US008426137B2

(12) United States Patent
Bergeron et al.

(10) Patent No.: US 8,426,137 B2

(45) **Date of Patent: *Apr. 23, 2013**

(54) METHODS AND PROBES FOR DETECTING A VANCOMYCIN RESISTANCE GENE

(75) Inventors: Michel G. Bergeron, Québec (CA); Maurice Boissinot, Saint-Augustin-de-Desmaures (CA); Ann Huletsky, Sillery (CA); Christian Menard, St-Lambert-de-Lévis (CA); Marc Ouellette, Sillery (CA); Francois J. Picard, Cap-Rouge (CA); Paul H. Roy, Loretteville (CA)

(73) Assignee: Genohm Sciences Canada, Inc., Sainte-Foy (BZ)

( * ) Notice: Subject to any disclaimer, the term of this patent is extended or adjusted under 35 U.S.C. 154(b) by 0 days.

This patent is subject to a terminal disclaimer.

(21) Appl. No.: 13/176,626

(22) Filed: Jul. 5, 2011

(65) Prior Publication Data

US 2012/0035071 A1 Feb. 9, 2012

Related U.S. Application Data

(63) Continuation of application No. 11/522,253, filed on Sep. 14, 2006, now abandoned, which is a continuation-in-part of application No. 11/236,785, filed on Sep. 27, 2005, now Pat. No. 8,114,601, which is a continuation of application No. 10/089,177, filed as application No. PCT/CA00/01150 on Sep. 28, 2000, now abandoned, said application No. 11/522,253 is a continuation-in-part of application No. 10/753,169, filed on Jan. 7, 2004, now Pat. No. 8,034,588, which is a continuation of application No. 09/989,643, filed on Nov. 20, 2001, now abandoned, which is a continuation of application No. 09/297,539, filed as application No. PCT/CA97/00829 on Nov. 4, 1997, now abandoned, which is a continuation-in-part of application No. 08/743,637, filed on Nov. 4, 1996, now Pat. No. 5,994,066.

(30) Foreign Application Priority Data

Sep. 28, 1999 (CA) ..................................... 2283458
May 19, 2000 (CA) ..................................... 2307010

(51) Int. Cl.

| | |
|---|---|
| ***C12Q 1/68*** | (2006.01) |
| ***C12P 19/34*** | (2006.01) |
| ***C07H 21/02*** | (2006.01) |
| ***C07H 21/04*** | (2006.01) |

(52) U.S. Cl.

USPC ......... 435/6.15; 435/6.1; 435/6.12; 435/91.2; 536/23.7; 536/24.32; 536/24.33

(58) Field of Classification Search ........................ None
See application file for complete search history.

(56) References Cited

U.S. PATENT DOCUMENTS

| | | | |
|---|---|---|---|
| 4,816,389 | A | 3/1989 | Sansonetti et al. |
| 5,030,556 | A | 7/1991 | Beaulieu et al. |
| 5,041,372 | A | 8/1991 | Lampel et al. |
| 5,084,565 | A | 1/1992 | Parodos et al. |
| 5,089,386 | A | 2/1992 | Stackebrandt et al. |
| 5,162,199 | A | 11/1992 | Stern et al. |
| 5,232,831 | A | 8/1993 | Milliman et al. |
| 5,292,874 | A | 3/1994 | Milliman |
| 5,298,392 | A | 3/1994 | Atlas et al. |
| 5,334,501 | A | 8/1994 | Adams et al. |
| 5,389,513 | A | 2/1995 | Baquero et al. |
| 5,401,631 | A | 3/1995 | Lane et al. |
| 5,437,978 | A | 8/1995 | Ubukata et al. |
| 5,472,843 | A | 12/1995 | Milliman |
| 5,476,929 | A | 12/1995 | Briles et al. |
| 5,523,205 | A | 6/1996 | Cossart et al. |
| 5,523,217 | A | 6/1996 | Lupski et al. |
| 5,541,308 | A | 7/1996 | Hogan et al. |
| 5,574,145 | A | 11/1996 | Barry et al. |
| 5,595,874 | A | 1/1997 | Hogan et al. |
| 5,599,665 | A | 2/1997 | Barbieri et al. |
| 5,627,275 | A | 5/1997 | Roll |
| 5,652,102 | A | 7/1997 | Fratamico et al. |
| 5,708,160 | A | 1/1998 | Goh et al. |
| 5,866,336 | A | 2/1999 | Nazarenko et al. |
| 5,994,066 | A | 11/1999 | Bergeron et al. |
| 6,001,564 | A | 12/1999 | Bergeron et al. |
| 6,037,130 | A | 3/2000 | Tyagi et al. |
| 6,582,908 | B2 | 6/2003 | Fodor et al. |
| 6,610,836 | B1 | 8/2003 | Breton et al. |

(Continued)

FOREIGN PATENT DOCUMENTS

| | | |
|---|---|---|
| CA | 2052822 | 4/1992 |
| EP | 0 133 288 | 2/1985 |

(Continued)

OTHER PUBLICATIONS

Abdulkarim et al., Homologous Recombination between the *tuf* Genes of *Salmonella typhimurium*, J Mol Bio.(1996) 260: 506-522.

Abe et al., A Sensitive Method for the Detection of Enterotoxigenic *Escherichia coli* by the Polymerase Chain Reaction Using Multiple Primer Pairs, Zentralbl Bakteriol. (1992) 277(2): 170-8 (Abstract Only).

Akaboshi et al., Nucleotide sequence of the recA gene of Proteus mirabilis, Nucleic Acids Res. (1989) 17(11): 4390-4390.

Ako-Nai et al., The Characterisation of Clinical Isolates of *Staphylococcus aureus* in Ile-Ife, Nigeria, J Med Microbiol. (1991) 34: 109-112.

Altschul et al., Basic Local Alignment Search Tool, J Mol Biol. (1990) 215: 403-410.

(Continued)

*Primary Examiner* — Carla Myers

(74) *Attorney, Agent, or Firm* — Knobbe Martens Olson & Bear LLP

(57) ABSTRACT

Compositions and methods for the detection of vancomycin-resistant pathogens using primers and/or probes to the vanA and vanB genes.

20 Claims, 38 Drawing Sheets

U.S. PATENT DOCUMENTS

| | | | | |
|---|---|---|---|---|
| 8,034,588 | B2 * | 10/2011 | Bergeron et al. | 435/91.2 |
| 8,067,207 | B2 * | 11/2011 | Bergeron et al. | 435/91.2 |
| 2003/0049636 | A1 * | 3/2003 | Bergeron et al. | 435/6 |
| 2003/0180733 | A1 | 9/2003 | Bergeron et al. | |
| 2004/0185478 | A1 | 9/2004 | Bergeron et al. | |
| 2005/0042606 | A9 | 2/2005 | Bergeron et al. | |
| 2006/0263810 | A1 | 11/2006 | Bergeron et al. | |
| 2007/0009947 | A1 | 1/2007 | Bergeron et al. | |
| 2007/0105129 | A1 | 5/2007 | Bergeron et al. | |
| 2009/0047671 | A1 | 2/2009 | Bergeron et al. | |
| 2009/0053702 | A1 | 2/2009 | Bergeron et al. | |
| 2009/0053703 | A1 | 2/2009 | Bergeron et al. | |
| 2009/0068641 | A1 | 3/2009 | Bergeron et al. | |
| 2010/0267012 | A1 | 10/2010 | Bergeron et al. | |

FOREIGN PATENT DOCUMENTS

| | | | |
|---|---|---|---|
| EP | 0 133 671 | | 3/1985 |
| EP | 0 272 009 | | 6/1988 |
| EP | 0 277 237 | A1 | 8/1988 |
| EP | 0 297 291 | B1 | 1/1989 |
| EP | 0 337 896 | | 10/1989 |
| EP | 0 364 255 | | 4/1990 |
| EP | 0 438 115 | A2 | 7/1991 |
| EP | 0 466 251 | | 1/1992 |
| EP | 0 527 628 | A1 | 2/1993 |
| EP | 0 577 523 | | 1/1994 |
| EP | 0 630 973 | A2 | 12/1994 |
| EP | 0 652 291 | A1 | 5/1995 |
| EP | 0 695 803 | A2 | 2/1996 |
| EP | 0 761 815 | | 3/1997 |
| EP | 0 786 519 | | 7/1997 |
| EP | 0 804 616 | | 11/1997 |
| FR | 2584419 | A1 | 1/1987 |
| FR | 2599743 | A1 | 12/1987 |
| FR | 2636075 | | 3/1990 |
| FR | 2685334 | A1 | 6/1993 |
| FR | 2686604 | A1 | 7/1993 |
| FR | 2699539 | A1 | 6/1994 |
| JP | 06-054700 | | 3/1994 |
| JP | 06-090798 | | 4/1994 |
| JP | 06-165681 | | 6/1994 |
| JP | 07-067657 | | 3/1995 |
| JP | 07-209294 | | 8/1995 |
| WO | WO 90/14444 | | 11/1990 |
| WO | WO 91/08305 | | 6/1991 |
| WO | WO 91/11531 | | 8/1991 |
| WO | WO 91/16454 | | 10/1991 |
| WO | WO 91/18926 | | 12/1991 |
| WO | WO 92/03455 | | 3/1992 |
| WO | WO 92/11273 | | 7/1992 |
| WO | WO 92/14488 | | 9/1992 |
| WO | WO 93/03186 | | 2/1993 |
| WO | WO 93/12245 | | 6/1993 |
| WO | WO 94/02645 | | 2/1994 |
| WO | WO 94/17205 | | 8/1994 |
| WO | WO 95/00650 | | 1/1995 |
| WO | WO 95/09025 | | 4/1995 |
| WO | WO 95/20055 | | 7/1995 |
| WO | WO 96/00298 | | 1/1996 |
| WO | WO 96/02648 | | 2/1996 |
| WO | WO 96/08582 | | 3/1996 |
| WO | WO 96/18745 | | 6/1996 |
| WO | WO 98/20157 | | 5/1998 |
| WO | WO 99/24059 | | 5/1999 |
| WO | WO 00/14274 | | 3/2000 |
| WO | WO 01/23604 | | 4/2001 |
| WO | WO 2004/055205 | | 7/2004 |

OTHER PUBLICATIONS

Amann et al., β-Subunit of ATP-Synthase: A Useful Marker for Studying the Phylogenetic Relationship of Eubacteria J Gen Microbiol. (1988) 134: 2815-2821.

Aminov et al., Cloning, Sequencing and Complementation Analysis of the *recA* Gene from *Prevotella ruminicola*, FEMS Microbiol Lett. (1996) 144(1): 53-59.

An et al., the Nucleotide Sequence of *tufB* and four nearby *tRNA* Structural Genes of *Escherichia coli*, Gene, (1980) 12(1-2): 33-39.

Anborgh et al., New Antibiotic that Acts Specifically on the GTP-Bound Form of Elgonation Factor Tu, Embo J. (1991) 10(4): 779-784.

Andersson et al., Unusual Organization of the rRNA Genes in *Rickettsia prowazekii*, J Bacteriol. (1995) 177(14): 4171-4175.

Aragón et al., Increase in β-lactam-resistant *Proteus mirabilis* Strains due to CTX-M- and CMY-type as well as New VEB-and Inhibitor-resistant TEM-type β-lactamases, J Antimicro Chemother. (2008) 61: 1029-1032.

Ashimoto et al., Molecular epidemiology of Staphylococcus spp. contamination in the ward environment: study on mecA and femA genes in methicillin-resistant strains, Kasenshogaku Zasshi (1995) 69: 15-20.

Bäckman et al., Evaluation of an Extended Diagnostic PCR Assay for Detection and Verification of the Common Causes of Bacterial Meningitis in CSF and other Biological Samples, Mol Cell Probes (1999) 13: 49-60.

Bagley et al., Significance of Fecal Coliform-positive *Klebsiella*, App Environ Microbio. (May 1977) 33(5): 1141-1148.

Balows et al., Eds. The Prokaryotes: A Handbook on the Biology of Bacteria: Ecophysiology, Isolation, Identification, Applications, 2nd Ed., Brenner, Introduction to the Family Enterobacteriaceae, Springer Verlag (1992) Chapter 141, pp. 2673-2695.

Balows et al., Eds. The Prokaryotes: A Handbook on the Biology of Bacteria: Ecophysiology, Isolation, Identification, Applications, 2nd Ed., Brenner, Additional Genera of Enterobacteriaceae, Springer Verlag (1992) Chapter 155, pp. 2922-2937.

Bej et al., Multiplex PCR amplification and immobilized capture probes for detection of bacterial pathogens and indicators in water, Mol. Cell. Probes (1990) 4: 353-365.

Belay et al., Methanogenic Bacteria from Human Dental Plaque, App Environ Microbiol.(1988) 54(2): 600-603.

Belay et al., Methanogenic Bacteria in Human Vaginal Samples, J Clin Microbiol.(1990) 28(7): 1666-1668.

Bell et al., Outer Membrane Protein H1 of *Pseudomonas aeruginosa*: Purification of the Protein and Cloning and Nucleotide Sequence of the Gene, J Bacteriol. (1989) 171(6): 3211-3217.

Bentley et al., Development of PCR-based Hybridization Protocol for Identification of Streptococcal Species, J Clin Microbiol. (1995) 33(5): 1296-1301.

Bercovier et al, Intra and Interspecies Relatedness of *Yersinia pestis* by DNA Hybridization and its Relationship to *Yersinia pseudotuberculosis*, Curr Microbiol. (1980) 4: 225-229.

Berg et al, Development of an Amplication and Hybridization Assay for the Specific and Sensitive Detection of *Mycoplasma fermantans* DNA. Mol Cell Probes, (1996) 10: 7-14.

Bergeron et al., Diagnosing Bacterial Infectious Diseases in One hour: An Essential Upcoming Revolution Infection (1995) 23(2): 69-72.

Bergeron et al., Preventing Antibiotic Resistance through Rapid Genotypic Identification of Bacteria and of Their Antibiotic Resistance Genes in the Clinical Microbiology Laboratory, J Clin Microbiol. (1998) 36(8): 2169-2172.

Berkenkamp et al, Infrared MALDI Mass Spectrometry of Large Nucleic Acids, Science (1998) 281: 260-262; American Association for the Advancement of science.

Betzl et al., Identification of Lactococci and Enterococci by Colony Hybridization with 23S rRNA-Targeted Oligonucleotide Probes, Appl Environ Microbio., (Sep. 1990) 56(9):2927-2929.

Birnboim, et al, A rapid alkaline extraction procedure for screening recombinant plasmid DNA, Nucleic Acids Res. (1979) 7(6): 1513-1523. (1979).

Black et al., Detection of streptococcal pyrogenic exotoxin genes by a nested polymerase chain reaction, Mol. Cell. Probes, 7 (1993) 255-259.

Bongaerts et al., In Vitro Activities of BAY Y3118, Ciprofloxacin, Ofloxacin, and Fleroxacin against Gram-Positive and Gram-Negative Pathogens from Respiratory Tract and Soft Tissue Infections, Antimicro Agents Chemother. (Sep. 1993) 37(9):2017-2019.

Brakstad et al., Detection of *Staphylococcusa aureus* by Polymerase Chain Reaction Amplification of the *nuc* Gene, J Clin Microbiol. (1992) 30(7): 1654-1660.

Brakstad et al., Comparison of Various Methods and Reagents for Species Identification of *Staphylococcus aureus* Positive or Negative for the mecA Gene, APMIS (1993) 101(9):651-654.
Brakstad et al., Multiplex Polymerase Chain Reaction for Detection of Genes for *Staphylococcus aureus* Thermonuclease and Methicillin Resistance and Correlation with Oxacilin Resistance, APMIS (1993) 101(9): 681-688.
Brakstad et al., Direct Identification of *Staphylococcus aureus* in blood cultures by detection of the gene encoding the thermostable nuclease or the gene product, APMIS (1995) 103: 209-218.
Bremaud et al Genetic and molecular analysis of the tRNA-tufB operon of the myxobacterium *Stigmatella aurantiaca*, Nucleic Acids Res. (1995)23(10): 1737-1743.
Brenner et al., Polynucleotide sequence relatedness among three groups of pathogenic *Escherichia coli* strains, Infect Immun. (1972) 6(3): 308-315.
Brenner et al., Polynucleotide sequence divergence among strains of *Escherichia coli* and closely related organisms, J Bacter. (1972) 109(3): 953-965.
Brenner et al., *Enterobacter gergoviae* sp nov.: a new species of *Enterobacteriaceae* found in clinical specimens and the environment, Int J Syst Bacter. (1980) 30(1): 1-6.
Brenner et al., *Escherichia vulneris*: a New Species of *Enterobacteriaceae* associated with human wounds, J Clin Microbiol. (1982) 15(6): 1133-1140.
Brenner et al., Attempts to classify herbicola group—*Enterobacter agglomerans* strains by deoxyribonucleic acid hybridization and phenotypic tests, Int J Sys Bacter. (1984) 34(1): 45-55.
Brenner et al., *Enterobacter asburiae* sp nov., a new species found in clinical spencimens, and reassignment of *Ervinia dissolvens* and *Ervinia nimipressuralis* to the genus *Enterobacter* as *Enterobacter dissolvens* comb nov and *Enterobacter nimipressuralis* comb nov., J Clin Microbiol. (1986) 23(6): 1114-1120.
Brenner et al., Classification of citrobacteria by DNA hybridization: Designation of *Citrobacter farmeri* sp nov., *Citrobacter youngae* sp nov., *Citrobacter braakii* sp nov., *Citrrobacter werkmanii* sp nove., *Citrobacter sedlakii* sp nove., and three unnambed *citrobacter* genomospecies, *Int J System Bacter*. (1993) 43(4): 645-658.
Brenner et al., Encoded combinatorial chemistry, Proc Natl Acad Sci. USA (1992) 89: 5381-5383.
Brenner et al., Biochemical identification of *Citrobacter* species defined by DNA hybridization and description of *Citrobacter gillenii* sp nov., J Clin Microbio. (1999) 37(8): 2619-2624.
Brisson-Noël et al. Evidence for natural gene transfer from gram-positive cocci to *Escherichia coli*, J Bacteriol. (1988) 170(4): 1739-1745.
Buck, et al., Design Strategies and Performance of Custom DNA Sequencing Primers, Biotechniques (1999) 27(3): 528-536.
Caldas et al., Chaperone properties of bacterial elongation factor EF-Tu, J Biol Chem. (1998) 273(19): 11478-11482.
Carlin et al., Monoclonal antibodies specific for elongation factor Tu and complete nucleotide sequence of the *tuf* gene in *Mycobacterium tuberculosis*, Infect Immun. (1992) 60(8): 3136-3142.
Chamberland et al., Antibiotic susceptibility profiles of 941 gram-negative bacteria isolated from Septicemi patients throught Canada: The Canadian Study Group, Clin Infect Dis. (1992) 15(4): 615-628.
Chen et al., Transcription and expression of the exotoxin A gene of *Pseudomonas aeruginosa*, Gen Microbiol. (1987) 133 (11): 3081-3091.
Chen et al., Broad range DNA probes for detecting and amplifying eubacterial nucleic acids, FEMS Micro Lett. (1989) 57: 19-24.
Chiu et al., Mass spectrometry of nucleic acids, Clin Chem. (1999) 45: 1578-1579.
Christensen et al., Phylogenetic relationships of *Salmonella* based on DNA sequence comparison of atpD encoding the β subunit of ATP synthase, FEMS Micro Lett. (1998) 161: 89-96.
Cilia et al., Sequence heterogeneities among 16S Ribosomal RNA sequences, and their effect on phylogenetic analyses at the species level, Clin Chem. ((1999) 45: 451-461.
Clayton et al., Intraspecific variation in small-subunit rRNA sequences in GenBank: Why single sequences may not adequately represent prokaryotic taxa, Int J System Bacteriol. (1995) 45(3): 595-599.
Cleuziat et al., Specific detection of *Escherichia coli* and *Shigella* species using fragments of genes coding for b-glucuronidase, FEMS Microbiol. Letters, (1990) 72: 315-322.
Cormican et al., Multiplex PCR for identifying mycobacterial isolates, J Clin Pathol. (1995) 48: 203-205.
Côte et al. Molecular Typing of Haemophilus influenzae Using a DNA Probe and Multiplex PCR, Mol Cell Probes, (1994) 8(1): 23-37.
Cousineau et al., On the Origin of Protein Synthesis Factors: A Gene Duplication/Fusion Model, J Mol Evol (1997) 45: 661-670.
Croizé, Les Méthodes Automatisées d'Identification des Bactéries a l'Aube de 1995, La Lettre de L'Infectiologu (1995) 10(4): 109-113. (French Language w/ Engl Abstract).
Deneer et al., Species-Specific Detection of *Listeria Monocytogens* by DNA amplification, Appl. Envion Mircobiol. (1991) 57(2): 606-609.
Derecola et al., A 5-Year Surveillance Study of 44,691 Isolates of *Haemophilus Influenzae* Project Beta-Alert 1993-1997, Antimicro Agen Chemothera. (Jan. 1999) 43(1):185-186.
Designer PCR, The advertisement from Research Genetics. Nucleic Acids Res. 22(15), Aug. 11, 1994.
Dickey et al., Emended description of *Enterobacter cancerogenus* comb nov. Int J System Bacteriol. (1988) 38(4): 371-374.
Dieffenbach et al., General concepts for PCR primer design, Genome Research (1993) 3: 30-37.
Dieffenbach et al. Eds. PCR Primer: A laboratory manual, Cha et al., Specificity, efficiency, and fidelity of PCR, Cold Spring Harbor Laboratory Press (1995) pp. 37-62.
Dieffenbach et al. Eds. PCR Primer: A laboratory manual, Kwok et al., Design and use of mismatched and degenerate primers, Cold Spring Harbor Laboratory Press (1995) pp. 143-155.
Dopazo, et al., A Computer Program for the Design of PCR Primers for Diagnosis of Highly Variable Genomes, J Virol Meth. (1993) 41:157-165.
Drmanac et al., DNA Sequence Determination by Hybridization: A strategy for efficient large-scale sequencing, Science (1993) 260: 1649-1652.
Duncan, Susceptibility of 1,500 Isolates of *Pseudomonas aeruginosa* to Gentamicin, Carbenicillin, Colistin, and Polymyxin B, Antimicro Agents Chemother. (Jan. 1974) 5(1): 9-15.
Dutilh et al., Specific Amplifications of a DNA Sequence Common Toall Chylamydia Trachomatis Serovars using the Polymerase Chain Reaction, Res Microbiol., (1989) 140: 7-16.
Dutka-Malen et al., Sequence of the vanC gene of *Enterococcus gallinarum* BM 4174 encoding a D-alanine:D-alanine ligase-related protein necessary for vancomycin resistance, Gene (1992) 112: 53-58.
Dutka-Malen et al., Detection of Glycopeptide Resistance Genotypes and Identification to the Species Level of Clinically Relevant *Enterococci* by PCR, J Clin Microbiol. (1995) 31(1): 24-27.
East et al., Cloning and Sequence Determination of six *Staphylococcus aureaus* betalactamasses and their expression in *Escherichia coli* and *Staphylococcus aureus*, J Gen Microbiol. (1989) 135(4): 1001-15.
Edwards et al., Multiplex PCR: Advantages, Development, and Applications, PCR Meth. Appl. (1994) 3: 565-575.
Egholm et al., PNA hybridizes to complementary oligonucleotides obeying the Watson-Crick hydrogen-bonding rules, Nature (1993) 365(10): 566-568.
Ehrlich et al., Eds. PCR-Based Diagnosis in Infectious Disease, Chapters 1, 3 , Blackwell Scientific Publications (1994), pp. 3-18 and 45-55.
Emori et al., An Overview of Nosocomial Infections, Including the Role of Microbiology Laboratory. Clin Microbiol Rev. (1993) 6(4): 428-442.
Evers et al., Sequence of the *vanB* and *ddl* Genes Encoding D-alanine:D-lactate and D-alanine:D-alanine Ligases in Vancomycin-resistant *Enterococcus faecalis* V583. Gene. (1994) 140(1): 97-102.
Experimental Protocol concerning Enablement of EP-B1 804 616 signed by Martin Gagnon/Marc Ouellette on Mar. 24, 2004.
Eykyn et al., The Causative Organisms of Septicaemia and Their Epidemiology. J Antimicrob Chemother. (1990) 25 Suppl C: 41-58.

Fani et al., Use of Random amplified polymorphic DNA (RAPD) for generating specific DNA probes for microorganisms, Mol Ecol. (1993) 2:243-250.
Farmer III et al., *Enterobacter sakazakii*: A new species of "*Enterobacteriaceae*" isolated from clinical specimens, Int J System Bacter. (1980) 30(3): 569-584.
Farmer III et al., Biochemical identification of new species and biogroups of *Enterobacteriaceae* isolated from clinical specimens, J Clin Microbiol. (1985) 21(1): 46-76.
Farmer III et al., *Escherichia fergusonii* and *Enterobacter taylorae*, two new species of *Enterobacteriaceae* isolated from clinical specimens, J Clin Microbiol. (1985) 21(1): 77-81.
Farmer III, Proposed Rewording of Rule 10C of the Bacteriological Code, Int J Syst Bacter. (1985) 35(2): 222.
Feizabadi, Drug Resistant Patterns of *Enterococci Recovered from Patients in Tehran During 2000-2003, Letters to the Editor, Int J Antimicrob Agents* (2004) 24: 521-522.
Fenoll et al., Serotype Distribution and Antimicrobial Resistance of *Streptococcus pneumoniae* Isolates Causing Systemic Infections in Spain, 1979-1989, Reviews of Infect. Diseases (1991) 13: 56-60.
Figueroa et al., Multiplex Polymerase Chain Reaction based Assay for the Detection of *Babesia bigemina, Babesia bovis* and *Anaplasma marginale* DNA in Bovine Blood, Vet Parasit., (1993) 50: 69-81.
Filer et al., Duplication of the *tuf*Gene, which encodes peptide chain elongation factor Tu, is widespread in gram-negative bacteria, J Bacter. (1981) 148(3): 1006-1011.
Fischer et al., Mannitol-specific Phosphoenolpyruvate-dependent Phosphotransferase System of *Enterococcus faecalis*: Molecular Cloning and Nucleotide Sequences of the Enzyme $III^{Mtl}$ Gene and the Mannitol-1-phosphate Dehydrogenase Gene, Expression in *Escherichia coli*, and Comparison of the Gene Products with Similar Enzymes, J Bacteriol. (1991) 173(12): 3709-3715.
Fischer et al., Predicting structures for genome proteins, Curr Opin Struct Biol. (1999) 9: 2008-211.
Fleischmann et al., Whole-genome Random Sequencing and Assembly of *Haemophilus influenzae* Rd. Science (1995) 269(5223): 496-512.
Flores et al., Recovery of DNA from Agarose Gels Stained with Methylene Blue. Biotechniques. (1992) 13(2): 203-205.
Fox et al., How Close is Close: 16S rRNA sequence identity may not be sufficient to guarantee species identity, Int J Syst Bacter. (1992) 42(1): 166-170.
Fratamico et al., Detection of *Escherichia coli* O157:H7 by multiplex PCR, J Clin Microbiol., (1995) 33(8): 2188-2191.
Friedland et al., Development of a Polymerase Chain Reaction Assay to Detect the Presence of *Streptococcus pneumoniae* DNA, Diagn Microbio Infect Dis. (1994) 20(4): 187-193.
Gannon et al., Rapid and Sensitive Method for Detection of Shiga-like Toxin-producing *Escherichia coli* in Ground Beef Using the Polymerase Chain Reaction, Appl Env Microbiol. (1992) 58(12): 3809-3815.
Gavini et al., Transfer of *Enterobacter agglomerans* (Beijerinck 1999) Ewing and Fife 1972 to *Pantoea* gen. nov. as *Pantoea agglomerans* comb. Nov. and description of *Pantoea dispersa* sp nov., Int J System Bacteriol. (1989) 39(3): 337-345.
Geha et al., Multiplex PCR for Identification of Methicillin-Resistant Staphylococci in the Clinical Labortory, J Clin Microbiol. (1994), 32(7): 1768-72.
Genbank GI:147581 [online] Sep. 14, 1992 [retrieved on Oct. 12, 2008], retrieved from http://www.ncbi.nlm.nik.gov/entrez/viewer.fcgi?147581:OLDID:114614 (4 pages).
Genbank Accession No. M37185, *Enterococcus faecalis* Gelatinase E(gelE) Gene, Complete CDS (Apr. 1993).
Genbank Accession No. Z26902, Phylogenetic Analysis Using 16S rDNA Sequencing of Staphylococci (Oct. 1993).
Gillespie et al., Detection of *Streptococcus pneumoniae* in sputum samples by PCR, J Clin Microbiol. (1994) 32(5): 1308-11.
Gogarten et al., Evolution of the vacuolar $H^+$—ATPase: Implications for the origin off eukaryotes, Proc Natl Acad Sci. USA, 86: 6661-6665, 1989.
Gray et al., Cloning, Nucleotide Sequence, and Expression in *Escherichia coli* of the Exotoxin A Structural Gene of *Pseudomonas aeruginosa*, Proc Natl Acad Sci USA. (1984) 81(9): 2645-2649.
Greer, Comparative modeling of homologous proteins, Methods in Enzymology, (1991) 202: 239-252.
Greisen et al., PCR Primers and Probes for the 16S rRNA Gene of Most Species of Pathogenic Bacteria, Including Bacteria Found in Cerebospinal Fluid, J Clin Microbiol. (1994) 32(2): 335-351.
Griffin et al., Eds PCR Technology—Current Innovations; Sharrocks, Chapter 2: The Design of Primers for PCR; CRC Press (1994) 5-11.
Guay et al., Detection of the Pathogenic Parasite *Toxoplasma gondii* by Specific Amplification of Ribosomal Sequences Using Comultiplex Polymerase Chain Reaction, J Clin Microbiol. (1993) 31(2): 203-207.
Guex et al., Protein modelling for all (Swiss-Model), TIBS 24 Computer Corner (1999) pp. 364-367.
Gupta et al., Protein phylogenies and signature sequences: a reappraisal of evolutionary relationships among *Archaebacteria, Eubacteria*, and *Eukaryotes*, Micro Mol Bio Rev. (1998) 62(4): 1435-1491.
Gutierrez et al., Point Mutations that Reduce the Expression of maIPQ, a Positively Controlled Operon of *Escherichia coli*, J Mol Biol. (1984) 177(1): 69-86.
Guzmàn et al., Role of Adherence in Pathogenesis of *Enterococcus faecalis* Urinary Tract Infection and Endocarditis, Infect Immun. (Jun. 1989) 57(6): 1834-1838.
Harrison et al., Eds Micro Total Analysis Systems '98, Anderson et al., Advances in Integrated Genetic Analysis, Proceedings of the uTAS '98 Workshop, Banff, Canada Oct. 13-16, 1998; Kluwer Academic Publishers, Dordrecht, The Netherlands (1998) pp. 11-16, Heller et al., An integrated microelectronic hybridization system for genomic research and diagnostic applications, pp. 221-224.
Hartl et al., The Population Genetics of *Escherichia coli*, Ann Rev Genet. (1984) 18: 31-68.
Hedegaard et al., Identification of *Enterobacteriaceae* by partial sequencing of the gene encoding translation initiation factor 2, Int J System Bacter. (1999) 49: 1531-1538.
Higashide et al., Methicillin-resistant *Staphylococcus saprophyticus* Isolates Carrying Staphylococcal Cassette Chromosome *mec* Have Emerged in Urogenital Tract Infections, Antimicrob Agents Chemother. (Jun. 2008) 52(6): 2061-2068.
Hill et al., Inversions between ribosomal RNA genes of *Escherichia coli*, Proc Natl Acad Sci. USA (1981) 78(11): 7069-7072.
Horii et al., Organization of the recA Gene of *Escherichia coli*, Proc Natl Acad Sci USA. (1980) 77(1): 313-317.
Hotomi et al., Detection of *Haemophilus influenzae* in Middle Ear of Otitis Media with Effusion by Polymerase Chain Reaction, Int J Pediatr Otorhinolaryngol. (1993) 27(2): 19-26.
Houard, et al. Specific Identification of *Bordetella pertussis* by the Polymerase Chain Reaction, Res Microbio. (1989) 140: 477-487.
Hynes et al., Pcr Amplification of Streptococcal DNA Using Crude Cell Lysates, FEMS Microbiol Lett. (1992) 94: 139-142.
Ibrahim et al., The phylogeny of the genus *Yersinia* based on 16S rDNA sequences, FEMS Micro Lett. (1993) 114: 173-178 and Corrigendum FEMS Microbiol Lett. (1994) 116: 243.
Innis et al., Eds. Statistical Refinement of Primary Design Parameters, PCR Applications; Beasley et al., Statistical refinement of primer design parameters, Academic Press (1999) Chapter 5: 55-71.
Iwabe et al., Evolutionary relationship of archaebacteria, eubacteria, and eukaryotes inferred from phylogenetic trees of duplicated genes, Proc Natl Acad Sci. USA (1989) 86: 9355-9359.
Izard et al., Deoxyribonucleic acid relatedness between *Enterobacter cloacae* and *Enterobacter amnigenus* sp nov., Int J System Bacter. (1981) 31(1): 35-42.
Izumiya et al., Characterization of Multidrug-Resistant *Salmonella enterica* Serovar Typhimurium Isolated in Japan, J Clin Microbio. (Jul. 2001) 39(7):2700-2703.
Janda et al., Prototypal diarrheagenic strains of *Hafnia alvei* are actually members of the genus *Escherichia*, J Clin Microbiol. (1999) 37(8): 2399-2401.
Jenkins, F. J., Basic Methods for the Detection of PCR Products, Genome Res. (Apr. 1994) 3:S77-S82.
Johnson, et al. Urinary Tract Infections in Women: Diagnosis and Treatment, Ann Intern Med. (1989) 111: 906-917.

Jordá, et al. Diagnosis of Nosocomial Pneumonia in Mechanically Ventilated Patients by the Blind Protected Telescoping Catheter, Intensive Care Med. (1993) 19:377-382.
Kamla, (1994) Database Empro EMBL AC: z34275.
Kaper et al., Pathogenicity islands and Other Mobile Genetic Elements of Diarrheagenic *Escherichia Coli*, Am Soc Microbio. (1999) 3: 33-58.
Kaufhold et al., Identical Genes Confer High-Level Resistance to Gentamicin upon *Enterococcus faecalis, Enterococcus faecium*, and *Streptococcus agalactiae*, Antimicrob Agents Chemother. (1992) 36(6): 1215-1218.
Kearns et al., Rapid Detection of Methicillin-Resistant Staphylococci by Multiplex PCR, J Hosp Infect. (1999) 43: 33-37.
Kellogg et al., TaqStart Antibody: "hot start" PCR Facilitated by a Neutralizing Monoclonal Antibody Directed Against Taq DNA Polymerase. Biotechniques (1994) 16(6): 1134-1137.
Khan et al., Detection of *Pseudomonas aeruginosa* from Clinical and Environmental Samples by Amplification of the Exotoxin A Gene Using PCR, Appl Environ Microbiol. (1994)60(10): 3739-3745.
Kim et al., Simultaneous Detection by PCR of *Escherichia coli, Listeria Monocytogenes* and *Salmonella typhimurium* in Artificially Inoculated Wheat Grain, Inter'l J Food Microbio. (Apr. 2006) 111:21-25.
Kimura, A simple method for estimating evolutionary rates of base substitutions through comparative studies of nucleotide sequences, J Mol Evol (1980) 16: 111-120.
Kitch et al., Evaluation of RApID onE system for identification of 379 strains in the family *Enterobacteriaceae* and oxidase negative, gram-negative nonfermenters, J Clin Microbiol. (1994) 32(4): 931-934.
Kloos et al., Siplified scheme for routine identification of human *Staphylococcus* species, J Clin Microbiol. (1975) 1(1): 82-88.
König, et al. Analyses of the Flash Track DNA Probe and UTIscreen Bioluminescence Tests for Bacteriuria, J Clin Microbiol. (1992) 30(2): 342-345.
Kong et al., Co-detection of Three Species of Water-borne Bacteria by Multiplex PCR, Marine Pollution Bulletin, (1995) 31 (4-12): 317-324.
Koshkin et al., LNA (Locked Nucleic Acids): Synthesis of the Adenine, Cytosine, Guanine, 5-Methylcytosine, Thymine and Uracil bicyclonucleoside monomers, oligomerisation, and unprecedented nucleic acid recognition, Tetrahedron (1998) 54: 3607-3630.
Kwok et al., Avoiding False Positive with PCR, Nature (1989) 339: 237-238.
Lawrence et al., Molecular and Evolutionary Relationships Among Enteric Bacteria, J Gen Microbiol. (1991) 137(8): 1911-1921.
Le Bouguenec et al., Rapid and Specific Detection of the pap, afa, and sfa Adhesin-encoding Operons in Uropathogenic *Escherichia coli* Strains by Polymerase Chain Reaction, J Clin Microbiol. (1992) 30(5): 1189-1193.
Lee et al., Eds Nucleic Acid Amplification Technologies: Application to Disease Diagnosis, Chapter 5 by Carrino et al. Ligation-based nucleic acid probe methods, Biotechniques Boods, Div. Eaton Publishing (1997), pp. 61-78.
Lee et al., Eds Nucleic Acid Amplification Technologies: Application to Disease Diagnosis, Chapter 6 by Martin et al. PCR and its modifications for the detection of infectious diseases, Biotechniques Boods, Div. Eaton Publishing (1997), pp. 79-99.
Lee et al., Eds Nucleic Acid Amplification Technologies: Application to Disease Diagnosis, Chapter 7 by Olive et al. Qβ replicase assays for the clinical detection of infectious agents, Biotechniques Boods, Div. Eaton Publishing (1997), pp. 101-112.
Lee et al., Eds Nucleic Acid Amplification Technologies: Application to Disease Diagnosis, Chapter 8 by McDonough et al. Application of transcription-medicated amplification . . . , Biotechniques Boods, Div. Eaton Publishing (1997), pp. 113-122.
Lewin, Benjamin, Genes IV, Chapter 3: Genes are mutable units; Oxford University Press (1990) pp. 41-56.
Lewin, Benjamin, Genes IV, Oxford University Press (1990) pp. 497-517.
Lewis et al., Emergence of Clinical Isolates of *Staphylococcus aureus* Resistant to Gentamicin and Correlation of Resistance with Bacteriophage Type, J Infect Diseases, (Mar. 1978) 137(3): 314-317.
Li et al., Identification of *Bordetella pertussis* Infection by Shared-primer PCR, J Clin Microbiol., (1994) 32(3): 783-789.
Livak et al., Oligonucleotides with fluorescent dyes at opposite ends provide a quenched probe system useful for detecting PCR product and nuclei acid hybridization, PCR Methods & Applications, (1995) Cold Spring Harbor Laboratory Press, 4: 357-362.
Loechel et al., Nucleotide Sequence of the *tuf* Gene from *Mycoplasma genitalium*, Nucleic Acids Res. (1989) 17(23): 10127.
Lowe et al., Nucleotide Sequence of the Aliphatic Amidase Regulator Gene (amiR) of *Pseudomonas aeruginosa*, FEBS Lett. (1989) 246 (1-2): 39-43.
Ludwig et al., Database Empro. EMPBL AC:X76863 (Oct. 1994), X76866 (Sep. 1994), X76867 (Oct. 1994), X76871 (Sep. 1994), and X76872 (Sep. 1994).
Ludwig et al., Complete nucleotide sequences of seven eubacterial genes coding for the elongation factor Tu: functional, structural and phylogenetic evaluations, Arch Microbiol. (1990) 153: 241-247.
Ludwig et al., Phylogenetic relationships of *Bacteria* based on comparative sequence analysis of elongation factor Tu and ATP-synthase β-subunit genes, Antonie von Leeuwenhoek (1993) 64: 285-305.
Lüneberg et al., Detection of *Mycoplasma pneumoniae* by Polymerase Chain Reaction and Nonradioactive Hybridization in Microtiter Plates, J Clin Microbiol. (1993) 31(5): 1088-1094.
Madico et al., Touchdown Enzyme Time Release-PCR for Detection and Identification of *Chlamydia trachomatic, C. pneumoniae*, and *C. psittaci* Using the 16S and 16S-23S Spacer rRNA Genes, J Clin Microbiol., (Mar. 2000) 38(3): 1085-1093.
Malloy et al., Detection of Borrelia Burgdorferi Using Polymerase Chain Reaction, J Clin Microbiol. (1990), 28(6): 1089-1093.
McCabe et al., Bacterial species identification after DNA amplification with a universal primer pair, Mol Gen Metabol. (1999) 66: 205-211.
McIntosh et al., Detection of *Pseudomonas aeruginosa* in Sputum from Cystic Fibrosis Patients by the Polymerase Chain Reactions, Mol Cell Probes (1992) 6(4): 299-304 Abstract Only.
McMillian et al., Simultaneous Detection of Toxin a and Toxin B Genetic Determinants of *Clostridium difficile* Using the Multiplex Polymerase Chain Reaction, Can J Microbiol., (1992) 38: 81-83.
Metherell et al., Rapid, sensitive, mircobial detection by gene amplification using restriction endonuclease target sequences, Mol Cell Probes (1997) 11: 297-308.
Miller et al., General microbiology of *recA*: Environmental and evolutionary significance, Ann Rev Microbiol. (1990) 44: 365-394.
Miller et al., Community Acquired Lobar Pneumonia in Patients with HIV Infection and AIDS, Thorax (Apr. 1994) 49:367-368.
Mitsuhashi M., Technical Report: Part 2. Basic Requirements for Designing Optimal PCR Primers, J Clin Lab Anal., (1996) 10: 285-293.
Mollet et al., *rpoB* sequence analysis as a novel basis for bacterial identification, Mol Microbiol. (1997) 26(5): 1005-1011.
Monod et al., Sequence and Properties of pIM13: A Macrolide-lincosamide-streptogramin B resistance Plasmid from *Bacillus subtilis*, J Bacteriol. (1986) 167(1): 138-147.
Murphy et al., (1986) Database Empro. EMBL. AC:X03216.
Murakami et al., Identification of Methicillin-Resistant Strains of *Staphylococci* by Polymerase Chain Reaction, J Clin Microbio. (1991) 29(10): 2240-2244.
Murray et al., Eds. Manual of Clinical Microbiology; Tang et al., Molecular detection and identification of microorganisms, ASM Press, 7th Ed, (1999) Chapter 13, pp. 215-244.
NCBI Blast: Nucleotide Sequence, Attachment for Sequence Comparison between 5'-CCAGCTGTATTAGAAGTA-3' from Seq ID No. 9 and Genomes of *Bacteria Bacillus Cereus* Q1 and AH187, (online: Apr. 12, 2009) 1 page.
NCBI Blast: Nucleotide Sequence, Attachment for Sequence Comparison between 5'CTGAACATTATCTTTGAT-3' from Seq ID No. 10 and Complete Genome of *Streptococcus mutans* UA159, (online: Apr. 12, 2009) 1 page.
Neidhardt et al., Eds. *Escherichia coli* and *Salmonella* Cellular and Molecular Biology, 2nd Ed., Grunberg-Manago, Regulation of the expression of aminoacyl-tRNA Synthetases and translation Factors, ASM Press, 2nd Ed. (1996) vol. 1, Chapt. 91: 1432-1457.

Neidhardt et al., Eds. *Escherichia coli* and *Salmonella* Cellular and Molecular Biology, Selander et al., Evolutionary Genetics of *Salmonella enterica*, ASM Press (1996) 2nd Ed., Chapt 147: 2691-2707.
Nelson et al., The Evolution of $H^+$—ATPases, TIBS (1989) 14: 113-116.
Neu, Harold C., The Crisis in Antibiotic Resistance, Science (Aug. 1992) 257:1064-1073.
Nichols et al., A universal nucleoside for use of ambiguous sites in DNA primers, Letters to Nature (1994) 369: 492-493.
Nikiforov et al., The use of 96-well Polystyrene plates for DNA hybridization-based assays: An evaluation of different approaches of oligonucleotide immobilization, Anal. Biochem. (1995) 227: 201-209.
Nikiforov et al., The use of phosphorothioate primers and exonuclease hydrolysis for the preparation of single-stranded PCR products and their detection by solid-phase hybridization, PCR Methods and Applications, (1994) 3: 285-291.
O'Callaghan et al., Development of a PCR Probe Test for Identifying *Pseudomonas aeruginosa and Pseudomonas* (*Burkholderia*) *cepacia*, J Clin Pathol. (1994) 47(3): 222-226.
Ohama et al., Organization and Codon Usage of the Streptomycin Operon in *Micrococcus luteus*, a Bacterium with a High Genomic G+C Content, J Bacteriol. (1987) 169(10): 4770-4777.
Olcén et al., Rapid Diagnosis of Bacterial Meningitis by a Seminested PCR Strategy, Scand J Infect Dis. (1995) 27(5): 537-539.
Ouellette et al., Precise Insertion of Antibiotic Resistance Determinants into Tn*21*like Transposons: Nucleotide Sequence of the OXA-1 β-lactamase Gene, Proc Natl Acad Sci. USA (1987) 84: 7378-7383.
Palm et al., Evolution of Catalytic and Regulatory Sites in Phosphorylases, Nature (1985) 313(6002): 500-502.
Paradis et al., The Potential of EF-Tu Sequences for Identification of Clinically Important Enterobacteriaceae Species (Sep. 1999) Intersci Conf Antimicrob Agents Chemother., 39: 227; Abstract 1574.
Perlee, et al. (1993) Database Empro EMBL, Translation elongation factor EF-Tu of *Borrelia burgdorferi*—CA:L23125.
Persing et al., Eds. Diagnostic Molecular Microbiology: Principles and Applications, Nucleic Acid Probes for Detection and Identification of Infectious Agents by Tenover, et al., American Society for Microbiology (1993) pp. 3-25.
Persing et al., Eds. Suppl to Diagnostic Molecular Microbiology: Principles and Applications, Genotypic Methods for microbial identification by Reiman et al., American Society for Microbiology (1996) pp. 3-31.
Pezzlo, Detection of Urinary Tract Infections by Rapid Methods, Clin Microbiol Rev. (1988) 1(2): 268-280.
Pezzlo et al., Detection of Bacteriuria and Pyuria by Urinscreen, A Rapid Enzymatic Screening Test, J Clin Microbiol. (1992) 30(3): 680-684.
Podbielski, *Streptococcus agalactiae* Camp Gene. Submitted to Genbank database on Mar. 22, 1993, Accession No. 72754.
Podzorski et al., Molecular Detection and Identification of Microorganisms in Manual of Clinical Microbiology, (1995) ASM Press, pp. 130-157.
Pollard et al., A Polymerase Chain Reaction (PCR) Protocol for the Specific Detection of Chlamydia spp., Mol Cell Probes., (1989) 3: 383-389.
Porcella et al., Identification of an EF-Tu Protein that is Periplasm-associated and Processed in *Neisseria gonorrhoeae*, Miocrobiology (1996) 142: 2481-2489.
Post et al., Molecular Analysis of Bacterial Pathogens in Otitis Media with Effusion, JAMA (1995) 273(20): 1598-1604.
Post et al., Development and Validation of a Multiplex PCR-based Assay for the Upper Respiratory Tract Bacterial Pathogens *Haemophilus influenzae, Streptococcus pneumoniae*, and *Moraxella catarrhalis*, (1996) Molecular Diagnosis 1(1): 29-39.
Powers, Robert D., New Directions in the Diagnosis and Therapy of 844Urinary Tract Infections, (1991) Am J Obstet Gynecol., 164:1387-1389.
Priebe, et al., Nucleotide Sequence of the *hexA* Gene for DNA Mismatch Repair in *Streptococcus pneumoniae* and Homology of *hexA* to *mutS* of *Escherichia coli* and *Salmonella typhimurium*. J. Bacteriol. (1988) 170: 190-196.
Pritchard et al., Possible Insertion Sequences in a Mosaic Genome Organization Upstream of the Exotoxin A Gene in *Pseudomonas aeruginosa*, J Bacteriol. (1990) 172(4): 2020-2028.
Radström et al., Detection of Bacterial DNA in Cerebrospinal Fluid by an Assay for Simultaneous Detection of *Neisseria meningitidis, Haemophilus influenzae*, and *Streptococci* Using a Seminested PCR Strategy, J Clin Microbiol. (1994) 32(11): 2738-2744.
Reeve, Archaebacteria then . . . archaes now (Are there really no archaeal pathogens? J Bacter. (1999) 181(12): 3613-3617.
Rosa et al., A Specific and Sensitive Assay for the Lyme Disease Spirochete *Borrelia burgdorferi* Using the Polymerase Chain Reaction, J Infect Dis. (1989) 160(6): 1018-1028.
Rosa et al., Polymerase Chain Reaction Analyses Identify Two Distinct Classes of *Borrelia burgodorferi*, J Clin Microbiol., (1991) 29(3): 524-532.
Rudolph et al., Evaluation of Polymerase Chain Reaction for Diagnosis of Pneumococcal Pneumonia, J Clin Microbiol. (1993) 31(10): 2661-2666.
Ryffel et al., Sequence Comparison of mecA Genes Isolated from Methicillin-resistant *Staphylococcus aureus* and *Staphylococcus epidermidis*, Gene (1990) 94(1): 137-8 (Abstract).
Šali, Modelling mutations and homologous proteins, Curr Opin Biotech. (1995) 6: 437-451.
Sambrook et al., Eds. Molecular Cloning: A Laboratory Manual, 2nd Ed. Cold Spring Harbor Laboratory Press, (1989) pp. 1.21-1.52, 9.31-9.62, 10.1-10.70, and 11.1-11.61.
Sambrook et al., Eds. Molecular Cloning: A Laboratory Manual, 2nd Ed. Cold Spring Harbor Laboratory Press, (1989) pp. 18.35-18.39.
Sánchez et al., Advances in comparative protein-structure modelling, Curr Opin Struct Biol. (1997) 7: 206-214.
Sanger et al., DNA Sequencing with Chain-Terminating Inhibitors, P.N.A.S. (1977) 74(12):5463-5467.
Saraste et al., The atp operon: nucleotide sequence of the genes for the γ, β, and ϵ subunits of *Escherichia coli* ATP synthase, Nucl Acids Res. (1981) 9(20): 5287-5296.
Schaechter et al., Mechanisms of Microbial Disease. The Enteric Bacteria: Diarrhea and Dysentery, Dept Microbiol Immunol., (1989), 17: 256-265.
Sela et al., Duplication of the *tuf* Gene: a new insight into the Phylogeny of Eubacteria, J Bacteriol. (1989) 171(1): 581-584.
Sharma et al., Identification of *Yersinia* species by the API 20E, J Clin Microbio. (1990) 28(6): 1443-1444.
Shaw et al., Isolation, Characterization, and DNA Sequence Analysis of an ACC(6')-II Gene from *Pseudomonas aeruginosa*, Antimicro Agents Chimo. 33(12): 2052-2062, 1989.
Silvestrini et al., Nitrite Reductase from *Pseudomonas aeruginosa*: Sequence of the Gene and the Protein, FEBS Lett. (1989) 254(1-2): 33-38.
Spierings et al., Characterization of the *Citrobacter freundii phoE* Gene and Development of *C. freundii—specific Oligonucleotides*, FEMS Microbiol. Letters (1992) 99:199-204.
Spröer et al., The phylogenetic position of *Serratia, Buttiauxella* and some other genera of the family Enterobacteriaceae, Int J System Bacteriol. (1999) 49: 1433-1438.
Stackebrandt et al., Taxonomic note: A place for DNA-DNA reassociation and 16S rRNA sequence analysis in the present species definition in bacteriology, Int J System Bacteriol. (1994) 44(4): 846-849.
Stacy-Phipps et al. Multiplex PCR Assay and Simple Preparation Method for Stool Specimans Detect Enterotoxigenic *Escherichia coli* DNA during Course of Infection, J Clin Microbio. (1995) 33(5): 1054-1059.
Stager et al., Automated Systems for Identification of Microorganisms, Clin Microbiol Rev. (1992) 5(3): 302-327.
Stark, et al., Bacteriuria in the Catherized Patient: What Quantitative Level of Bacteriuria is Relevant? N Engl J Med. (1984) 311(9): 560-564.
Steigerwalt et al., DNA relatedness among species of *Enterobacter* and *Serratia*, Can J Microbiol. (1976) 22: 121-137.
Su et al., Nucleotide Sequence of the Gelatinase Gene (gelE) from *Enterococcus faecalis* subsp. Liquefaciens, Infect. Immun. (1991) 59(1): 415-420.

Takezaki et al. Phylogenetic test of the molecular clock and linearized trees, Mol Biol Evol. (1995) 12(5): 823-833.
Taylor, Remotely related sequences and structures: analysis and predictive modelling, Trends Biotechnol. (1994) 12(5): 154-158.
Tyagi et al., Molecular beacons: probes that fluoresce upon hybridization, Nature Biotech. (1996) 14: 303-308.
Tyler et al., Streptococcal Erythrogenic Toxin Genes: Detection by Polymerase Chain Reaction and Association with Disease in Strains Isolated in Canada from 1940 to 1991, J Clin Microbiol. (1992) 30(12): 3127-3131.
Ubukata et al., Rapid Detection of the mecA Gene in Methicillin-resistant Staphylococci by Enzymatic Detection of Polymerase Chain Reaction Products, J Clin Microbiol. (1992) 30(7): 1728-1733.
Ueyama et al., High Incidence of *Haemophilus influenzae* in Nasopharyngeal Secretions and Middle Ear Effusions as Detected by PCR, J Clin Microbiol. (1995) 33(7): 1835-1838.
Ünal et al., Detection of Methicillin-Resistant Staphylococci by Using the Polymerase Chain Reaction, J Clin Microbio., (1992) 1685-1691.
Van Burik et al., Panfungal PCR Assay for Detection of Fungal Infection in Human Blood Specimens, J Clin Microbiol. (1998) 36(5): 1169-1175.
van Ketel, Detection of *Haemophilus influenzae* in Cerebrospinal Fluids by Polymerase Chain Reaction DNA Amplification, J Med Microbiol., (1990) 33: 271-276.
Vannuffel et al., Specific Detection of Methicillin-Resistant Staphylococcus Species by Multiplex PCR, J Clin Microbiology, (1995) 2864-2867.
Vijgenboom et al., Three *tuf*-like genes in the Kirromycin producer *Strept myc s ramocissimus*, Microbiol. (1994) 140: 983-998.
Wang et al., A 16S rDNA-based PCR Method for Rapid and Specific Detection of *Clostridium perfringens* in Food, Mol Cell Probes (1994) 8(2): 131-137.
Wang et al., Phylogenetic analysis and identification of *Shigella spp by molecular probes, Mol Cell Probes* (1997) 11: 427-432.
Watson et al., Molecular Biology of the Gene, 4th Ed. The Genetic Code; The Benjamin/Cummings Publishing Company, Inc., (1976) Chapter 15, pp. 339-358.
Watson et al., Molecular Biology of the Gene, vol. I—General Principles; 4th Ed. The Benjamin/Cummings Publishing Company, Inc., (1987) pp. 431-462.
Way et al., Specific Detection of *Salmonella spp.* By Multiplex Polymerase Chain Reaction, App Environ Microbiol. (1993) 59(5): 1473-1479.
Wayne et al., Report of the Ad Hoc Committee on Reconciliation of approaches to bacterial systematics, Int J Sys Bacter. (1987) 37(4): 463-464.
Weaver et al., Incidence of methanogenic bacteria in a sigmoidoscopy population: an association of methanogenic bacteria and diverticulosis, Gut 27: 698-704, 1986.
Weickmann and Weickmann, European Opposition for EP 0804616Spezifität der Primer, Annex II: Specific and ubiquitous primers for DNA amplification, 11 pages, (Sep. 13, 2007).
Weickmann and Weickmann, European Opposition for EP 0804616, Vergleich: Bacterial species: *Escherichia coli*, 1 page (Sep. 13, 2007).
Weickmann and Weickmann, European Opposition for EP 0804616, Comparison of Sequences TRP.0O3 and TRP.004 of W0 93/12245 with SEQ ID No. 5 of EP 804616 (Sep. 13, 2007).
Weickmann and Weickmann, European Opposition for EP 0804616Comparison of Sequence *E. coli* malPQ operon, 5'-end of Gutierrez et al., J. Mol. Biol. 177(1) (1984) 69-86 with SEQ ID No. 6 (glycogen phosphorylase) of EP 804616; of Sequence *E. coli* recA gene, 5'-region of Zhao et al., Mol.Gen.Genet. 222(2-3) (1990) 369-376 with SEQ ID No. 7 of EP 804616, and of exotoxin A gene of Chen et al., J. Gen. Microbiol. 133(11) (1987) 3081-3091 with SEQ ID No. 18 of EP 804616 (Sep. 13, 2007).
Weickmann and Weickmann, European Opposition for EP 0804616, Vergleich (Sequence Comparison) der SEQ ID No. 26 (Haemophilus influenzae omp P1 gene) aus EP804616 und Sonde 106b aus EP804616 mit Primer Homp1 und Homp3 aus Cote S. Et al., Mol. Cell. Probes (Feb. 1994) 8:23-37 (Sep. 13, 2007).
Weickmann and Weickmann, European Opposition for EP 0804616, Vergleich der SEQ ID No. 27 (Haemophilus influenzaetransformation gene cluster) und Primer 154 bzw 155b und Sonde 107b aus EP804616 mit Primer Htra3 aus Cote S. Et al., Mol. Cell. Probes (Feb. 1994) 8:23-37 (Sep. 13, 2007).
Weickmann and Weickmann, European Opposition for EP 0804616, Comparison of SEQ ID No. 8 to 21 of EP577523 with neuraminidase nanA of *Streptococcus pneumoniae* (cf. SEQ ID No. 35 of EP804616) (Sep. 13, 2007).
Weickmann and Weickmann, European Opposition for EP 0804616, Comparison of SEQ ID No. 1 and Primers YR2 and YR6 of FR2686604 with primers SEQ ID No. 141 and 142 of EP804616 (Sep. 13, 2007).
Weickmann and Weickmann, European Opposition for EP 0804616, Vergleich der SEQ ID No. 33 (Streptococcus pyogenes Exotoxin A gene) aus EP804616 und Primern SEQ ID Nos. 143 bzw. 144b (EP804616) mit speA-Primern P1-P4 aus Black C.M. et al., Mol. Cell. Probes (1993) 7: 255-259 und speA-primern SPEA-1, SPEA-2 aus Tyler S.D. et al., J.Clin.Microbiol.Dis. (1992) 30:3127-3131 (Sep. 13, 2007).
Weickmann and Weickmann, European Opposition for EP 0804616, References for target genes (Sep. 13, 2007).
Weickmann and Weickmann, European Opposition for EP 0804616Vergleich der SEQ ID Nos. 18 und 20 (*Pseudomonas aeruginosa*) aus EP804616 und der entsprechenden Probesequenzen SEQ ID Nos. 87-90 und 94+95 mit Primer und Probesequenzen ETA1-ETA7 aus Khan et al., Appl. Environment. Microbiol. Oct. 1994.
Westin et al., Anchored multiplex amplification on a microelectronic chip array, Nature Biotech. (2000) 18: 199-204.
Whitcombe et al., Detection of PCR products using self-probing amplicons and fluorescence, Nature Biotech. (1999) 17: 804-807.
White et al., The Polymerase Chain Reaction: Clinical Applications, Adv Clin Chem. (1992) 29: 161-196.
Wilson et al., Detection of Enterotoxigenic *Staphlococcus aureus* in Dried Skimmed Milk: Use of the Polymerase Chain Reaction for Amplification and Detection of Staphylococcal Enterotoxin Genes *entB* and *entC1* and the Thermonuclease Gene *nuc*. Appl Environ Microbiol., (1991) 1793-1798.
Wittwer et al., Rapid Cycle DNA Amplification: Time and Temperature Optimization, Biotechniques (1991) 10(1): 76-83.
Wittwer et al., The LightCycler™: A microvolume multisample fluorimeter with rapid temperature control, Bio Techniques (1997) 22: 176-181.
Yanofsky et al., The Complete Nucleotide Sequence of the Tryptophan Operon of *Escherichia coli*. Nucleic Acids Res. (1981) 9(24): 6647-6668.
York, et al, Evaluation of the *autoSCAN-W/A* Rapid System for Identification and Susceptibility Testing of Gram-Negative Fermentative Bacilli, J Clin Microbiol. (1992) 30(11): 2903-2910.
Yoshikawa et al., Bacillus subtilis Genes for RNA Polymerase beta Subunit, Ribosomal Proteins L 12 and S7, Elongation Factors G and Tu and Ribosomal Proteins S10 and L3, EMBL. AC: D64127. Submitted to DDB/EMBL/Genbank database on Apr. 14, 1995.
Zakrewska-Czerwińska et al., Identification of *Staphylococcus epidermidis* Using a 16S rRNA-directed Oligonucleotide Probe, FEMS Microbiol Lett. (1992) 100: 51-58.
Zambardi et al., Laboratory Diagnosis of Oxacillin Resistance in *Staphylococcus aureus* by a Multiplex-polymerase Chain Reaction Assay, Diagn Microbiol Infect Dis. (1994) 19: 25-31.
Zhanel et al., Antimicrobial Resistance in *Haemophilus influenzae* and *Moraxella catarrhalis* Respiratory Tract Isolates: Results of the Canadian Respiratory Organizm Susceptibility Study, 1997 to 2002, Antimicrob Agents Chemother., (Jun. 2003) 47(6): 1875-1881.
Zhang et al., Cloning, Sequencing, and Expression in *Escherichia coli* of the Gene Encoding a 45-Kilodalton Protein, Elongation Factor Tu, from *Chlamydia trachomatis* Serovar F, J Bacteriol. (1994) 176(4): 1184-1187.
Zhao et al., Dna Sequence Analysis of the recA Genes from *Proteus vulgaris, Erwinia carotovora, Shigella flexneri* and *Escherichia coli* B/r, Mol Gen Genet. (1990) 222(2-3): 369-376.
International Search Report dated Apr. 12, 2002 from PCT/CA00/01150, filed Sep. 28, 2000.

Bej et al., Detection of coliform bacteria and *Escherichia coli* by multiplex polymerase chain reaction: Comparison with defined substrate and plating methods for water quality monitoring, Appl Environ Microbio., (Aug. 1991) 57(8): 2429-2432.

Cebula, et al., Simultaneous identification of strains of *Escherichia coli* Serotype O157:H7 and their shiga-like toxin type by mismatch amplification mutation assay-multiplex PCR, J Clin Microbio. (Jan. 1995) 33(1): 248-250.

Frankel et al., Multi-gene amplification: simultaneous detection of three virulence genes in diarrhoeal stool, Mol Microbio. (1989) 3(12): 1729-1734.

GenBank Accession No. FJ858146, Enterococcus Faecium Strain QSE32 fsr Operon, Complete Sequence; and GelE (gelE) and SprE (sprE) Genes, Complete CDS, (Nov. 2009) http://www.ncbi.nlm.nih.gov/nuccore/226938234.

GenBank Accession No. AP000565, *Homo sapiens* Genomic DNA, Chromosome 21Q22, clone:f79A10, D21S226-AML Region, Complete Sequence, (Nov. 1999) http://www.ncbi.nlm.nih.gov/nuccore/6015482.

Haas et al., Universal PCR primers for detection of phytopathogenic *Agrobacterium* strains, App Environ Microbio., (Aug. 1995) 61(8): 2879-2884.

Harth et al., Epidemiology of *Vibrio parahaemolyticus* Outbreaks, Southern Chile, Emerg Infect Dis., (Feb. 2009) 15(2): 163-168 and GenBank Accession No. EU185084 downloaded from http://ncbi.nlm.nih.gov/nuccore/158524083.

Kaltenboeck et al., Two-step polymerase chain reactions and restriction endonuclease analyses detect and differentiate *ompA* DNA of *Chlamydia* spp., J Clin Microbio. (May 1992) 30(5): 1098-1104.

Lucotte et al., A multiple primer pairs polymerase chain reaction for the detection of human genital papillomavirus types, Mol Cell Probes (1993) 7: 339-344.

Opposition Brief by Infectio Diagnostic (I.D.I.) Inc. dated Sep. 14, 2007 from EP Application No. 95931109.3, filed Sep. 12, 1995.

Opposition Brief by Roche Diagnostics GmbH dated Sep. 21, 2007 from EP Application No. 95931109.3, filed Sep. 12, 1995.

Reply Brief by Roche Diagnostics GmbH dated Jan. 29, 2008 to Opposition Brief by I.D.I. from EP Application No. 95931109.3, filed Sep. 12, 1995 (w/English translation).

Reply Brief by I.D.I. dated Apr. 1, 2008 to Roche's Appeal Brief from EP Application No. 95931109.3, filed Sep. 12, 1995.

EPO Notice of Summons to Oral Proceedings and Preliminary Opinion dated May 20, 2010 from EP Application No. 95931109.3, filed Sep. 12, 1995.

Reply Brief by I.D.I. dated Sep. 6, 2010 to Summons/Preliminary Opinion from EP Application No. 95931109.3, filed Sep. 12, 1995.

Reply Brief by Roche dated Sep. 6, 2010 to Summons/Preliminary Opinion from EP Application No. 95931109.3, filed Sep. 12, 1995.

EPO Notice of Decision of Appeal dated Oct. 6, 2010 from EP Application No. 95931109.3, filed Sep. 12, 1995.

* cited by examiner

Figure 1: *atpD* sequences databases and main subsets.

Figure 2: *tuf* sequences databases and main subsets.

FIGURE 4 (1/2)

FIGURE 4 (2/2)
*S. aureus* – SEQ ID NO: 2619
*S. epidermidis* – SEQ ID NO: 2620
*E. durans* – SEQ ID NO: 2621
*E. hirae* – SEQ ID NO: 2622
*E. mundtii* – SEQ ID NO: 2623
*E. faecium* – SEQ ID NO: 2624
*E. cecorum* – SEQ ID NO: 2625
*E. columbae* – SEQ ID NO: 2626
*E. cassel falvus* – SEQ ID NO: 2627
*E. gallinarum* – SEQ ID NO: 2628
*E. faecalis* – SEQ ID NO: 2629
*E. avium* – SEQ ID NO: 2630
*E. raftinosus* – SEQ ID NO: 2631
*E. dispar* – SEQ ID NO: 2632
*E. malodoratus* – SEQ ID NO: 2633
*E. pseudoavium* – SEQ ID NO: 2634
*E. surlfureus* – SEQ ID NO: 2635
*E. saccharolyticus* – SEQ ID NO: 2636
*E. solitarius* – SEQ ID NO: 2637
*L. monocytogenes* – SEQ ID NO: 2638
*E. casselflavus* – SEQ ID NO: 2639
*E. gallinarum* – SEQ ID NO: 2640
*E. durans* – SEQ ID NO: 2641
*E. faecium* – SEQ ID NO: 2642
*E. hirae* – SEQ ID NO: 2643
*E. mundtii* – SEQ ID NO: 2644
*E. avium* – SEQ ID NO: 2645
*E. pseudoavium* – SEQ ID NO: 2646
*E. malodoratus* – SEQ ID NO: 2647
*E. rafinosus* – SEQ ID NO: 2648
*E. dispar* – SEQ ID NO: 2649
*S. pneumoniae,* – SEQ ID NO: 2650
*S. suis.* – SEQ ID NO: 2651
*S. pyogenes* – SEQ ID NO: 2652
*S. mutans* – SEQ ID NO: 2653
*L. lacits* – SEQ ID NO: 2654
*T. aquaticus* – SEQ ID NO: 2655
*E. coli* – SEQ ID NO: 2656

FIGURE 7

```
                                                                        SEQ ID
                   301        311        321                  331        NO :
E. coli          GAGATCGGTG AAGAAGAGCG TTGGG..... ..........CGATTCACCG  (2620)
E. agglomerans   GACATCGGTG AAGAAGAGCG TTGGG..... ..........CGATCCACCG  (2621)
P. agglomerans   CACCTCAAAG AAGAACATGG CAGCCCACTA GAGATCCCCT CTATTCACCC  (2622)
P. dispersa      GACCTGAAAG AAGAAGACGG CAGCGCTGTA GAGGTTTCCT CTATTCATCG  (2623)
T. ptyseos       GACCTGAAGA ACGAAGATGG TAGCAATGTT GAGGTGAACT CTATTCACCG  (2624)

E. coli          ~I~~G~~E~~ E~~E~~R~~W ~~A~~..... ..........I~~H~~R~~   (2625)
E. agglomerans   ~I~~G~~E~~ E~~E~~R~~W ~~A~~..... ..........I~~H~~R~~   (2626)
P. agglomerans   ~L~~K~~E~~ E~~D~~G~~S ~~A~~V~~E~ ~I~~A~~S~~ I~~H~~R~~   (2627)
P. dispersa      ~L~~K~~E~~ E~~D~~G~~S ~~A~~V~~E~ ~V~~S~~S~~ I~~H~~R~~   (2628)
T. ptyseos       ~L~~K~~N~~ E~~D~~G~~S ~~N~~V~~E~ ~V~~N~~S~~ I~~H~~R~~   (2629)
```

FIGURE 11: Position of the 5 new primer pairs selected from the *M. catarrhalis*-specific 466-bp DNA fragment (SEQ ID NO: 29)[1]
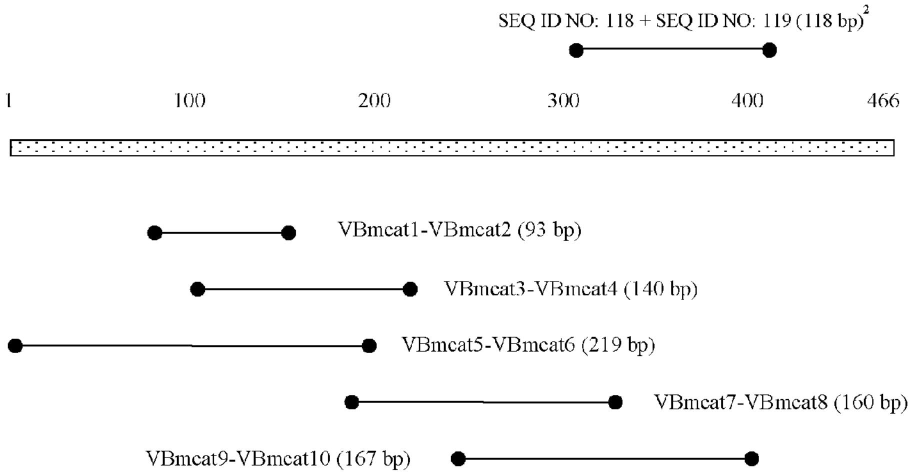
[1] All SEQ ID NOs. in this Figure are from US patent 6,001,564.
[2] Amplicon size is given in parenthesis.

FIGURE 12: Position of the 5 new primer pairs selected from the *S. epidermidis*-specific 705-bp DNA fragment (SEQ ID NO: 36)[1].
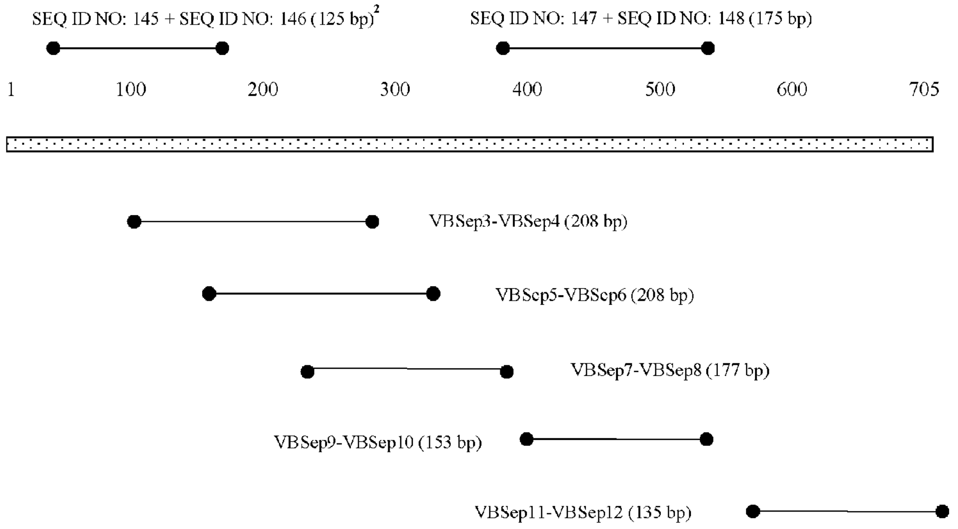
[1] All SEQ ID NOs. in this Figure are from US patent 6,001,564.
[2] Amplicon size is given in parenthesis.

Views
TxR/der TxR_1
Der Quasar_2
Quasar_2
Der Texas Red_3
TET/derTET
FAM/derFAM
Melt peak_1
Temperature
FAM
TET
TAMRA
ROX
FAM 2nd_1
TET 2nd_1
Texas Red_2
Fluorescence
Cycles
25.0
Site ID
Sample ID
1 a 1ng A
1 a 1ng B
1 b neg
4 25 cop A
4 50 cop B
4 neg
D3
D4
D5
D6
D7
D8

METHODS AND PROBES FOR DETECTING A VANCOMYCIN RESISTANCE GENE

CROSS-REFERENCE TO RELATED APPLICATIONS

This application is a continuation of application Ser. No. 11/522,253, filed Sep. 14, 2006, which is a continuation-in-part of application Ser. No. 11/236,785, filed Sep. 27, 2005, which is a continuation of Ser. No. 10/089,177, filed Mar. 27, 2002, which is the U.S. national phase under 35 U.S.C. §371 of prior PCT International Application No. PCT/CA00/01150, filed Sep. 28, 2000, which claims the benefit of Canada Application No. 2037010 filed May 19, 2000, and Canada Application No. 2283458, filed Sep. 28, 1999, the disclosures of which are hereby expressly incorporated by reference in their entireties. Application Ser. No. 11/522,253, filed Sep. 14, 2006, is also a continuation-in-part of application Ser. No. 10/753,169, filed Jan. 7, 2004, which is a continuation of application Ser. No. 09/989,643, filed Nov. 20, 2001 which is a continuation of application Ser. No. 09/297,539 filed May 3, 1999 which is a national phase of PCT/CA97/00829 filed Nov. 4, 1997, which claims priority to application Ser. No. 08/743,637, filed Nov. 4, 1996, the disclosures of which are hereby expressly incorporated by reference in their entireties.

SEQUENCE LISTING

The present application is being filed along with a sequence listing in electronic format. The sequence listing is provided as a file entitled GENOM048P1C1.txt, created Jul. 1, 2011 which is 1.98 MB in size. The information in the electronic format of the sequence listing is incorporated herein by reference in its entirety.

BACKGROUND OF THE INVENTION

Classical Methods for the Identification of Microorganisms

Microorganisms are classically identified by their ability to utilize different substrates as a source of carbon and nitrogen through the use of biochemical tests such as the API20E™ system (bioMérieux). For susceptibility testing, clinical microbiology laboratories use methods including disk diffusion, agar dilution and broth microdilution. Although identifications based on biochemical tests and antibacterial susceptibility tests are cost-effective, generally two days are required to obtain preliminary results due to the necessity of two successive overnight incubations to identify the bacteria from clinical specimens as well as to determine their susceptibility to antimicrobial agents. There are some commercially available automated systems (i.e. the MicroScan™ system from Dade Behring and the Vitek™ system from bioMérieux) which use sophisticated and expensive apparatus for faster microbial identification and susceptibility testing (Stager and Davis, 1992, Clin. Microbiol. Rev. 5:302-327). These systems require shorter incubation periods, thereby allowing most bacterial identifications and susceptibility testing to be performed in less than 6 hours. Nevertheless, these faster systems always require the primary isolation of the bacteria or fungi as a pure culture, a process which takes at least 18 hours for a pure culture or 2 days for a mixed culture. So, the shortest time from sample reception to identification of the pathogen is around 24 hours. Moreover, fungi other than yeasts are often difficult or very slow to grow from clinical specimens. Identification must rely on labor-intensive techniques such as direct microscopic examination of the specimens and by direct and/or indirect immunological assays. Cultivation of most parasites is impractical in the clinical laboratory. Hence, microscopic examination of the specimen, a few immunological tests and clinical symptoms are often the only methods used for an identification that frequently remains presumptive.

The fastest bacterial identification system, the autoSCAN-Walk-Away™ system (Dade Behring) identifies both gram-negative and gram-positive bacterial species from standardized inoculum in as little as 2 hours and gives susceptibility patterns to most antibiotics in 5 to 6 hours. However, this system has a particularly high percentage (i.e. 3.3 to 40.5%) of non-conclusive identifications with bacterial species other than Enterobacteriaceae (Croizé J., 1995, Lett. Infectiol. 10:109-113; York et al., 1992, J. Clin. Microbiol. 30:2903-2910). For Enterobacteriaceae, the percentage of non-conclusive identifications was 2.7 to 11.4%. The list of microorganisms identified by commercial systems based on classical identification methods is given in Table 15.

A wide variety of bacteria and fungi are routinely isolated and identified from clinical specimens in microbiology laboratories. Tables 1 and 2 give the incidence for the most commonly isolated bacterial and fungal pathogens from various types of clinical specimens. These pathogens are the main organisms associated with nosocomial and community-acquired human infections and are therefore considered the most clinically important.

Clinical Specimens Tested in Clinical Microbiology Laboratories

Most clinical specimens received in clinical microbiology laboratories are urine and blood samples. At the microbiology laboratory of the Centre Hospitalier de l'Université Laval (CHUL), urine and blood account for approximately 55% and 30% of the specimens received, respectively (Table 3). The remaining 15% of clinical specimens comprise various biological fluids including sputum, pus, cerebrospinal fluid, synovial fluid, and others (Table 3). Infections of the urinary tract, the respiratory tract and the bloodstream are usually of bacterial etiology and require antimicrobial therapy. In fact, all clinical samples received in the clinical microbiology laboratory are tested routinely for the identification of bacteria and antibiotic susceptibility.

Conventional Pathogen Identification from Clinical Specimens

Urine Specimens

The search for pathogens in urine specimens is so preponderant in the routine microbiology laboratory that a myriad of tests have been developed. However, the gold standard remains the classical semi-quantitative plate culture method in which 1 μL of urine is streaked on agar plates and incubated for 18-24 hours. Colonies are then counted to determine the total number of colony forming units (CFU) per liter of urine. A bacterial urinary tract infection (UTI) is normally associated with a bacterial count of $10^7$ CFU/L or more in urine. However, infections with less than $10^7$ CFU/L in urine are possible, particularly in patients with a high incidence of diseases or those catheterized (Stark and Maki, 1984, N. Engl. J. Med. 311:560-564). Importantly, approximately 80% of urine specimens tested in clinical microbiology laboratories are considered negative (i.e. bacterial count of less than $10^7$ CFU/L; Table 3). Urine specimens found positive by culture are further characterized using standard biochemical tests to identify the bacterial pathogen and are also tested for susceptibility to antibiotics. The biochemical and susceptibility testing normally require 18-24 hours of incubation.

Accurate and rapid urine screening methods for bacterial pathogens would allow a faster identification of negative specimens and a more efficient treatment and care management of patients. Several rapid identification methods (Uriscreen™, UTIscreen™, Flash Track™ DNA probes and others) have been compared to slower standard biochemical methods, which are based on culture of the bacterial pathogens. Although much faster, these rapid tests showed low sensitivities and poor specificities as well as a high number of false negative and false positive results (Koening et al., 1992, J. Clin. Microbiol. 30:342-345; Pezzlo et al., 1992, J. Clin. Microbiol. 30:640-684).

Blood Specimens

The Blood Specimens Received In The Microbiology Laboratory Are Always Submitted For Culture. Blood Culture Systems May Be Manual, Semi-Automated Or Completely Automated. The BACTEC™ System (From Becton Dickinson) And The Bactalert™ System (From Organon Teknika Corporation) Are The Two Most Widely Used Automated Blood Culture Systems. These Systems Incubate Blood Culture Bottles Under Optimal Conditions For Growth Of Most Bacteria. Bacterial Growth Is Monitored Continuously To Detect Early Positives By Using Highly Sensitive Bacterial Growth Detectors. Once Growth Is Detected, A Gram Stain Is Performed Directly From The Blood Culture And Then Used To Inoculate Nutrient Agar Plates. Subsequently, Bacterial Identification And Susceptibility Testing Are Carried Out From Isolated Bacterial Colonies With Automated Systems As Described Previously. Blood Culture Bottles Are Normally Reported As Negative If No Growth Is Detected After An Incubation Of 6 To 7 Days. Normally, The Vast Majority Of Blood Cultures Are Reported Negative. For Example, The Percentage Of Negative Blood Cultures At The Microbiology Laboratory Of The CHUL For The Period February 1994-January 1995 Was 93.1% (Table 3).

Other Clinical Samples

Upon receipt by the clinical microbiology laboratory, all body fluids other than blood and urine that are from normally sterile sites (i.e. cerebrospinal, synovial, pleural, pericardial and others) are processed for direct microscopic examination and subsequent culture. Again, most clinical samples are negative for culture (Table 3). In all these normally sterile sites, tests for the universal detection of algae, archaea, bacteria, fungi and parasites would be very useful.

Regarding clinical specimens which are not from sterile sites such as sputum or stool specimens, the laboratory diagnosis by culture is more problematic because of the contamination by the normal flora. The bacterial or fungal pathogens potentially associated with the infection are grown and separated from the colonizing microbes using selective methods and then identified as described previously. Of course, the DNA-based universal detection of bacteria would not be useful for the diagnosis of bacterial infections at these non-sterile sites. On the other hand, DNA-based assays for species or genus or family or group detection and identification as well as for the detection of antimicrobial agents resistance genes from these specimens would be very useful and would offer several advantages over classical identification and susceptibility testing methods.

DNA-Based Assays with any Specimen

There is an obvious need for rapid and accurate diagnostic tests for the detection and identification of algae, archaea, bacteria, fungi and parasites directly from clinical specimens. DNA-based technologies are rapid and accurate and offer a great potential to improve the diagnosis of infectious diseases (Persing et al., 1993, Diagnostic Molecular Microbiology: Principles and Applications, American Society for Microbiology, Washington, D.C.; Bergeron and Ouellette, 1995, Infection 23:69-72; Bergeron and Ouellette, 1998, J Clin Microbiol. 36:2169-72). The DNA probes and amplification primers which are objects of the present invention are applicable for the detection and identification of algae, archaea, bacteria, fungi, and parasites directly from any clinical specimen such as blood, urine, sputum, cerebrospinal fluid, pus, genital and gastro-intestinal tracts, skin or any other type of specimens (Table 3). These assays are also applicable to detection from microbial cultures (e.g. blood cultures, bacterial or fungal colonies on nutrient agar, or liquid cell cultures in nutrient broth). The DNA-based tests proposed in this invention are superior in terms of both rapidity and accuracy to standard biochemical methods currently used for routine diagnosis from any clinical specimens in microbiology laboratories. Since these tests can be performed in one hour or less, they provide the clinician with new diagnostic tools which should contribute to a better management of patients with infectious diseases. Specimens from sources other than humans (e.g. other primates, birds, plants, mammals, farm animals, livestock, food products, environment such as water or soil, and others) may also be tested with these assays.

A High Percentage of Culture-Negative Specimens

Among all the clinical specimens received for routine diagnosis, approximately 80% of urine specimens and even more (around 95%) for other types of normally sterile clinical specimens are negative for the presence of bacterial pathogens (Table 3). It would also be desirable, in addition to identify bacteria at the species or genus or family or group level in a given specimen, to screen out the high proportion of negative clinical specimens with a DNA-based test detecting the presence of any bacterium (i.e. universal bacterial detection). As disclosed in the present invention, such a screening test may be based on DNA amplification by PCR of a highly conserved genetic target found in all bacteria. Specimens negative for bacteria would not be amplified by this assay. On the other hand, those that are positive for any bacterium would give a positive amplification signal. Similarly, highly conserved genes of fungi and parasites could serve not only to identify particular species or genus or family or group but also to detect the presence of any fungi or parasite in the specimen.

Towards the Development of Rapid DNA-Based Diagnostic Tests

A rapid diagnostic test should have a significant impact on the management of infections. DNA probe and DNA amplification technologies offer several advantages over conventional methods for the identification of pathogens and antimicrobial agents resistance genes from clinical samples (Persing et al., 1993, Diagnostic Molecular Microbiology: Principles and Applications, American Society for Microbiology, Washington, D.C.; Ehrlich and Greenberg, 1994, PCR-based Diagnostics in Infectious Disease, Blackwell Scientific Publications, Boston, Mass.). There is no need for culture of the pathogens, hence the organisms can be detected directly from clinical samples, thereby reducing the time associated with the isolation and identification of pathogens. Furthermore, DNA-based assays are more accurate for microbial identification than currently used phenotypic identification systems which are based on biochemical tests and/or microscopic examination. Commercially available DNA-based technologies are currently used in clinical microbiology laboratories, mainly for the detection and identification of fastidious bacterial pathogens such as *Mycobacterium tuberculosis, Chlamydia trachomatis, Neisseria gonorrhoeae* as well as for the detection of a variety of viruses (Tang Y. and Persing D. H., Molecular detection and identification of microorganisms, In: P. Murray et al., 1999, Manual of Clinical Microbiology, ASM press, 7$^{th}$ edition, Washington D.C.). There are also other commercially available DNA-based assays which are used for culture confirmation assays.

Others have developed DNA-based tests for the detection and identification of bacterial pathogens which are objects of the present invention, for example: *Staphylococcus* sp. (U.S. Pat. No. 5,437,978), *Neisseria* sp. (U.S. Pat. No. 5,162,199 and European patent serial no. 0,337,896,131) and *Listeria monocytogenes* (U.S. Pat. Nos. 5,389,513 and 5,089,386). However, the diagnostic tests described in these patents are based either on rRNA genes or on genetic targets different from those described in the present invention. To our knowledge there are only four patents published by others mentioning the use of any of the four highly conserved gene targets described in the present invention for diagnostic purposes (PCT international publication number WO92/03455 and WO00/14274, European patent publication number 0 133 671 B1, and European patent publication number 0 133 288 A2). WO92/03455 is focused on the inhibition of *Candida* species for therapeutic purposes. It describes antisense oligonucleotide probes hybridizing to *Candida* messenger RNA. Two of the numerous mRNA proposed as targets are coding for translation elongation factor 1 (tef1) and the beta subunit of ATPase. DNA amplification or hybrization are not under the scope of their invention and although diagnostic use is briefly mentioned in the body of the application, no specific claim is made regarding diagnostics. WO00/14274 describes the use of bacterial recA gene for identification and speciation of bacteria of the *Burkholderia cepacia* complex. Specific claims are made on a method for obtaining nucleotide sequence information for the recA gene from the target bacteria and a following comparison with a standard library of nucleotide sequence information (claim 1), and on the use of PCR for amplification of the recA gene in a sample of interest (claims 4 to 7, and 13). However, the use of a discriminatory restriction enzyme in a RFLP procedure is essential to fulfill the speciation and WO00/14274 did not mention that multiple recA probes could be used simultaneously. Patent EP 0 133 288 A2 describes and claims the use of bacterial tuf (and fus) sequence for diagnostics based on hybridization of a tuf (or fus) probe with bacterial DNA. DNA amplification is not under the scope of EP 0 133 288 A2. Nowhere it is mentioned that multiple tuf (or fus) probes could be used simultaneously. No mention is made regarding speciation using tuf (or fus) DNA nucleic acids and/or sequences. The sensitivities of the tuf hybrizations reported are $1\times10^6$ bacteria or 1-100 ng of DNA. This is much less sensitive than what is achieved by our assays using nucleic acid amplification technologies.

Although there are phenotypic identification methods which have been used for more than 125 years in clinical microbiology laboratories, these methods do not provide information fast enough to be useful in the initial management of patients. There is a need to increase the speed of the diagnosis of commonly encountered bacterial, fungal and parasitical infections. Besides being much faster, DNA-based diagnostic tests are more accurate than standard biochemical tests presently used for diagnosis because the microbial genotype (e.g. DNA level) is more stable than the phenotype (e.g. physiologic level).

Bacteria, fungi and parasites encompass numerous well-known microbial pathogens. Other microorganisms could also be pathogens or associated with human diseases. For example, achlorophylious algae of the *Prototheca* genus can infect humans. Archae, especially methanogens, are present in the gut flora of humans (Reeve, J. H., 1999, J. Bacteriol. 181:3613-3617). However, methanogens have been associated to pathologic manifestations in the colon, vagina, and mouth (Belay et al., 1988, Appl. Enviro. Microbiol. 54:600-603; Belay et al., 1990, J. Clin. Microbiol. 28:1666-1668; Weaver et al., 1986, Gut 27:698-704).

In addition to the identification of the infectious agent, it is often desirable to identify harmful toxins and/or to monitor the sensitivity of the microorganism to antimicrobial agents. As revealed in this invention, genetic identification of the microorganism could be performed simultaneously with toxin and antimicrobial agents resistance genes. Alternatively, assays to identify toxin and/or antimicrobial resistance genes can be performed separately and independently from assays for identification of infectious agents.

Knowledge of the genomic sequences of algal, archaeal, bacterial, fungal and parasitical species continuously increases as testified by the number of sequences available from public databases such as GenBank. From the sequences readily available from those public databases, there is no indication therefrom as to their potential for diagnostic purposes. For determining good candidates for diagnostic purposes, one could select sequences for DNA-based assays for (i) the species-specific detection and identification of commonly encountered bacterial, fungal and parasitical pathogens, (ii) the genus-specific detection and identification of commonly encountered bacterial, fungal or parasitical pathogens, (iii) the family-specific detection and identification of commonly encountered bacterial, fungal or parasitical pathogens, (iv) the group-specific detection and identification of commonly encountered bacterial, fungal or parasitical pathogens, (v) the universal detection of algal, archaeal, bacterial, fungal or parasitical pathogens, and/or (vi) the specific detection and identification of antimicrobial agents resistance genes, and/or (vii) the specific detection and identification of bacterial toxin genes. All of the above types of DNA-based assays may be performed directly from any type of clinical specimens or from a microbial culture.

In our assigned U.S. Pat. No. 6,001,564 and our WO98/20157 patent publication, we described DNA sequences suitable for (i) the species-specific detection and identification of clinically important bacterial pathogens, (ii) the universal detection of bacteria, and (iii) the detection of antimicrobial agents resistance genes.

The WO98/20157 patent publication describes proprietary tuf DNA sequences as well as tuf sequences selected from public databases (in both cases, fragments of at least 100 base pairs), as well as oligonucleotide probes and amplification primers derived from these sequences. All the nucleic acid sequences described in that patent publication can enter in the composition of diagnostic kits or products and methods capable of a) detecting the presence of bacteria and fungi b) detecting specifically at the species, genus, family or group levels, the presence of bacteria and fungi and antimicrobial agents resistance genes associated with these pathogens. However, these methods and kits need to be improved, since the ideal kit and method should be capable of diagnosing close to 100% of microbial pathogens and associated antimicrobial agents resistance genes and toxins genes. For example, infections caused by *Enterococcus faecium* have become a clinical problem because of its resistance to many antibiotics. Both the detection of these bacteria and the evaluation of their resistance profiles are desirable. Besides that, novel DNA sequences (probes and primers) capable of recognizing the same and other microbial pathogens or the same and additional antimicrobial agents resistance genes are also desirable to aim at detecting more target genes and complement our earlier patent applications.

The present invention improves the assigned application by disclosing new proprietary tuf nucleic acids and/or sequences as well as describing new ways to obtain tuf nucleic acids and/or sequences. In addition we disclose new proprietary atpD and recA nucleic acids and/or sequences. In addition, new uses of tuf, atpD and recA DNA nucleic acids and/or sequences selected from public databases (Table 11) are disclosed.

Highly Conserved Genes for Identification and Diagnostics

Highly conserved genes are useful for identification of microorganisms. For bacteria, the most studied genes for identification of microorganisms are the universally conserved ribosomal RNA genes (rRNA). Among those, the principal targets used for identification purposes are the small subunit (SSU) ribosomal 16S rRNA genes (in prokaryotes) and 18S rRNA genes (in eukaryotes) (Relman and Persing, Genotyping Methods for Microbial Identification, In: D. H. Persing, 1996, PCR Protocols for Emerging Infectious Diseases, ASM Press, Washington D.C.). The rRNA genes are also the most commonly used targets for universal detection of bacteria (Chen et al., 1988, FEMS Microbiol. Lett. 57:19-24; McCabe et al., 1999, Mol. Genet. Metabol. 66:205-211) and fungi (Van Burik et al., 1998, J. Clin. Microbiol. 36:1169-1175).

However, it may be difficult to discriminate between closely related species when using primers derived from the 16S rRNA. In some instances, 16S rRNA sequence identity may not be sufficient to guarantee species identity (Fox et al., 1992, Int. J. Syst. Bacteriol. 42:166-170) and it has been shown that inter-operon sequence variation as well as strain to strain variation could undermine the application of 16S rRNA for identification purposes (Clayton et al., 1995, Int. J. Syst. Bacteriol. 45:595-599). The heat shock proteins (HSP) are another family of very conserved proteins. These ubiquitous proteins in bacteria and eukaryotes are expressed in answer to external stress agents. One of the most described of these HSP is HSP 60. This protein is very conserved at the amino acid level, hence it has been useful for phylogenetic studies. Similar to 16S rRNA, it would be difficult to discriminate between species using the HSP 60 nucleotide sequences as a diagnostic tool. However, Goh et al. identified a highly conserved region flanking a variable region in HSP 60, which led to the design of universal primers amplifying this variable region (Goh et al., U.S. Pat. No. 5,708,160). The sequence variations in the resulting amplicons were found useful for the design of species-specific assays.

SUMMARY OF THE INVENTION

Disclosed herein are compositions and methods for the detection and quantitation of antibiotic resistant organisms from a sample.

Some embodiments relate to compositions for the detection of a vancomycin resistant pathogen in a sample using a nucleic acid amplification assay. The composition can include at least one primer pair, comprising a forward and a reverse oligonucleotide, wherein the forward and reverse oligonucleotides each includes a binding region that is complementary to primer binding sites present on opposite strands of the pathogen's DNA, wherein the primer pair is adapted to amplify a vanA or vanB gene of the pathogen's DNA between and including said primer binding sites to produce a detectable amplification product. The binding regions of the oligonucleotides can correspond to, or be fully complementary to, at least 10, 11, 12, 13, 14, 15, 16, 17, 18, 19, or 20 consecutive nucleotides of at least two of the following sequences: SEQ ID NO: 1090, SEQ ID NO: 1091, SEQ ID NO: 1095, SEQ ID NO: 2298 and SEQ ID NO: 1096.

In some embodiments, the composition includes a primer pair wherein the primers comprise, consist essentially of, or consist of at least 10 consecutive nucleotides of SEQ ID NO: 1095 and SEQ ID NO: 1096. Preferred compositions include a primer pair wherein the primers comprises, consists essentially of, or consist of the sequences of SEQ ID NO: 1095 and SEQ ID NO: 1096.

Preferably, the composition comprises at least four primers, wherein the each of the four primers primers comprises, consists essentially of, or consists of at least 10 consecutive nucleotides of SEQ ID NOs: 1090, 1091, 1096 and 2298, or the complements thereof. In other preferred embodiments, the four primers comprise, consist essentially of, or consist of the SEQ ID NO: 1090, 1091, 1096, and 2298.

In some embodiments, the composition can also include at least one internal hybridization probe, wherein the internal hybridization probe can hybridize under stringent condition to the vanA or vanB amplification products produced by the compositions described above. Preferably, the internal hybridization probe is a molecular beacon. In more preferred embodiments, the molecular beacon can include the sequence of SEQ ID NO: 2299 or SEQ ID NO: 2300.

In further embodiments, the compositions can also include at least one internal control DNA, which can be amplified to produce an internal control amplicon under the same conditions and using the same oligonucleotides of the compositions described above. In further embodiments, the compositions can include an internal control probe that can hybridize under stringent conditions to the internal control amplicon. In some embodiments, the internal control DNA comprises the sequence of SEQ ID NO: 2302. Preferably, the internal control probe is a molecular beacon. In some embodiments, the internal control probe includes at least 10 consecutive nucleotides of the sequence of SEQ ID NO: 2301.

Also provided herein are kits that include the compositions described herein.

Methods to detect the presence of vancomycin-resistant organisms in a sample are also provided. In some embodiments, the method can include the step of annealing the nucleic acids of the sample with at least one probe and/or primer, wherein each of the primers and/or probes include nucleic acid sequences that correspond to, or are fully complementary to, at least 10 consecutive nucleotides of at least two of the following sequences: SEQ ID NO: 1090, SEQ ID NO: 1091, SEQ ID NO: 1095 and SEQ ID NO: 1096. The presence and/or amount of primer or probe that is annealed to said sample nucleic acid can be detected. In some embodiments, the primers and/or probes can include the nucleic acid sequences of SEQ ID NO's 1090, 1091, 1096 and 2297, or the complements thereof.

Preferably, the primers and/or probes are placed in the same physical enclosure.

In some embodiments, wherein at least one pair of primers is annealed to the sample DNA, and wherein said primer pair include nucleic acid sequences that correspond to, or are fully complementary to, at least 10 consecutive nucleotides of SEQ ID NO: 1090 and 1091 or SEQ ID NO: 1095 and 1096, the methods also include a step of amplifying the sample DNA with the annealed primer pair(s). For example, in some embodiments, the amplification step can include a method selected from the group consisting of:

(a) polymerase chain reaction (PCR),
(b) ligase chain reaction,
(c) nucleic acid sequence-based amplification,
(d) self-sustained sequence replication,
(e) strand displacement amplification,
(f) branched DNA signal amplification,
(g) nested PCR, and
(h) multiplex PCR.

Preferably, the amplification step includes a PCR amplification step.

In some embodiments that include an amplification step, the sample can also be contacted with at least one probe that hybridizes to an amplification product produced from at least one of the primer pairs. In preferred embodiments, the probe includes at least 10 consecutive nucleotides of the sequence of SEQ ID NO: 2299 or 2300. For example, in some embodiments, the at least one probe includes the sequence of SEQ ID NO: 2299 or 2300.

It is an object of the present invention to provide a specific, ubiquitous and sensitive method using probes and/or amplification primers for determining the presence and/or amount of nucleic acids:

from any algal, archaeal, bacterial, fungal or parasitical species in any sample suspected of containing said nucleic acids, and optionally, from specific microbial species or genera selected from the group consisting of the species or genera listed in Table 4, and optionally, from an antimicrobial agents resistance gene selected from the group consisting of the genes listed in Table 5, and optionally, from a toxin gene selected from the group consisting of the genes listed in Table 6, wherein each of said nucleic acids or a variant or part thereof comprises a selected target region hybridizable with said probes or primers;

said method comprising the steps of contacting said sample with said probes or primers and detecting the presence and/or amount of hybridized probes or amplified products as an indication of the presence and/or amount of said any microbial species, specific microbial species or genus or family or group and antimicrobial agents resistance gene and/or toxin gene.

In a specific embodiment, a similar method directed to each specific microbial species or genus or family or group detection and identification, antimicrobial agents resistance genes detection, toxin genes detection, and universal bacterial detection, separately, is provided.

In a more specific embodiment, the method makes use of DNA fragments from conserved genes (proprietary sequences and sequences obtained from public databases), selected for their capacity to sensitively, specifically and ubiquitously detect the targeted algal, archaeal, bacterial, fungal or parasitical nucleic acids.

In a particularly preferred embodiment, oligonucleotides of at least 12 nucleotides in length have been derived from the longer DNA fragments, and are used in the present method as probes or amplification primers. To be a good diagnostic candidate, an oligonucleotide of at least 12 nucleotides should be capable of hybridizing with nucleic acids from given microorganism(s), and with substantially all strains and representatives of said microorganism(s); said oligonucleotide being species-, or genus-, or family-, or group-specific or universal.

In another particularly preferred embodiment, oligonucleotides primers and probes of at least 12 nucleotides in length are designed for their specificity and ubiquity based upon analysis of our databases of tuf, atpD and recA sequences. These databases are generated using both proprietary and public sequence information. Altogether, these databases form a sequence repertory useful for the design of primers and probes for the detection and identification of algal, archaeal, bacterial, fungal and parasitical microorganisms. The repertory can also be subdivided into subrepertories for sequence analysis leading to the design of various primers and probes.

The tuf, atpD and recA sequences databases as a product to assist the design of oligonucleotides primers and probes for the detection and identification of algal, archaeal, bacterial, fungal and parasitical microorganisms are also covered.

The proprietary oligonucleotides (probes and primers) are also another object of this invention.

Diagnostic kits comprising probes or amplification primers such as those for the detection of a microbial species or genus or family or phylum or group selected from the following list consisting of *Abiotrophia adiacens, Acinetobacter baumanii, Actinomycetae, Bacteroides, Cytophaga* and *Flexibacter phylum, Bacteroides fragilis, Bordetella pertussis, Bordetella* sp., *Campylobacter jejuni* and *C. coli, Candida albicans, Candida dubliniensis, Candida glabrata, Candida guilliermondii, Candida krusei, Candida lusitaniae, Candida parapsilosis, Candida tropicalis, Candida zeylanoides, Candida* sp., *Chlamydia pneumoniae, Chlamydia trachomatis, Clostridium* sp., *Corynebacterium* sp., *Crypococcus neoformans, Cryptococcus* sp., *Cryptosporidium parvum, Entamoeba* sp., Enterobacteriaceae group, *Enterococcus casseliflavus-flavescens-gallinarum* group, *Enterococcus faecalis, Enterococcus faecium, Enterococcus gallinarum, Enterococcus* sp., *Escherichia coli* and *Shigella* sp. group, *Gemella* sp., *Giardia* sp., *Haemophilus influenzae, Klebsiella pneumoniae, Legionella pneumophila, Legionella* sp., *Leishmania* sp., Mycobacteriaceae family, *Mycoplasma pneumoniae, Neisseria gonorrhoeae*, platelets contaminants group (see Table 14), *Pseudomonas aeruginosa*, Pseudomonads group, *Staphylococcus aureus, Staphylococcus epidermidis, Staphylococcus haemolyticus, Staphylococcus hominis, Staphylococcus saprophyticus, Staphylococcus* sp., *Streptococcus agalactiae, Streptococcus pneumoniae, Streptococcus pyogenes, Streptococcus* sp., *Trypanosoma brucei, Trypanosoma cruzi, Trypanosoma* sp., Trypanosomatidae family, are also objects of the present invention.

Diagnostic kits further comprising probes or amplification primers for the detection of an antimicrobial agents resistance gene selected from the group listed in Table 5 are also objects of this invention.

Diagnostic kits further comprising probes or amplification primers for the detection of a toxin gene selected from the group listed in Table 6 are also objects of this invention.

Diagnostic kits further comprising probes or amplification primers for the detection of any other algal, archaeal, bacterial, fungal or parasitical species than those specifically listed herein, comprising or not comprising those for the detection of the specific microbial species or genus or family or group listed above, and further comprising or not comprising probes and primers for the antimicrobial agents resistance genes listed in Table 5, and further comprising or not comprising probes and primers for the toxin genes listed in Table 6 are also objects of this invention.

In a preferred embodiment, such a kit allows for the separate or the simultaneous detection and identification of the above-listed microbial species or genus or family or group; or universal detection of algae, archaea, bacteria, fungi or parasites; or antimicrobial agents resistance genes; or toxin genes; or for the detection of any microorganism (algae, archaea, bacteria, fungi or parasites).

In the above methods and kits, probes and primers are not limited to nucleic acids and may include, but are not restricted to analogs of nucleotides such as: inosine, 3-nitropyrrole nucleosides (Nichols et al., 1994, Nature 369:492-493), Linked Nucleic Acids (LNA) (Koskin et al., 1998, Tetrahedron 54:3607-3630), and Peptide Nucleic Acids (PNA) (Egholm et al., 1993, Nature 365:566-568).

In the above methods and kits, amplification reactions may include but are not restricted to: a) polymerase chain reaction (PCR), b) ligase chain reaction (LCR), c) nucleic acid sequence-based amplification (NASBA), d) self-sustained sequence replication (3SR), e) strand displacement amplification (SDA), f) branched DNA signal amplification (bDNA), g) transcription-mediated amplification (TMA), h) cycling probe technology (CPT), i) nested PCR, j) multiplex PCR, k) solid phase amplification (SPA), 1) nuclease dependent signal amplification (NDSA), m) rolling circle amplification technology (RCA), n) Anchored strand displacement amplification, o) Solid-phase (immobilized) rolling circle amplification.

In the above methods and kits, detection of the nucleic acids of target genes may include real-time or post-amplification technologies. These detection technologies can include, but are not limited to, fluorescence resonance energy transfer (FRET)-based methods such as adjacent hybridization to FRET probes (including probe-probe and probe-primer methods), TaqMan, Molecular Beacons, scorpions, nanoparticle probes and Sunrise (Amplifluor). Other detection methods include target genes nucleic acids detection via immunological methods, solid phase hybridization methods on filters, chips or any other solid support, whether the hybridization is monitored by fluorescence, chemiluminescence, potentiometry, mass spectrometry, plasmon resonance, polarimetry, colorimetry, or scanometry. Sequencing, including sequencing by dideoxy termination or sequencing by hybridization, e.g. sequencing using a DNA chip, is another possible method to detect and identify the nucleic acids of target genes.

In a preferred embodiment, a PCR protocol is used for nucleic acid amplification, in diagnostic method as well as in method of construction of a repertory of nucleic acids and deduced sequences.

In a particularly preferred embodiment, a PCR protocol is provided, comprising, an initial denaturation step of 1-3 minutes at 95° C., followed by an amplification cycle including a denaturation step of one second at 95° C. and an annealing step of 30 seconds at 45-65° C., without any time allowed specifically for the elongation step. This PCR protocol has been standardized to be suitable for PCR reactions with most selected primer pairs, which greatly facilitates the testing because each clinical sample can be tested with universal, species-specific, genus-specific, antimicrobial agents resistance gene and toxin gene PCR primers under uniform cycling conditions. Furthermore, various combinations of primer pairs may be used in multiplex PCR assays.

It is also an object of the present invention that tuf, atpD and recA sequences could serve as drug targets and these sequences and means to obtain them revealed in the present invention can assist the screening, design and modeling of these drugs.

It is also an object of the present invention that tuf, atpD and recA sequences could serve for vaccine purposes and these sequences and means to obtain them revealed in the present invention can assist the screening, design and modeling of these vaccines.

We aim at developing a universal DNA-based test or kit to screen out rapidly samples which are free of algal, archaeal, bacterial, fungal or parasitical cells. This test could be used alone or combined with more specific identification tests to detect and identify the above algal and/or archaeal and/or bacterial and/or fungal and/or parasitical species and/or genera and/or family and/or group and to determine rapidly the bacterial resistance to antibiotics and/or presence of bacterial toxins. Although the sequences from the selected antimicrobial agents resistance genes are available from public databases and have been used to develop DNA-based tests for their detection, our approach is unique because it represents a major improvement over current diagnostic methods based on bacterial cultures. Using an amplification method for the simultaneous or independent or sequential microbial detection-identification and antimicrobial resistance genes detection, there is no need for culturing the clinical sample prior to testing. Moreover, a modified PCR protocol has been developed to detect all target DNA sequences in approximately one hour under uniform amplification conditions. This procedure should save lives by optimizing treatment, should diminish antimicrobial agents resistance because less antibiotics will be prescribed, should reduce the use of broad spectrum antibiotics which are expensive, decrease overall health care costs by preventing or shortening hospitalizations, and side effects of drugs, and decrease the time and costs associated with clinical laboratory testing.

In another embodiment, sequence repertories and ways to obtain them for other gene targets are also an object of this invention, such is the case for the hexA nucleic acids and/or sequences of Streptococci.

In yet another embodiment, for the detection of mutations associated with antibiotic resistance genes, we built repertories to distinguish between point mutations reflecting only gene diversity and point mutations involved in resistance. Such repertories and ways to obtain them for pbp1a, pbp2b and pbp2x genes of sensitive and penicillin-resistant *Streptococcus pneumoniae* and also for gyrA and parC gene fragments from various bacterial species are also an object of the present invention.

The diagnostic kits, primers and probes mentioned above can be used to identify algae, archaea, bacteria, fungi, parasites, antimicrobial agents resistance genes and toxin genes on any type of sample, whether said diagnostic kits, primers and probes are used for in vitro or in situ applications. The said samples may include but are not limited to: any clinical sample, any environment sample, any microbial culture, any microbial colony, any tissue, and any cell line.

It is also an object of the present invention that said diagnostic kits, primers and probes can be used alone or in conjunction with any other assay suitable to identify microorganisms, including but not limited to: any immunoassay, any enzymatic assay, any biochemical assay, any lysotypic assay, any serological assay, any differential culture medium, any enrichment culture medium, any selective culture medium, any specific assay medium, any identification culture medium, any enumeration culture medium, any cellular stain, any culture on specific cell lines, and any infectivity assay on animals.

In the methods and kits described herein below, the oligonucleotide probes and amplification primers have been derived from larger sequences (i.e. DNA fragments of at least 100 base pairs). All DNA fragments have been obtained either from proprietary fragments or from public databases. DNA fragments selected from public databases are newly used in a method of detection according to the present invention, since they have been selected for their diagnostic potential.

In another embodiment, the amino acid sequences translated from the repertory of tuf, atpD and recA nucleic acids and/or sequences are also an object of the present invention.

It is clear to the individual skilled in the art that other oligonucleotide sequences appropriate for (i) the universal detection of algae, archaea, bacteria, fungi or parasites, (ii) the detection and identification of the above microbial species or genus or family or group, and (iii) the detection of antimicrobial agents resistance genes, and (iv) the detection of toxin genes, other than those listed in Annexes I to III, XXI to XXII, XXXII to XXXVII, XXXIX to XLI, and XLIII to LIV may also be derived from the proprietary fragments or selected public database sequences. For example, the oligonucleotide primers or probes may be shorter or longer than the ones chosen; they may also be selected anywhere else in the proprietary DNA fragments or in the sequences selected from public databases; they may be also variants of the same oligonucleotide. If the target DNA or a variant thereof hybridizes to a given oligonucleotide, or if the target DNA or a variant thereof can be amplified by a given oligonucleotide PCR primer pair, the converse is also true; a given target DNA may hybridize to a variant oligonucleotide probe or be amplified by a variant oligonucleotide PCR primer. Alternatively, the oligonucleotides may be designed from any DNA fragment sequences for use in amplification methods other than PCR. Consequently, the core of this invention is the identification of universal, species-specific, genus-specific, family-specific, group-specific, resistance gene-specific, toxin gene-specific genomic or non-genomic DNA fragments which are used as a source of specific and ubiquitous oligonucleotide probes and/or amplification primers. Although the selection and evaluation of oligonucleotides suitable for diagnostic purposes requires much effort, it is quite possible for the individual skilled in the art to derive, from the selected DNA fragments, oligonucleotides other than the ones listed in Annexes I to III, XXI to XXII, XXXII to XXXVII, XXXIX to XLI, and XLIII to LIV which are suitable for diagnostic purposes. When a proprietary fragment or a public databases sequence is selected for its specificity and ubiquity, it increases the probability that subsets thereof will also be specific and ubiquitous.

Since a high percentage of clinical specimens are negative for bacteria (Table 3), DNA fragments having a high potential for the selection of universal oligonucleotide probes or primers were selected from proprietary and public database sequences. The amplification primers were selected from genes highly conserved in algae, archaea, bacteria, fungi and parasites, and are used to detect the presence of any algal, archaeal, bacterial, fungal or parasitical pathogen in clinical specimens in order to determine rapidly whether it is positive or negative for algae, archaea, bacteria, fungi or parasites. The selected genes, designated tuf, fus, atpD and recA, encode respectively 2 proteins (elongation factors Tu and G) involved in the translational process during protein synthesis, a protein (beta subunit) responsible for the catalytic activity of proton pump ATPase and a protein responsible for the homologous recombination of genetic material. The alignments of tuf, atpD and recA sequences used to derive the universal primers include both proprietary and public database sequences. The universal primer strategy allows the rapid screening of the numerous negative clinical specimens (around 80% of the specimens received, see Table 3) submitted for microbiological testing.

Table 4 provides a list of the archaeal, bacterial, fungal and parasitical species for which tuf and/or atpD and/or recA nucleic acids and/or sequences are revealed in the present invention. Tables 5 and 6 provide a list of antimicrobial agents resistance genes and toxin genes selected for diagnostic purposes. Table 7 provides the origin of tuf, atpD and recA nucleic acids and/or sequences listed in the sequence listing. Tables 8-10 and 12-14 provide lists of species used to test the specificity, ubiquity and sensitivity of some assays described in the examples. Table 11 provides a list of microbial species for which tuf and/or atpD and/or recA sequences are available in public databases. Table 15 lists the microorganisms identified by commercial systems. Tables 16-18 are part of Example 42, whereas Tables 19-20 are part of Example 43. Tables 21-22 illustrate Example 44, whereas Tables 23-25 illustrate Example 45.

BRIEF DESCRIPTION OF THE DRAWINGS

FIGS. 4 to 6 are illustrations to Example 42, whereas FIGS. 11 and 12 illustrate Example 44.

FIG. 4. Abridged multiple amino acid sequence alignment of the partial tuf gene products from selected species illustrated using the program Alscript. Residues highly conserved in bacteria are boxed in grey and gaps are represented with dots. Residues in reverse print are unique to the enterococcal tufB as well as to streptococcal and lactococcal tuf gene products. Numbering is based on *E. coli* EF-Tu and secondary structure elements of *E. coli* EF-Tu are represented by cylinders (α-helices) and arrows (β-strands).

FIG. 5. Distance matrix tree of bacterial EF-Tu based on amino acid sequence homology. The tree was constructed by the neighbor-joining method. The tree was rooted using archeal and eukaryotic EF-1α genes as the outgroup. The scale bar represents 5% changes in amino acid sequence, as determined by taking the sum of all of the horizontal lines connecting two species.

FIG. 6. Southern hybridization of BglII/XbaI digested genomic DNAs of some enterococci (except for *E. casseliflavus* and *E. gallinarum* whose genomic DNA was digested with BamHI/PvuII) using the tufA gene fragment of *E.*

*faecium* as probes. The sizes of hybridizing fragments are shown in kilobases. Strains tested are listed in Table 16.

Figure 7:
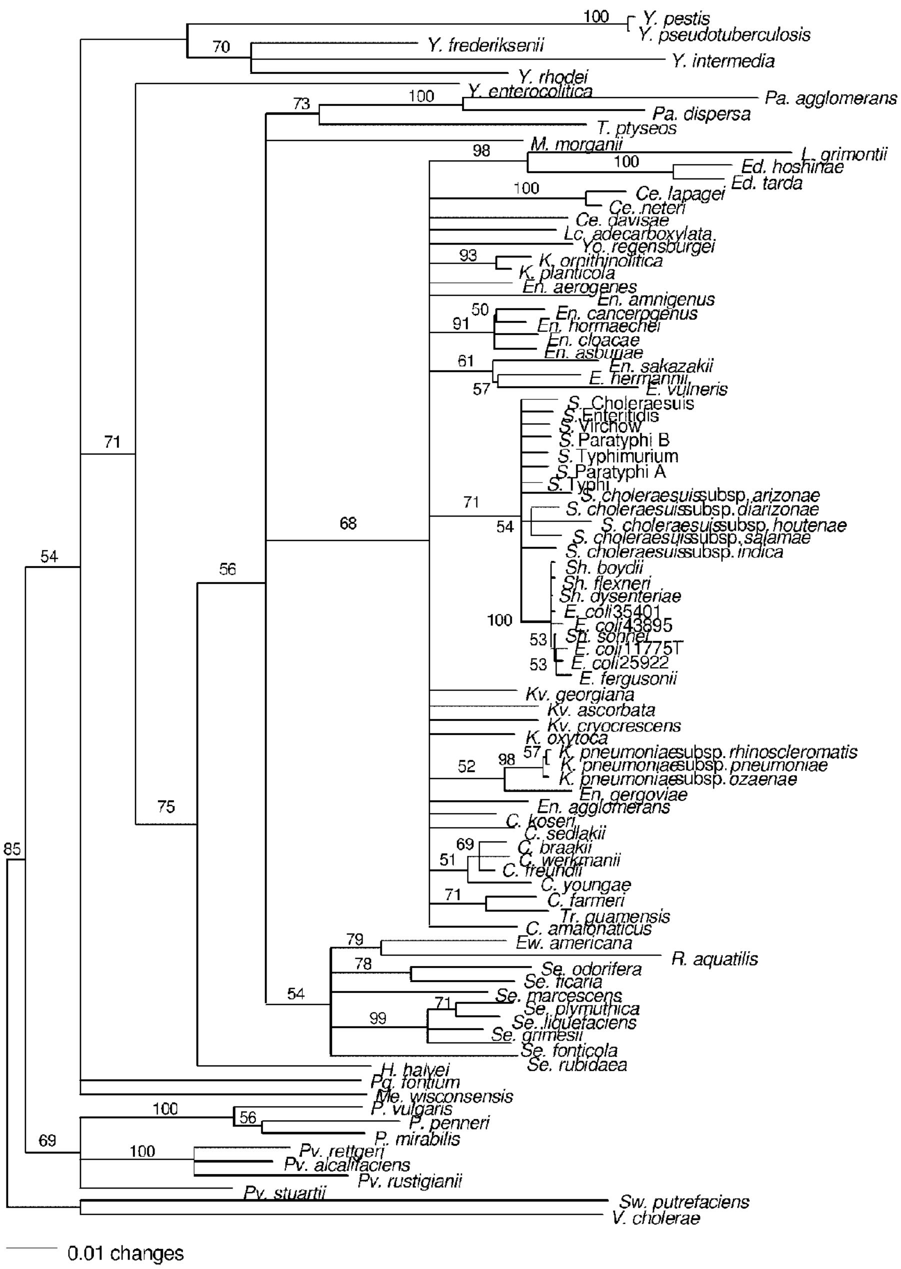
FIGS. 7 to 10 illustrate Example 43.

FIG. 7. *Pantoea* and *Tatumella* species specific signature indel in atpD genes. The nucleotide positions given are for *E. coli* atpD sequence (GenBank accession no. V00267). Numbering starts from the first base of the initiation codon.

Figure 8:
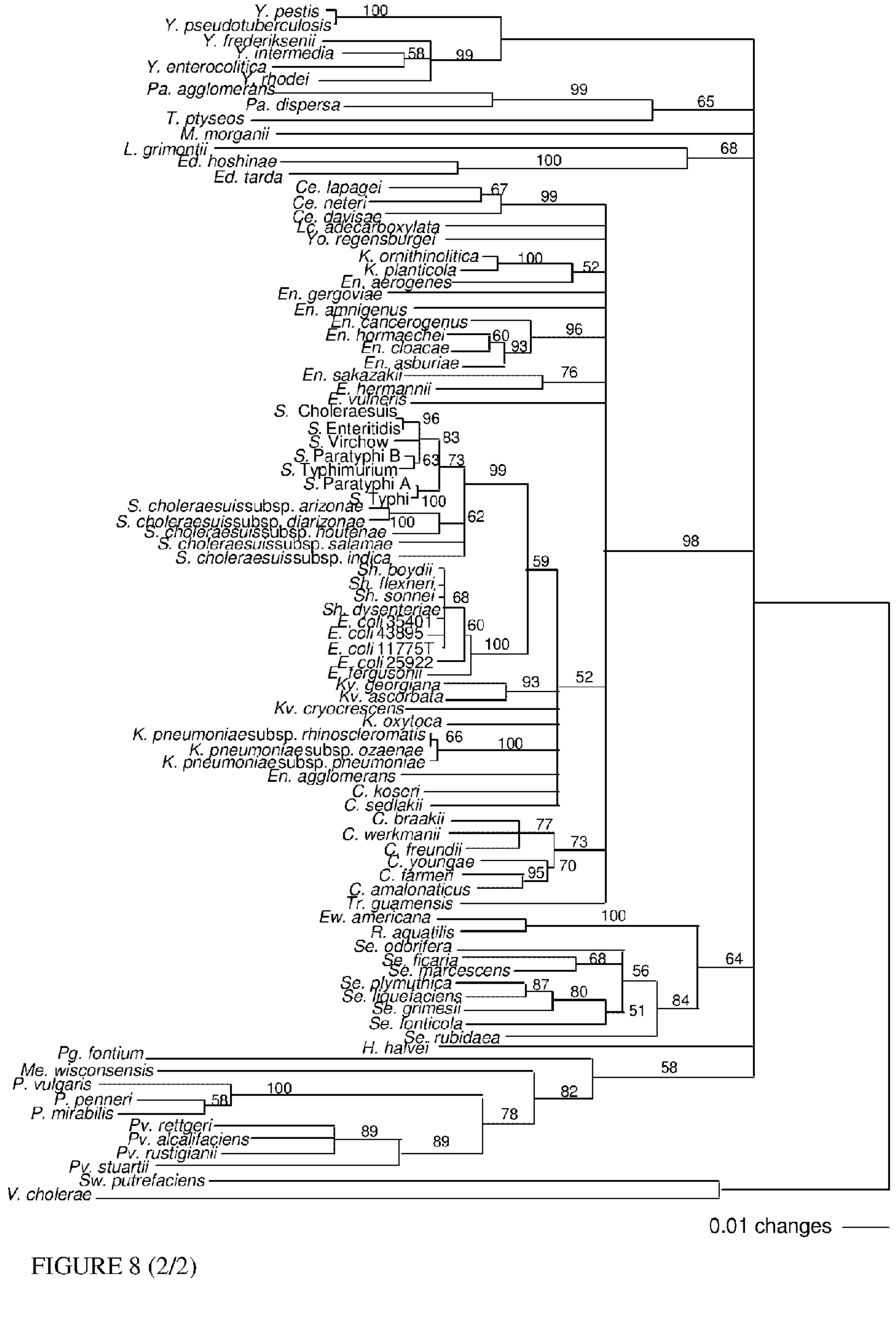

FIG. 8: Trees based on sequence data from tuf (left side) and atpD (right side). The phylogenetic analysis was performed using the Neighbor-Joining method calculated using the Kimura two-parameter method. The value on each branch indicates the occurrence (%) of the branching order in 750 bootstrapped trees.

Figure 9:
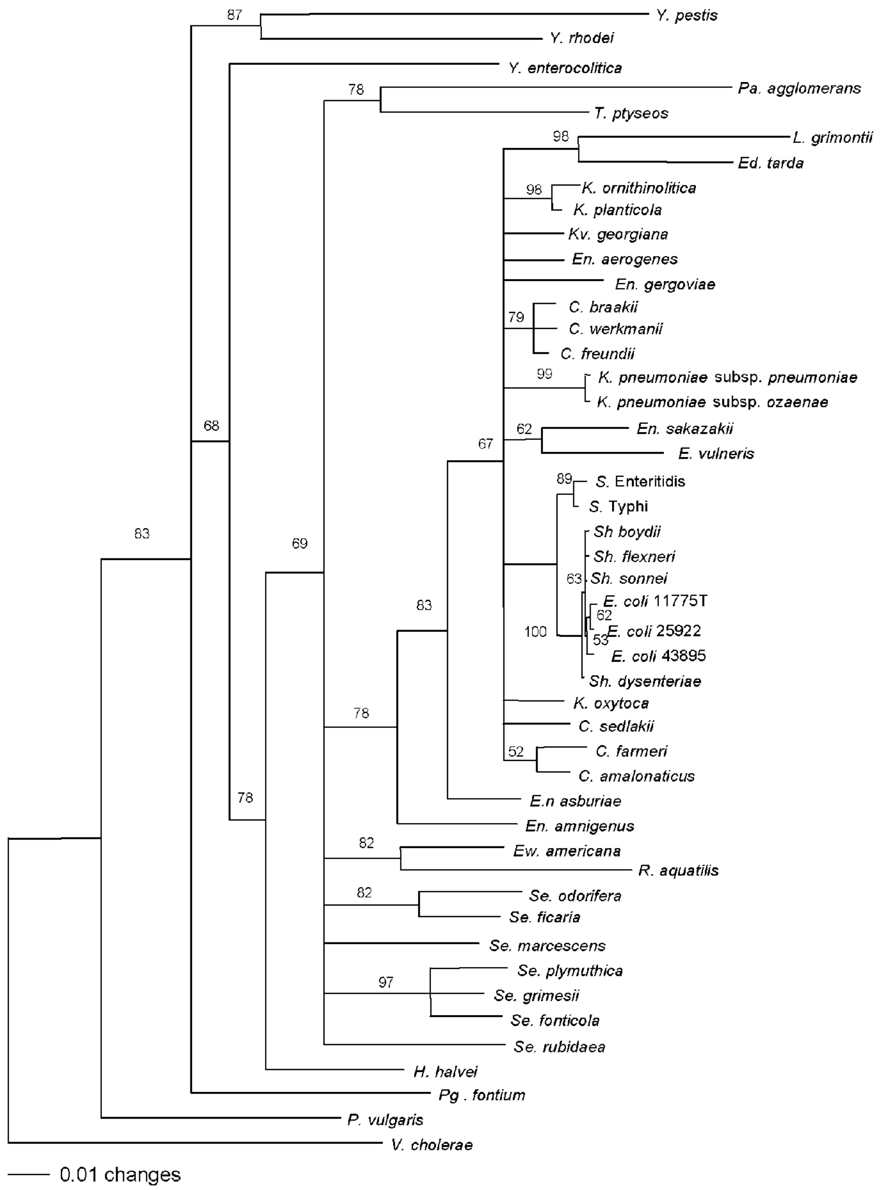
Figure 9:
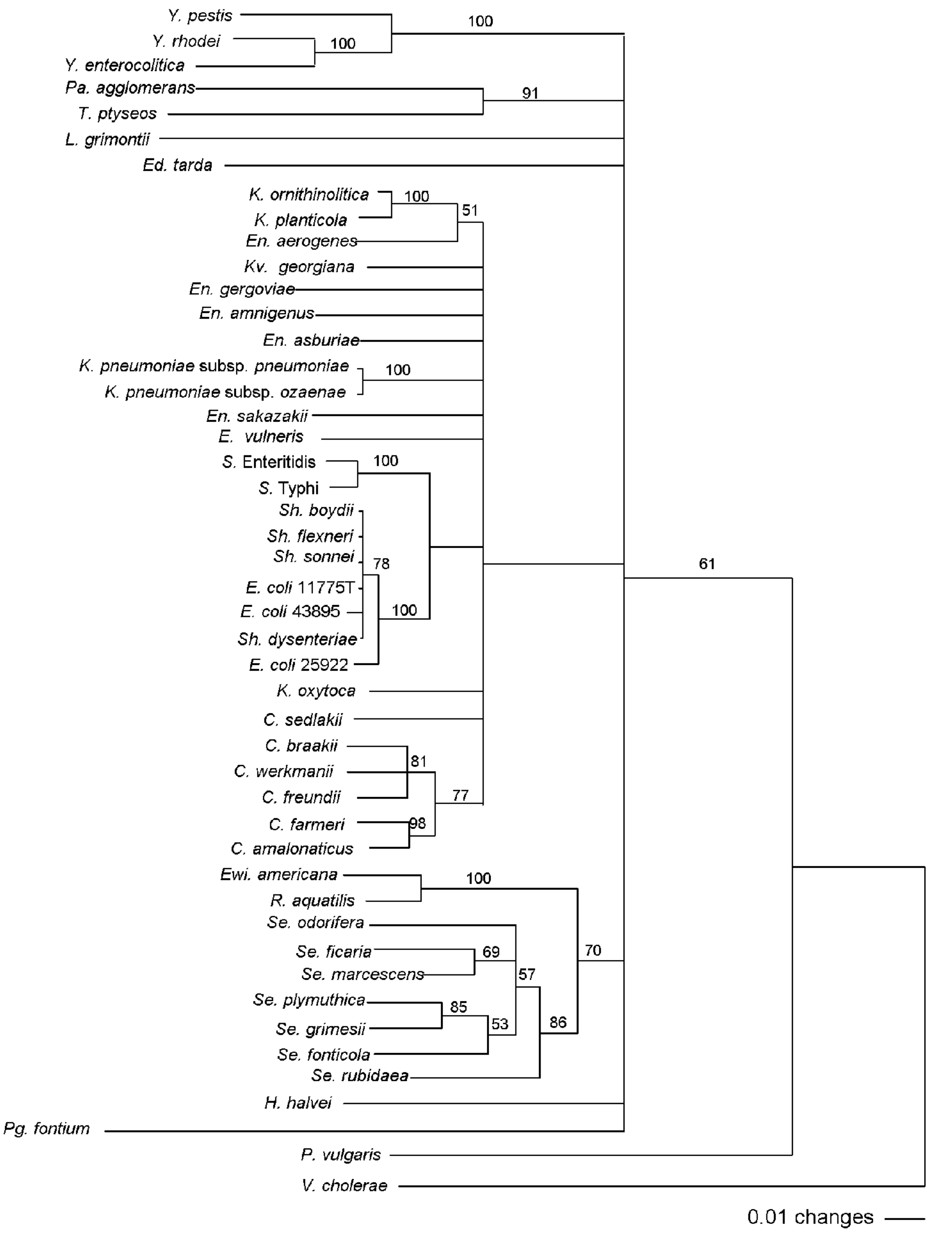
Figure 9:
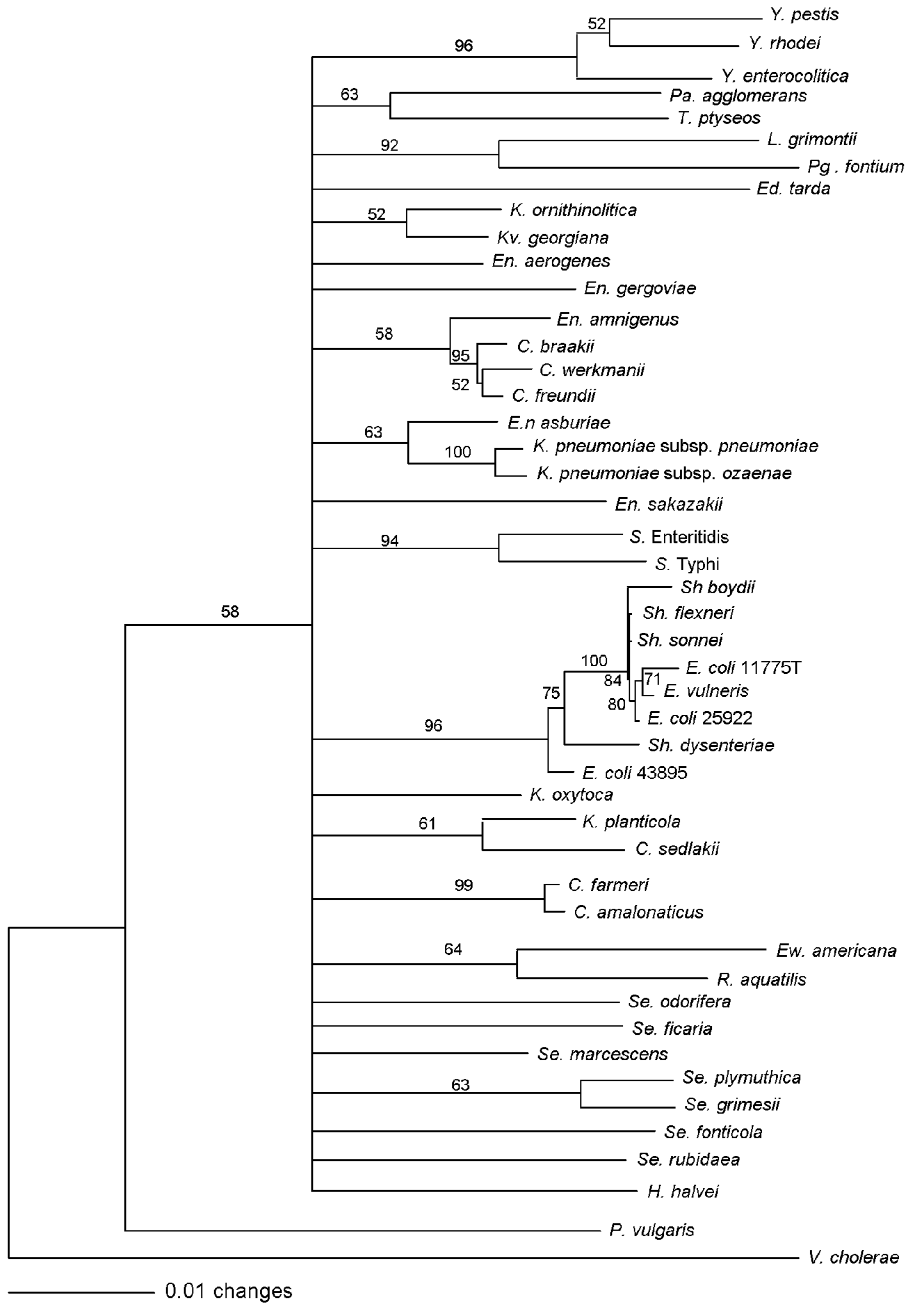

FIG. 9: Phylogenetic tree of members of the family Enterobacteriaceae based on tuf (a), atpD (b), and 16S rDNA (c) genes. Trees were generated by neighbor-joining method calculated using the Kimura two-parameter method. The value on each branch is the percentage of bootstrap replications supporting the branch. 750 bootstrap replications were calculated.

Figure 10:
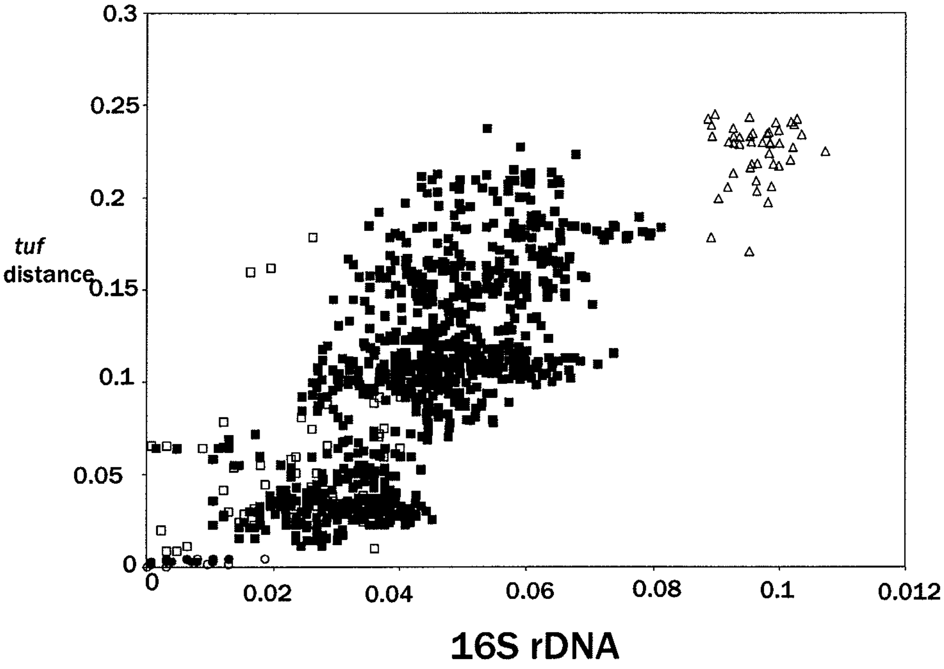
Figure 10:
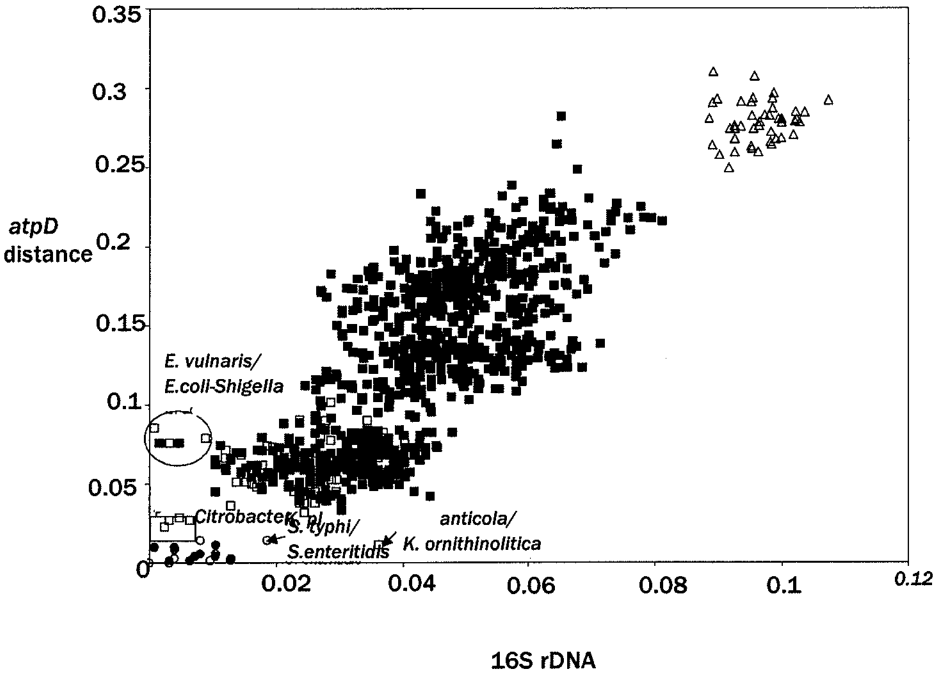
Figure 10:
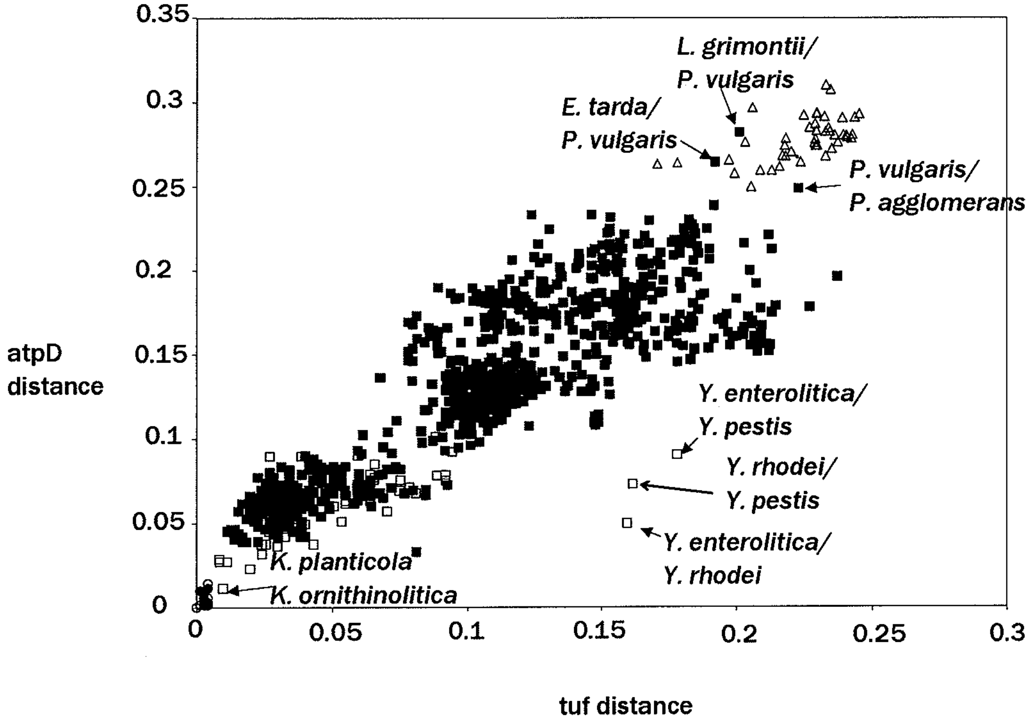

FIG. 10: Plot of tuf distances versus 16S rDNA distances (a), atpD distances versus 16S rDNA distances (b), and atpD distances versus tuf distances (c). Symbols: ○, distances between pairs of strains belonging to the same species; ●, distances between *E. coli* strains and *Shigella* strains; □, distances between pairs belonging to the same genus; ■, distances between pairs belonging to different genera; Δ, distances between pairs belonging to different families.

FIG. 11 depicts a multiple nucleic acid sequence alignment of the vanA gene from the indicated GenBank nucleotide accession numbers. Above the alignment of the GenBank sequences is a consensus sequence, derived from the alignment of the nucleic acid sequences below. Below the alignment of the GenBank sequences and shaded in grey are the sequences of oligonucleotides (SEQ ID NOs: 1090 and 1091) and the position of a molecular beacon probe (SEQ ID NO: 2299) that hybridizes to the amplification product of SEQ ID NOs: 1090 and 1091.

FIG. 12 depicts a multiple nucleic acid sequence alignment of the vanB gene from the indicated GenBank nucleotide accession numbers. Above the alignment of the GenBank sequences is a consensus sequence, derived from the alignment of the nucleic acid sequences below. Below the alignment of the GenBank sequences and shaded in grey are the sequences of oligonucleotides (SEQ ID NOs: 1096 and 2298) and the position of a molecular beacon probe (SEQ ID NO: 2300) that hybridizes to the amplification product of SEQ ID NOs: 1096 and 2298.

Figure 13A:
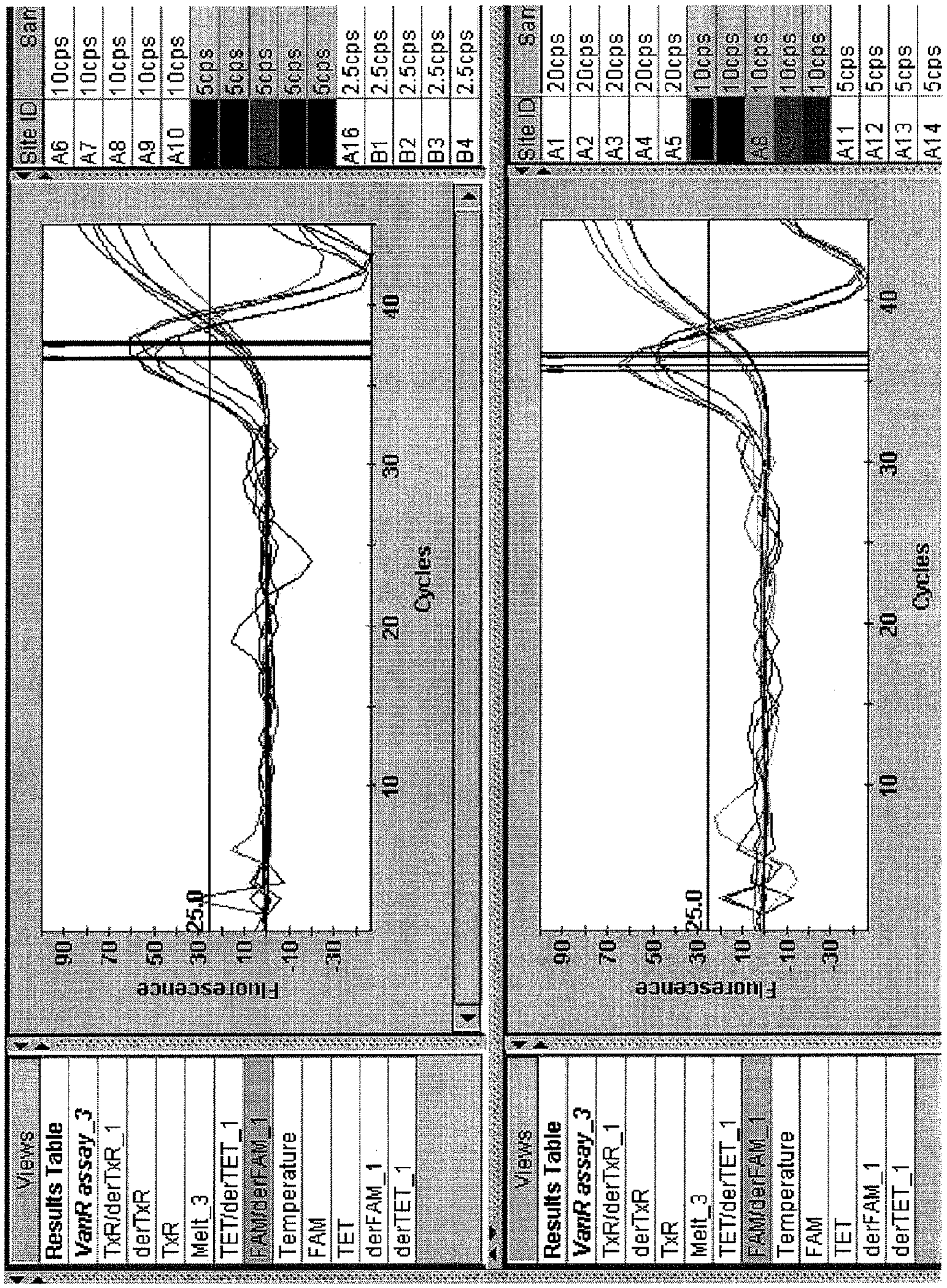
Figure 13B:
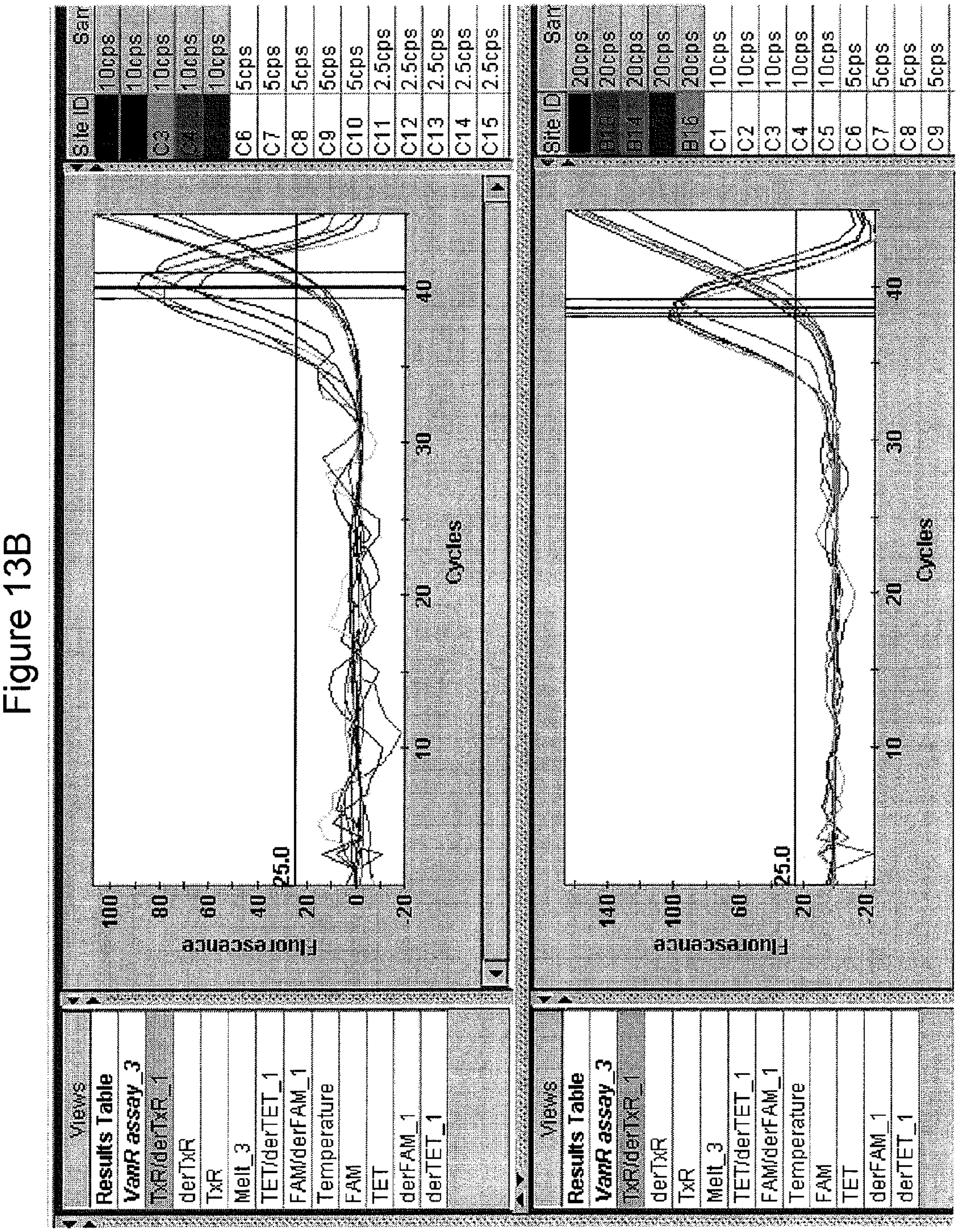

FIGS. 13A and 13B shows a graphical depictions of PCR amplification curves measured from reactions containing molecular beacon probes. Reactions contained 0, 0.5, 2.5, 5. 10, or 20 copies of vanA resistant *E. faecium* (FIG. 13A) or vanB resistant *E. faecalis* (FIG. 13B) template DNA, as well as 3.5 copies of internal control DNA. Molecular beacon probes (SEQ ID NO: 2299 and 2300) were added to each reaction and the fluorescence of the reactions was measured (FIGS. 13A and 13B, respectively). SEQ ID NO: 2299 is labeled with FAM. SEQ ID NO: 2300 is labeled with Texas Red. SEQ ID NO: 2301 is labeled with TET.

Figure 14A:
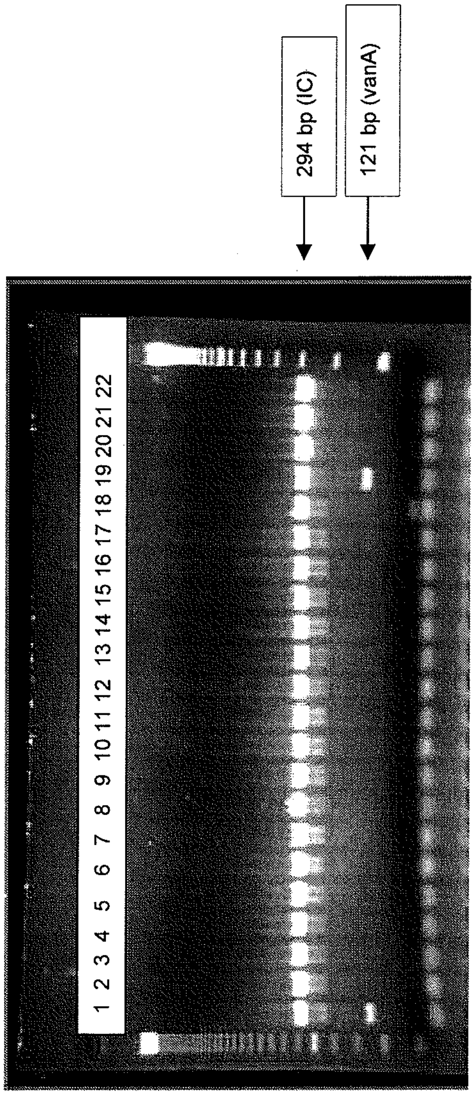
Figure 14B:
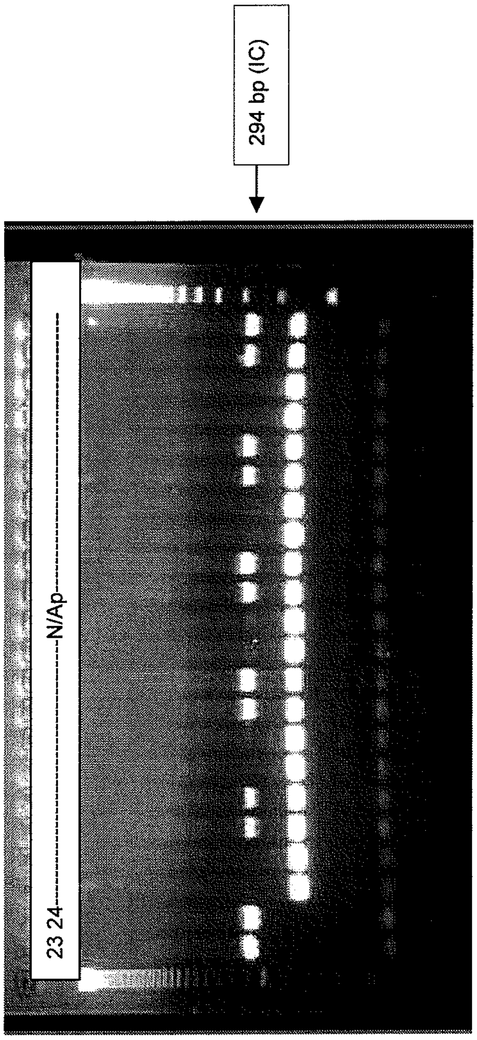

FIG. 14 shows an agarose gel of the DNA amplification products from PCR using the template DNA sources listed in Table 29. The numbers above the lanes correspond to the numbers in Table 29.

Figure 15A:
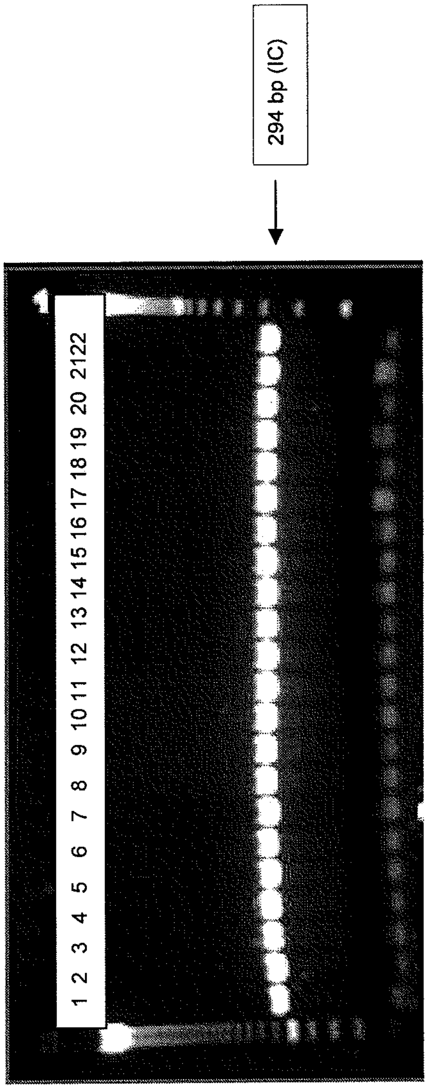
Figure 15B:
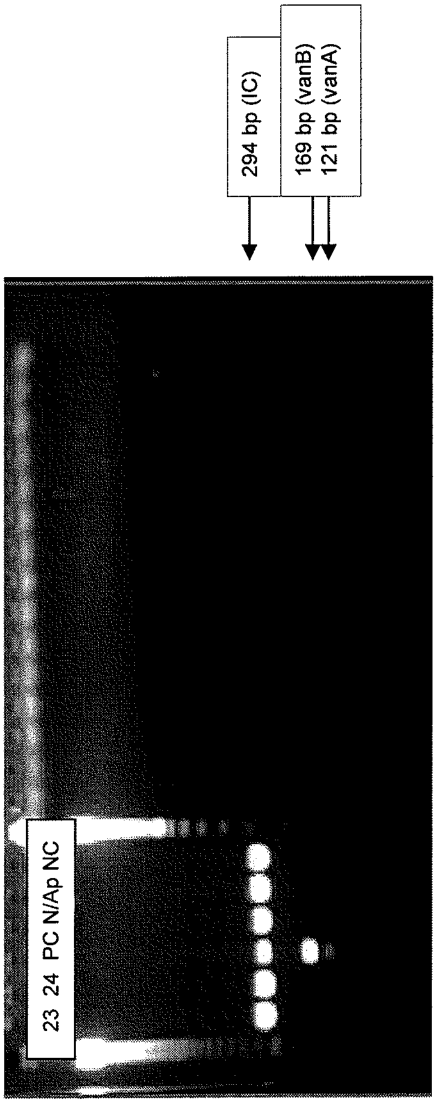

FIG. 15 shows an agarose gel of the DNA amplification products from PCR using template DNA sources listed in Table 30. The numbers above the lanes correspond to the numbers in Table 30.

Figure 16A:
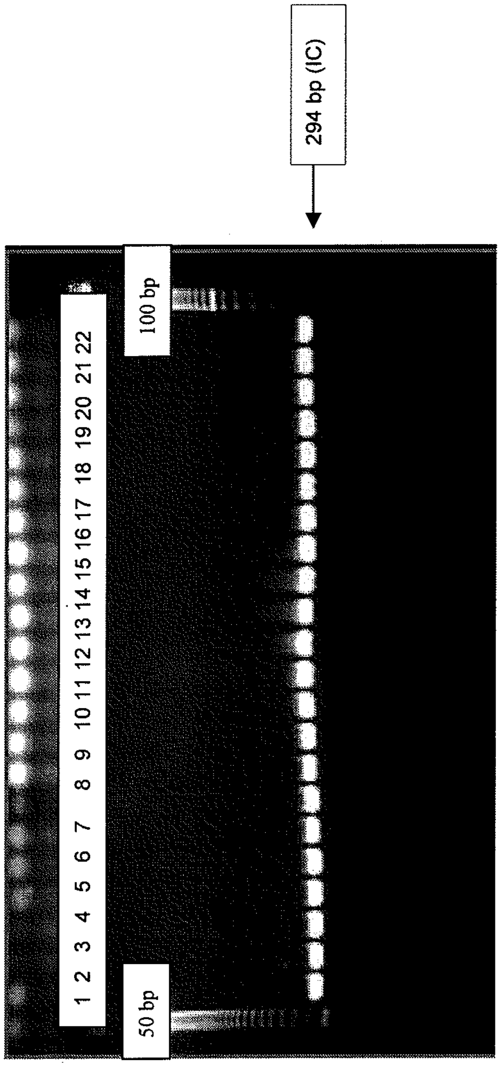
Figure 16B:
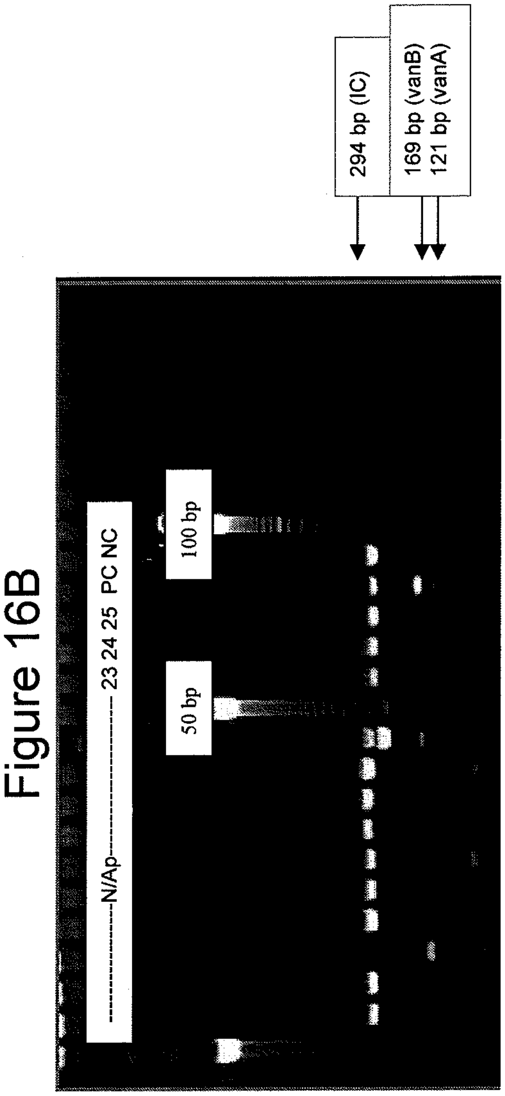

FIG. 16 shows an agarose gel of the DNA amplification products from PCR using template DNA sources listed in Table 31. The numbers above the lanes correspond to the numbers in Table 31.

Figure 17:
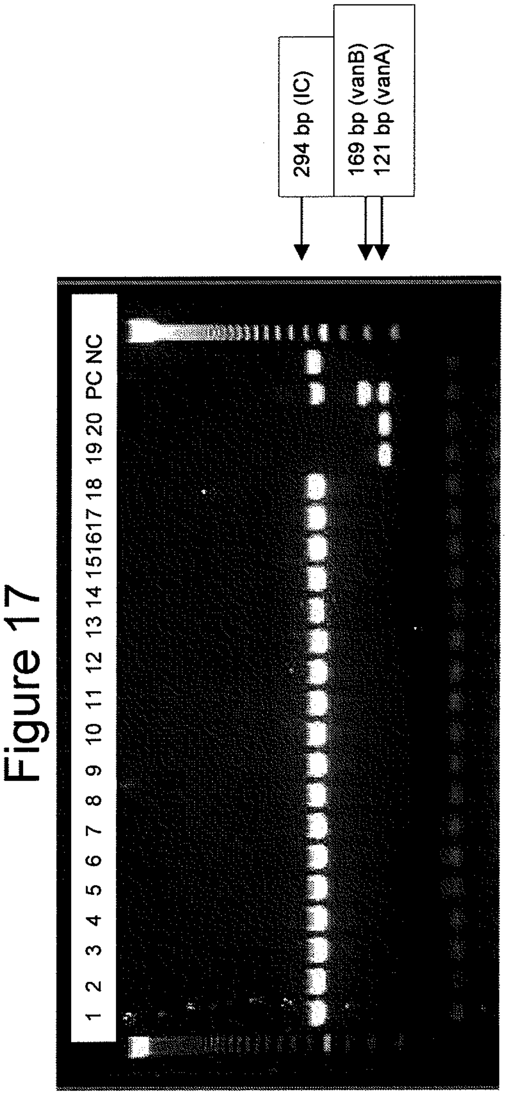

FIG. 17 shows an agarose gel of the DNA amplification products from PCR using template DNA sources listed in Table 32. The numbers above the lanes correspond to the numbers in Table 32.

Figure 18A:
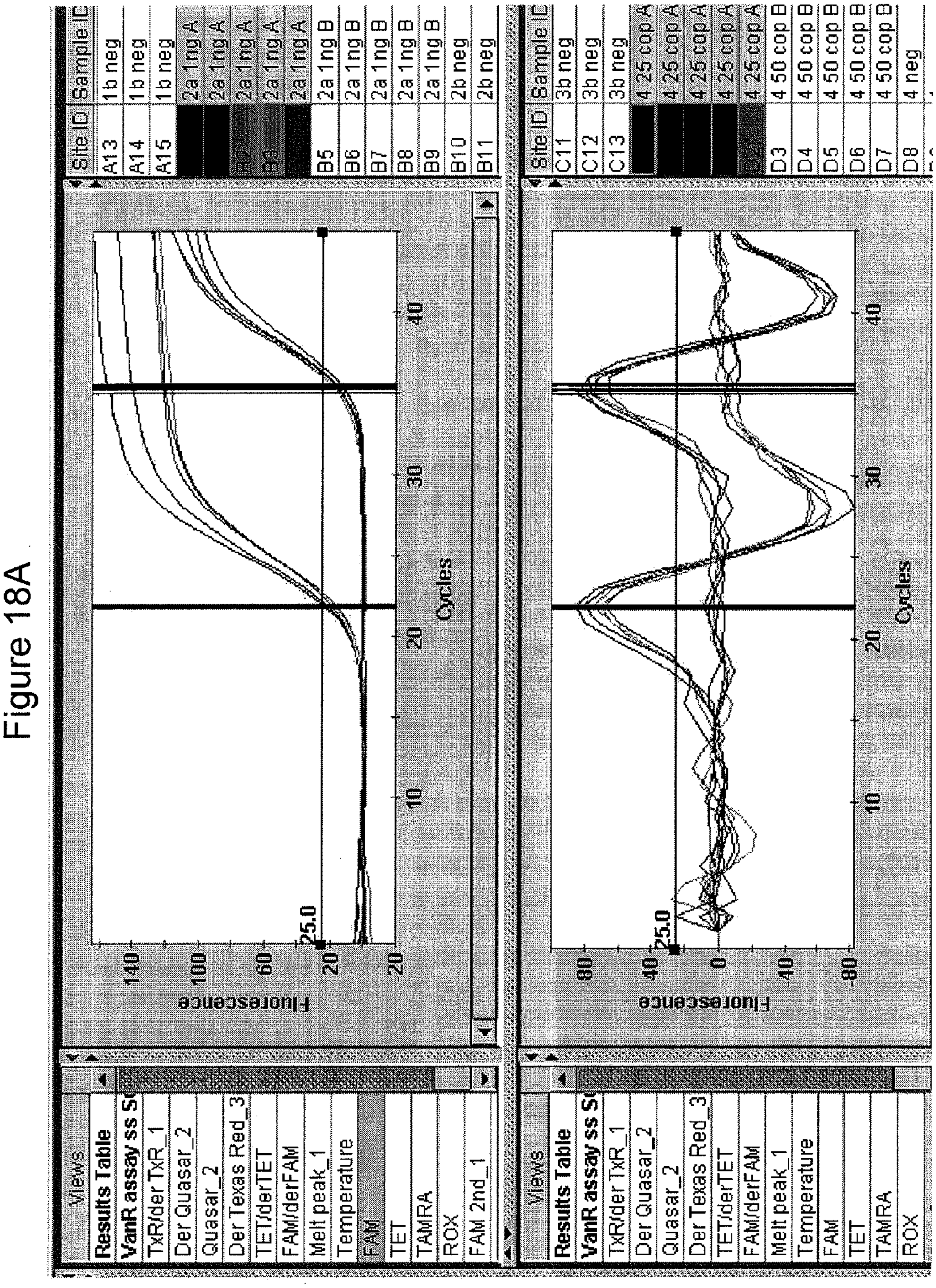
Figure 18B:
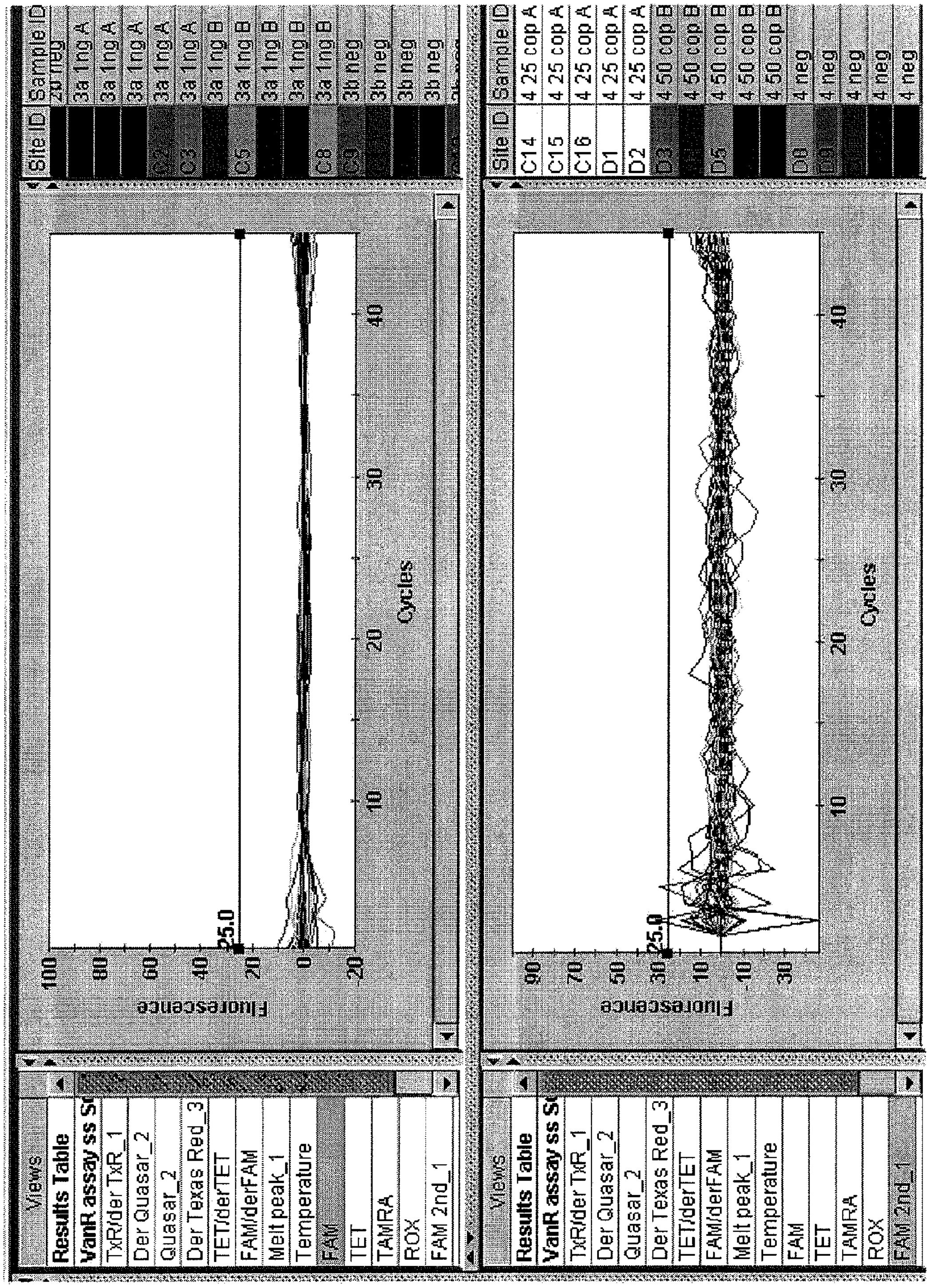

FIGS. 18A and 18B show the fluorescence signal readout obtained in the FAM channel when vanA template (FIG. 18A) or non-specific template (FIG. 18B) DNA was used in PCR according to Example 23.

Figure 19A:
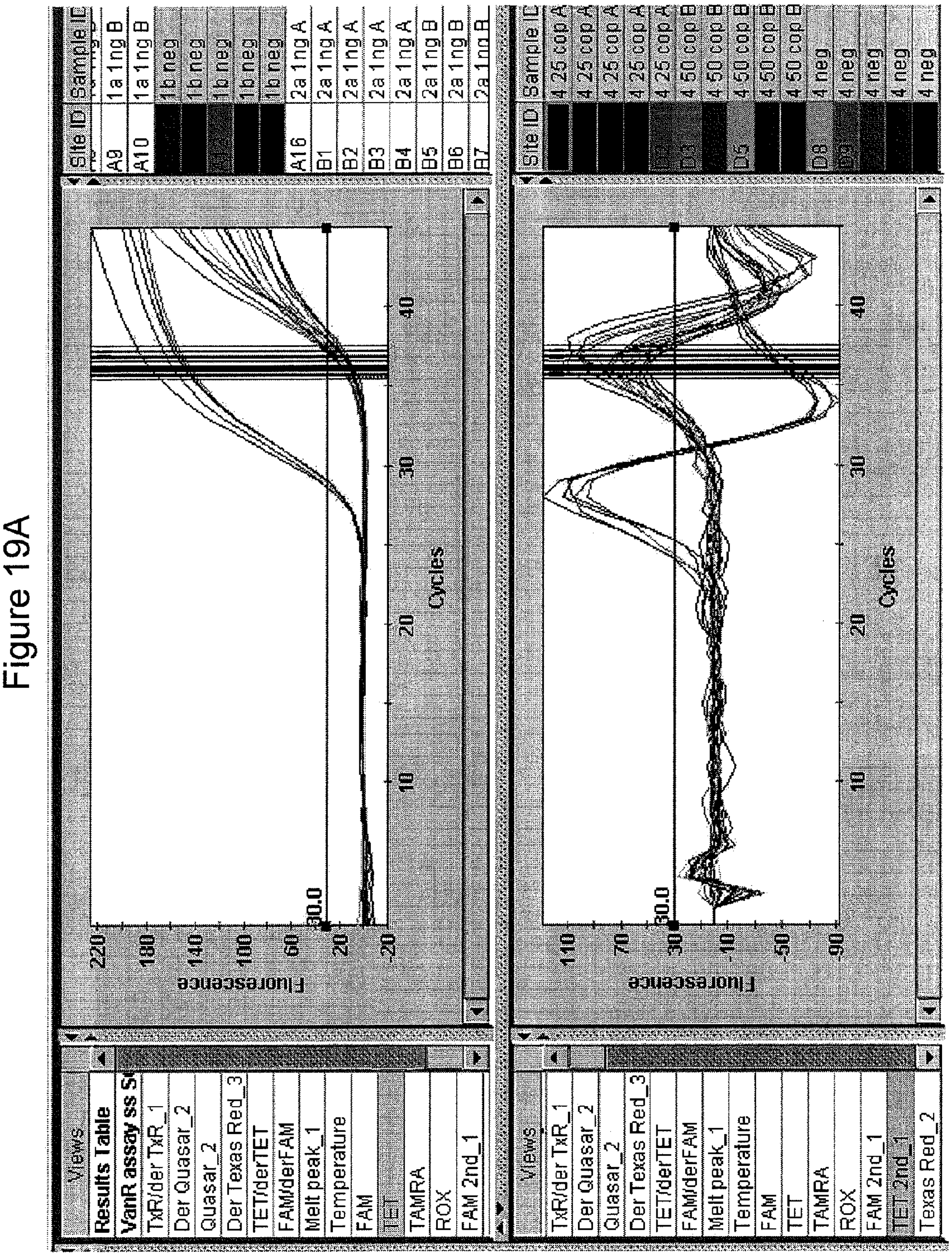
Figure 19B:
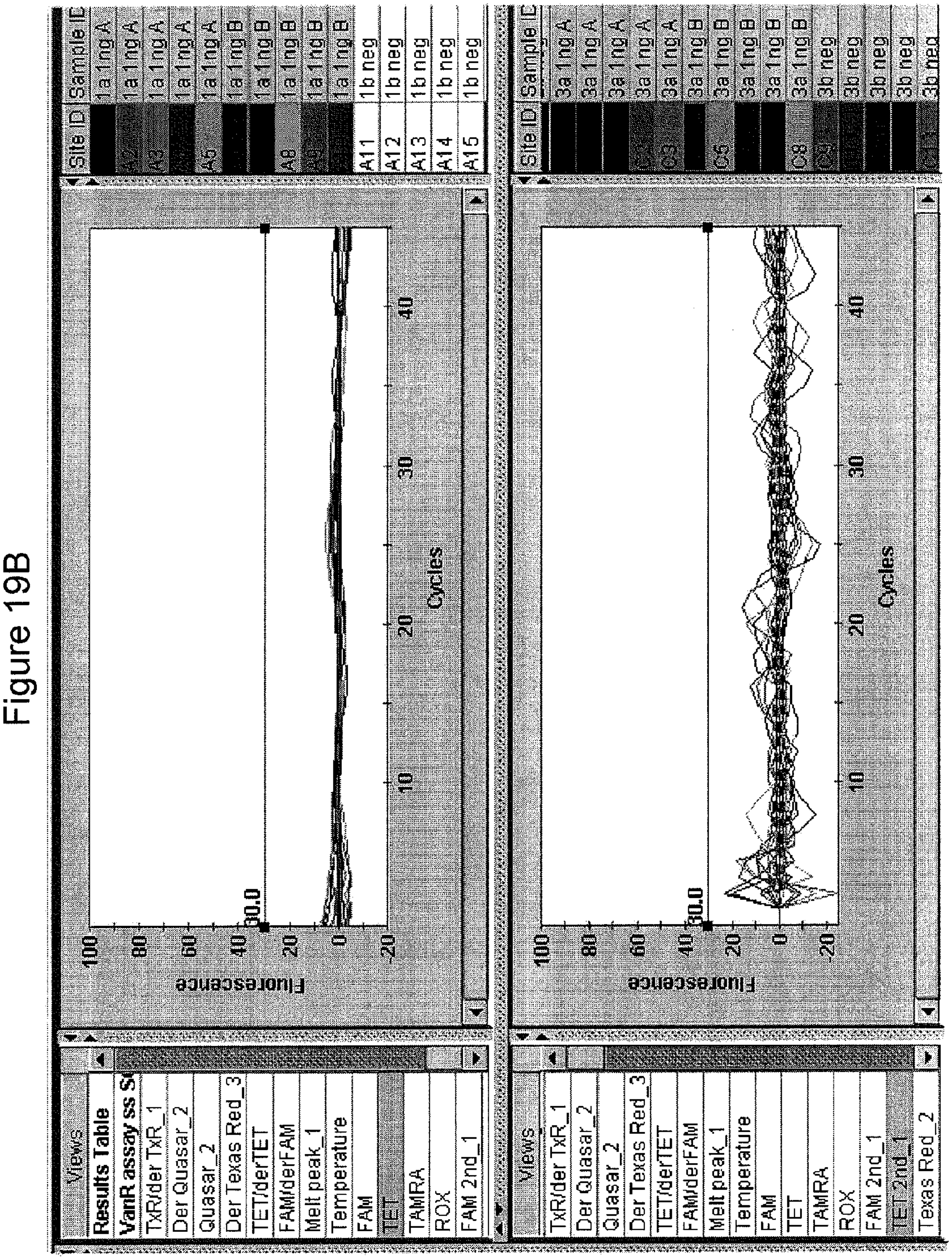

FIGS. 19A and 19B show the fluorescence signal readout obtained in the TET channel when internal control (IC) template (FIG. 19A) or non-specific template (FIG. 19B) DNA was used in PCR according to Example 23

Figure 20A:
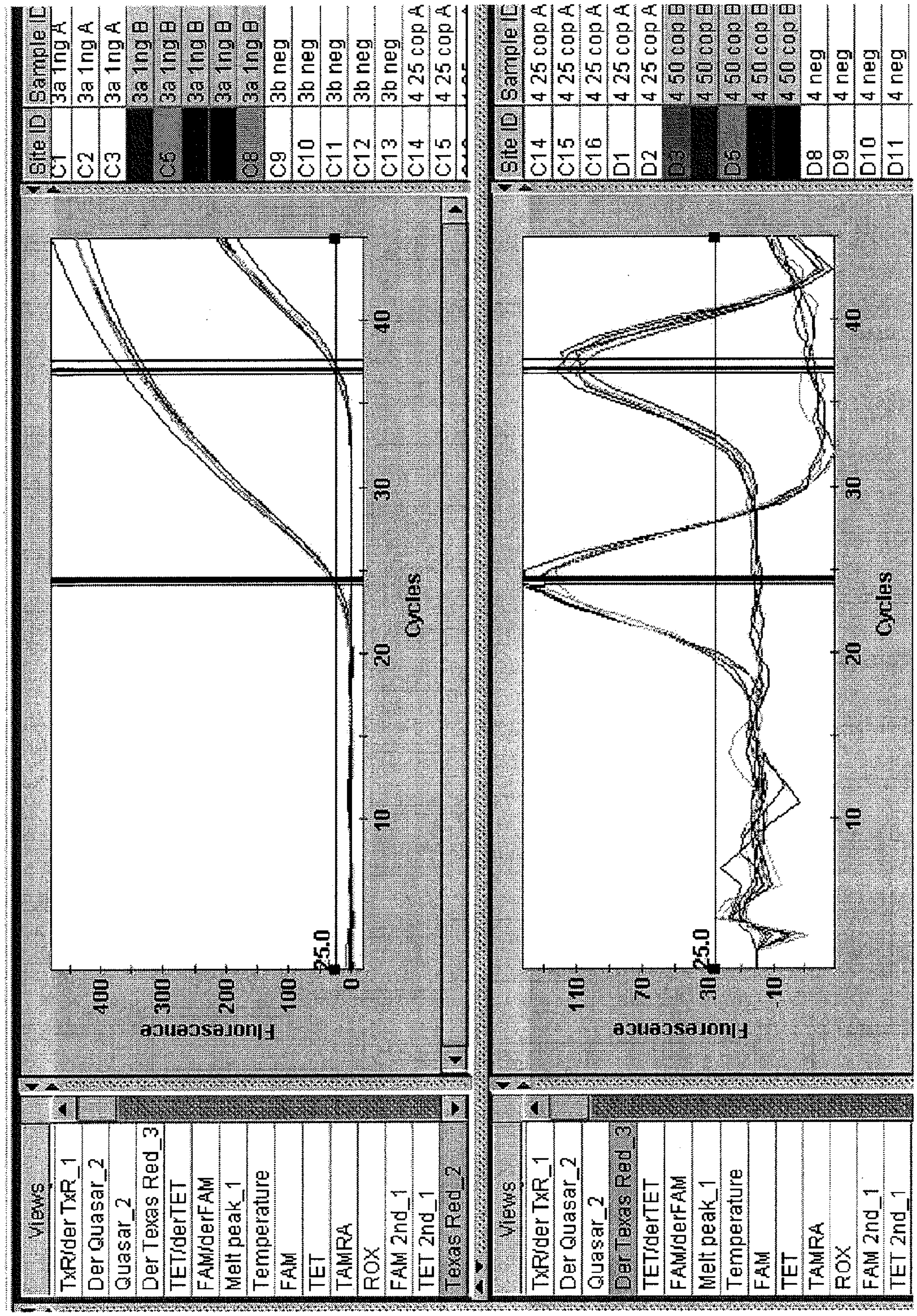
Figure 20B:
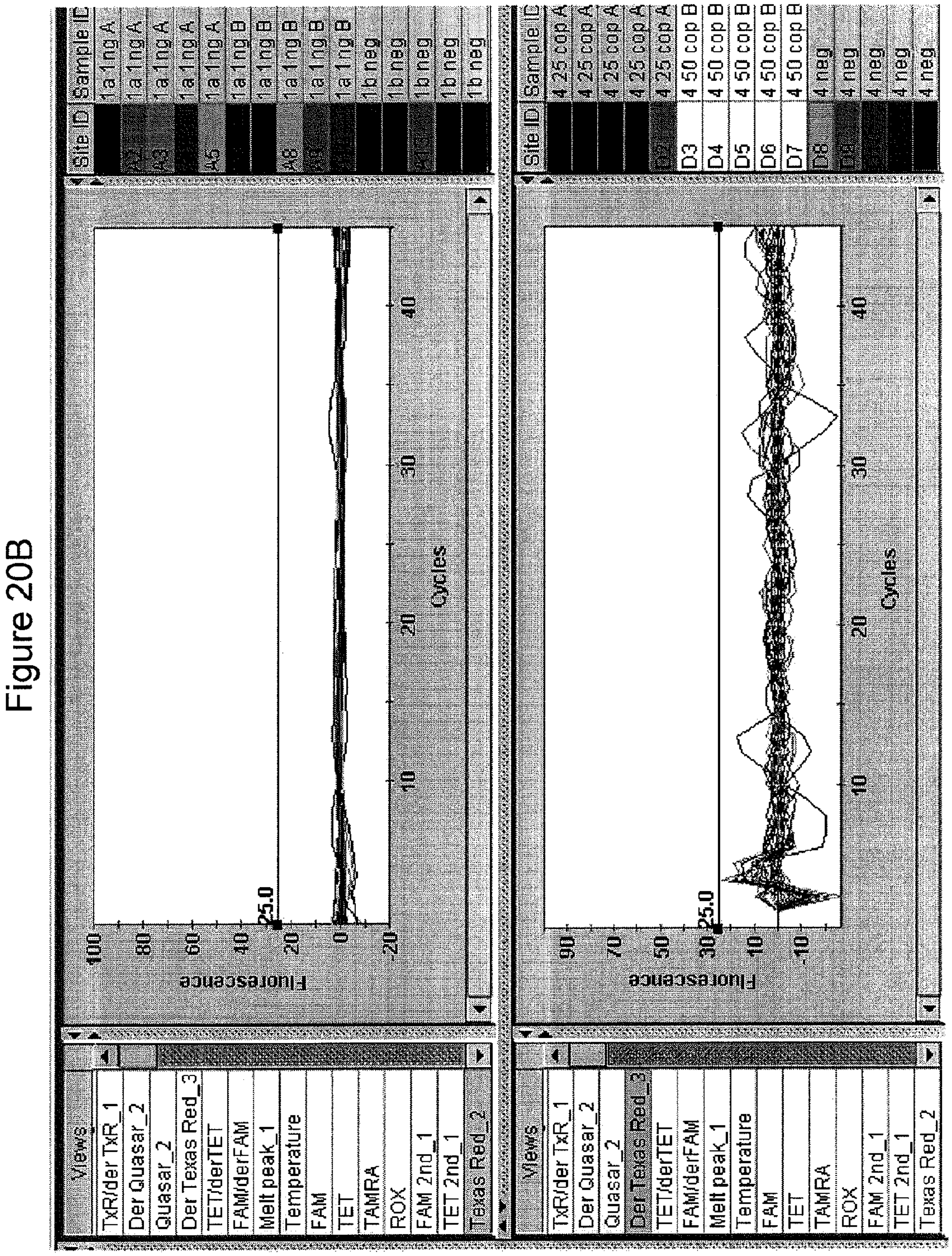

FIGS. 20A and 20B show the fluorescence signal readout obtained in the Texas Red channel when vanB template (FIG. 20A) or non-specific template (FIG. 20B) DNA was used in the PCR according to Example 23.

Figure 21:
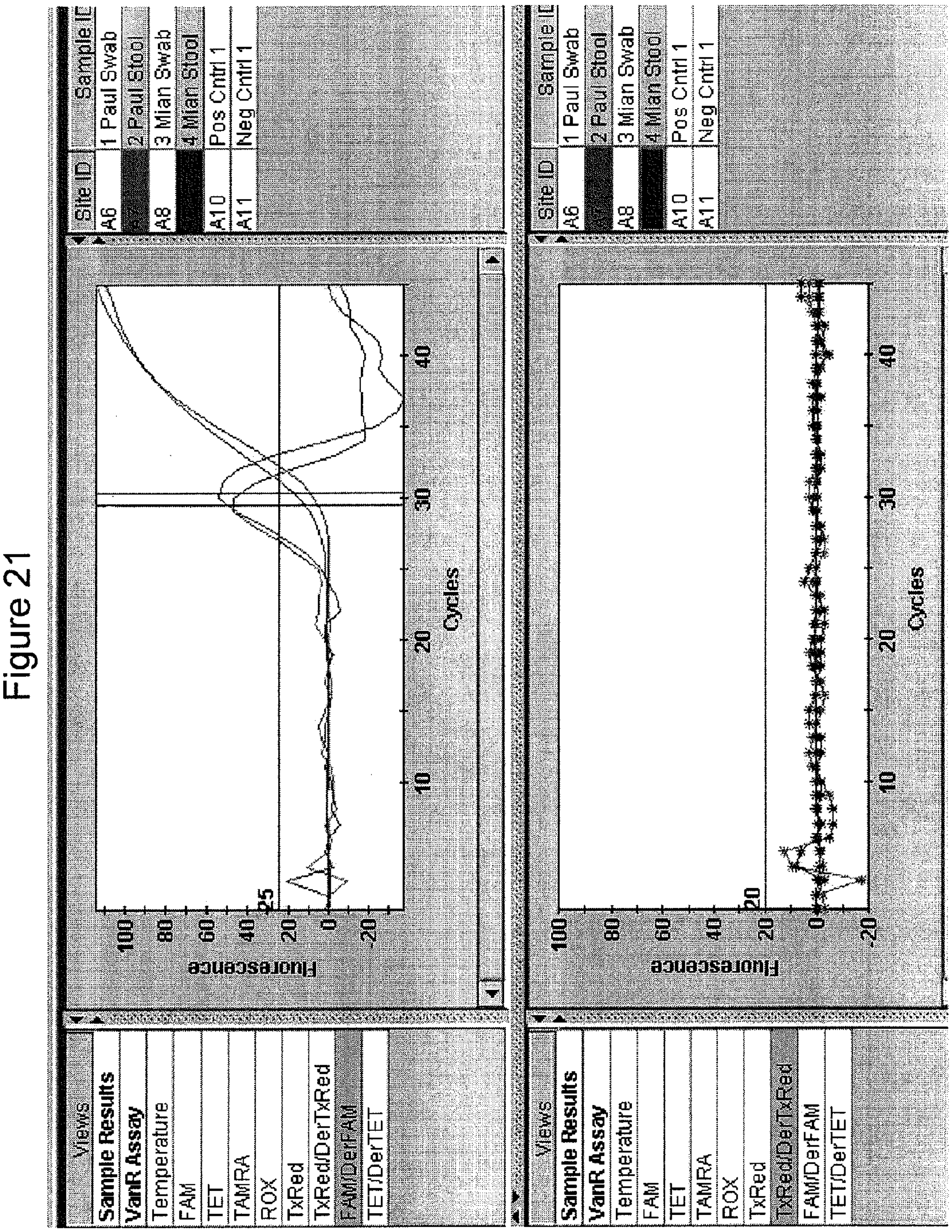

FIG. 21 shows the fluorescent signal readout obtained in the vanR assay for a vanA positive clinical specimen. The top panel shows the fluorescent readout from the FAM channel, and the bottom panel shows the fluorescent readout in the Texas Red channel, designed to detect the vanB probe.

Figure 22:
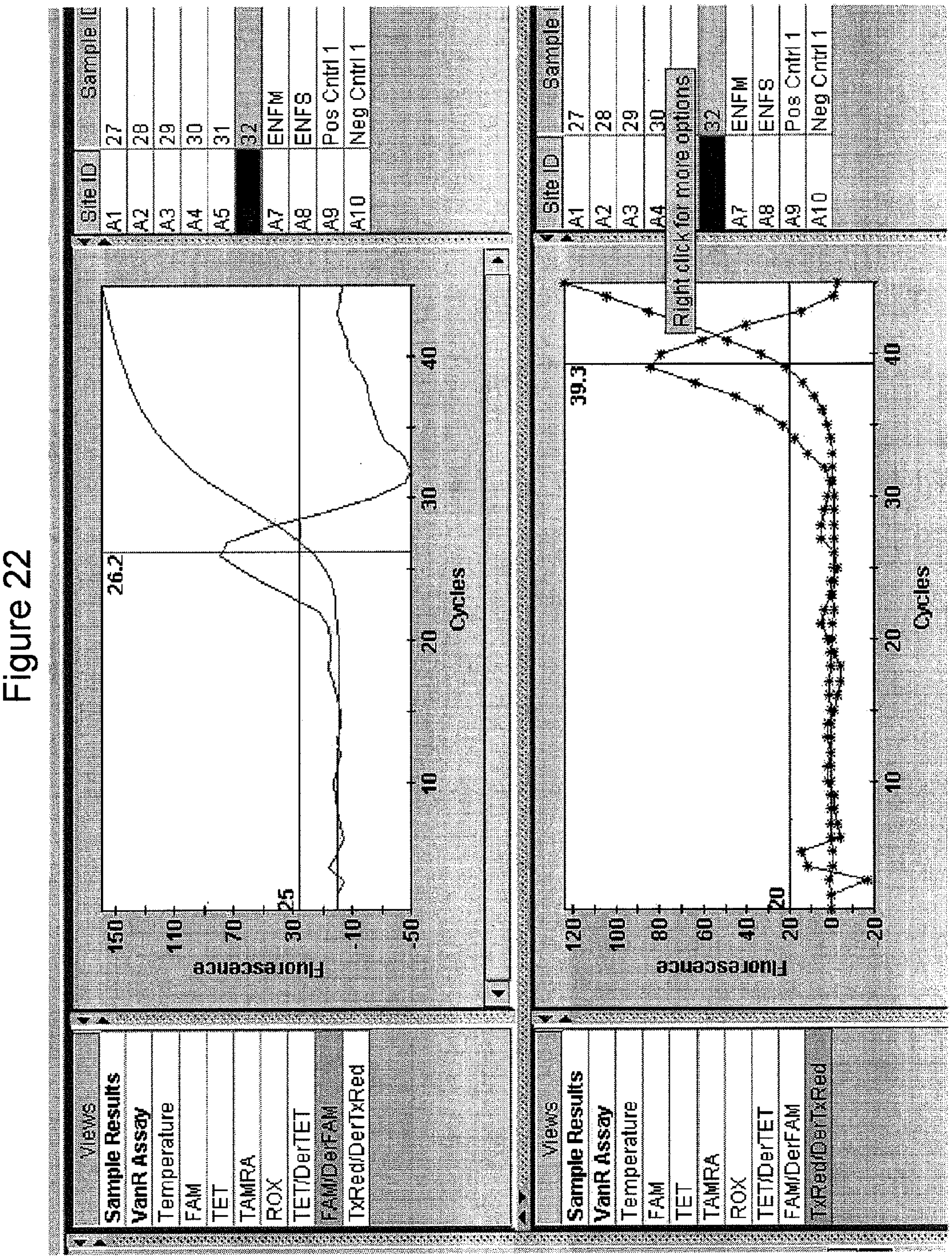

FIG. 22 shows the fluorescent signal readout obtained in the vanR assay for a clinical specimen that is both vanA and vanB positive. The top panel shows the readout from the FAM channel (vanA) and the bottom panel a shows the readout from the Texas Red channel (vanB).

Figure 23:
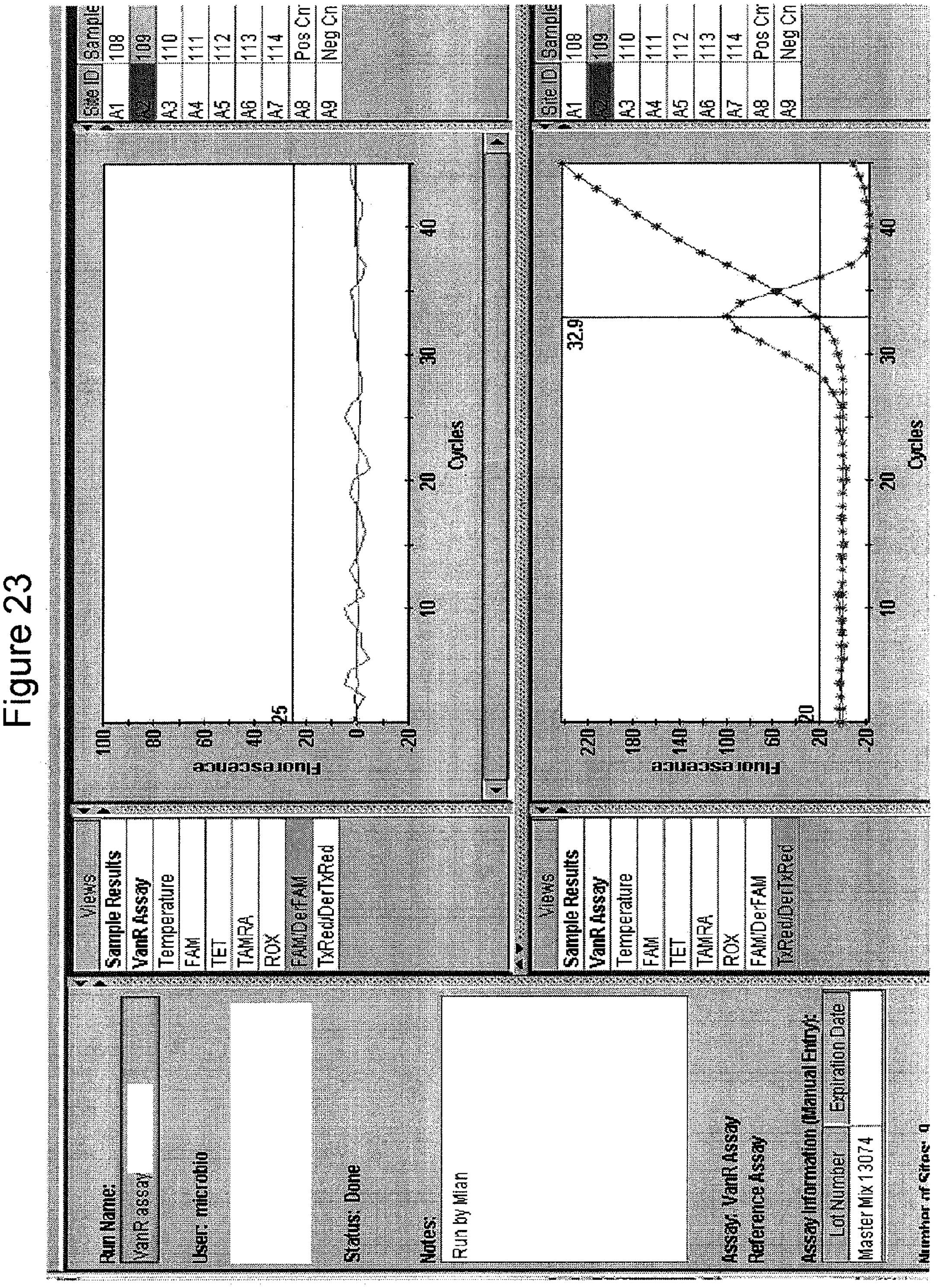

FIG. 23 shows the fluorescent signal readout obtained in the vanR assay for a clinical specimen that is vanB positive. The top panel shows the FAM channel (vanA) and the bottom channel shows the fluorescent readout from the Texas Red channel (vanB).

Figure 24:
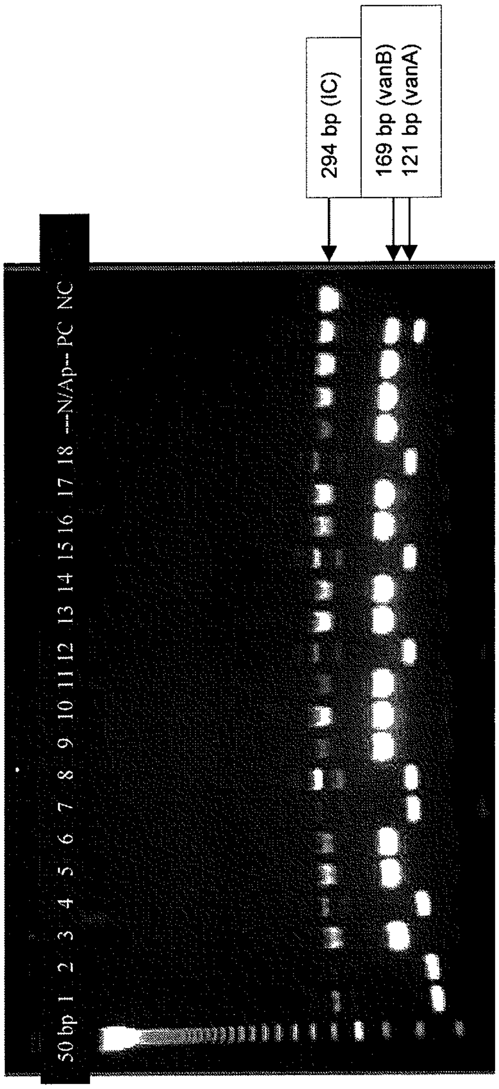

FIG. 24 shows an agarose gel of the DNA amplification products from PCR using the template DNA sources listed in Table 36. The numbers above the lanes correspond to the numbers in Table 36.

Figure 25:
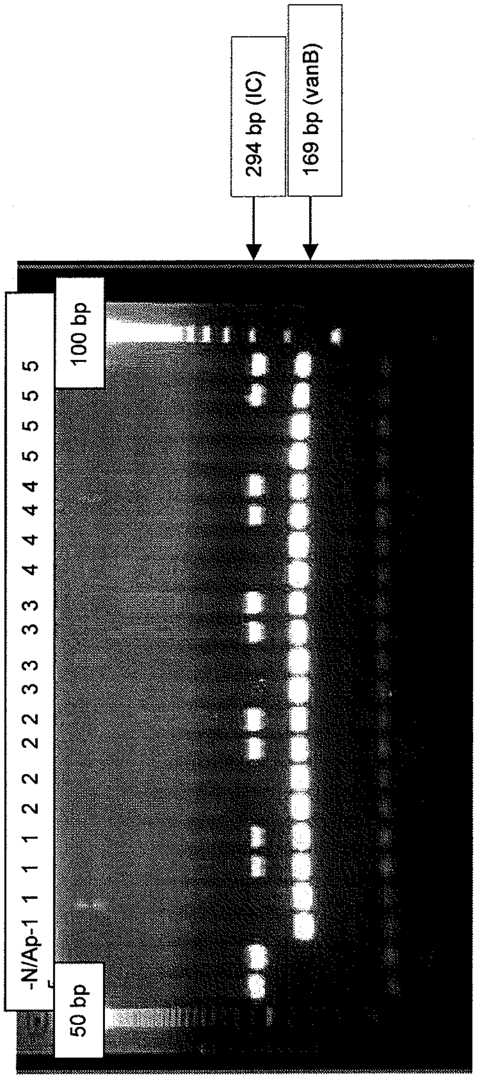

FIG. 25 shows an agarose gel of the DNA amplification products from PCR using the template DNA sources listed in Table 37. The numbers above the lanes correspond to the numbers in Table 37.

DETAILED DESCRIPTION OF THE PREFERRED EMBODIMENT

The present inventors reasoned that comparing the published *Haemophilus influenzae* and *Mycoplasma genitalium* genomes and searching for conserved genes could provide targets to develop useful diagnostic primers and probes. This sequence comparison is highly informative as these two bacteria are distantly related and most genes present in the minimal genome of *M. genitalium* are likely to be present in every bacterium. Therefore genes conserved between these two bacteria are likely to be conserved in all other bacteria.

Following the genomic comparison, it was found that several protein-coding genes were conserved in evolution. Highly conserved proteins included the translation elongation factors G (EF-G) and Tu (EF-Tu) and the β subunit of $F_0F_1$ type ATP-synthase, and to a lesser extent, the RecA recombinase. These four proteins coding genes were selected amongst the 20 most conserved genes on the basis that they all possess at least two highly conserved regions suitable for the design of universal amplification and sequencing primers. Moreover, within the fragment amplified by these primers, highly conserved and more variable regions are also present hence suggesting it might be possible to rapidly obtain sequence information from various microbial species to design universal as well as species-, genus-, family-, or group-specific primers and probes of potential use for the detection and identification and/or quantification of microorganisms.

Translation elongation factors are members of a family of GTP-binding proteins which intervene in the interactions of tRNA molecules with the ribosome machinery during essential steps of protein synthesis. The role of elongation factor Tu is to facilitate the binding of aminoacylated tRNA molecules to the A site of the ribosome. The eukaryotic, archaeal (archaebacterial) and algal homolog of EF-Tu is called elongation factor 1 alpha ($EF\text{-}_{1\alpha}$). All protein synthesis factors originated from a common ancestor via gene duplications and fusions (Cousineau et al., 1997, J. Mol. Evol. 45:661-670). In particular, elongation factor G (EF-G), although having a functional role in promoting the translocation of aminoacyl-tRNA molecules from the A site to the P site of the ribosome, shares sequence homologies with EF-Tu and is thought to have arisen from the duplication and fusion of an ancestor of the EF-Tu gene.

In addition, EF-Tu is known to be the target for antibiotics belonging to the elfamycin's group as well as to other structural classes (Anborgh and Parmeggiani, 1991, EMBO J. 10:779-784; Luiten et al., 1992, European patent application serial No. EP 0 466 251 A1). EF-G for its part, is the target of the antibiotic fusidic acid. In addition to its crucial activities in translation, EF-Tu has chaperone-like functions in protein folding, protection against heat denaturation of proteins and interactions with unfolded proteins (Caldas et al., 1998, J. Biol. Chem. 273:11478-11482). Interestingly, a form of the EF-Tu protein has been identified as a dominant component of the periplasm of *Neisseria gonorrhoeae* (Porcella et al., 1996, Microbiology 142:2481-2489), hence suggesting that at least in some bacterial species, EF-Tu might be an antigen with vaccine potential.

$F_0F_1$ type ATP-synthase belongs to a superfamily of proton-translocating ATPases divided in three major families: P, V and F (Nelson and Taiz, 1989, TIBS 14:113-116). P-ATPases (or $E_1$-$E_2$ type) operate via a phosphorylated intermediate and are not evolutionarily related to the other two families. V-ATPases (or $V_0V_1$ type) are present on the vacuolar and other endomembranes of eukaryotes, on the plasma membrane of archaea (archaebacteria) and algae, and also on the plasma membrane of some eubacteria especially species belonging to the order Spirochaetales as well as to the Chlamydiaceae and Deinococcaceae families. F-ATPases (or $F_0F_1$ type) are found on the plasma membrane of most eubacteria, on the inner membrane of mitochondria and on the thylakoid membrane of chloroplasts. They function mainly in ATP synthesis. They are large multimeric enzymes sharing numerous structural and functional features with the V-ATPases. F and V-type ATPases have diverged from a common ancestor in an event preceding the appearance of eukaryotes. The β subunit of the F-ATPases is the catalytic subunit and it possesses low but significant sequence homologies with the catalytic A subunit of V-ATPases.

The translation elongation factors EF-Tu, EF-G and EF-1α and the catalytic subunit of F or V-types ATP-synthase, are highly conserved proteins sometimes used for phylogenetic analysis and their genes are also known to be highly conserved (Iwabe et al., 1989, Proc. Natl. Acad. Sci. USA 86:9355-9359, Gogarten et al., 1989, Proc. Natl. Acad. Sci. USA 86:6661-6665, Ludwig et al., 1993, Antonie van Leeuwenhoek 64:285-305). A recent BLAST (Altschul et al., 1997, J. Mol. Biol. 215:403-410) search performed by the present inventors on the GenBank, European Molecular Biology Laboratory (EMBL), DNA Database of Japan (DDBJ) and specific genome project databases indicated that throughout bacteria, the EF-Tu and the β subunit of $F_0F_1$ type ATP-synthase genes may be more conserved than other genes that are well conserved between *H. influenzae* and *M. genitalium.*

The RecA recombinase is a multifunctional protein encoded by the recA gene. It plays a central role in homologous recombination, it is critical for the repair of DNA damage and it is involved in the regulation of the SOS system by promoting the proteolytic digestion of the LexA repressor. It is highly conserved in bacteria and could serve as a useful genetic marker to reconstruct bacterial phylogeny (Miller and Kokjohn, 1990, Annu. Rev. Microbiol. 44:365-394). Although RecA possesses some highly conserved sequence segments that we used to design universal primers aimed at sequencing the recA fragments, it is clearly not as well conserved EF-G, EF-Tu and β subunit of $F_0F_1$ type ATP-synthase. Hence, RecA may not be optimal for universal detection of bacteria with high sensitivity but it was chosen because preliminary data indicated that EF-G, EF-Tu and β subunit of $F_0F_1$ type ATP-synthase may sometimes be too closely related to find specific primer pairs that could discriminate between certain very closely related species and genera. While RecA, EF-G, EF-Tu and β subunit of $F_0F_1$ type ATP-synthase genes, possesses highly conserved regions suitable for the design of universal sequencing primers, the less conserved region between primers should be divergent enough to allow species-specific and genus-specific primers in those cases.

Figure 3:
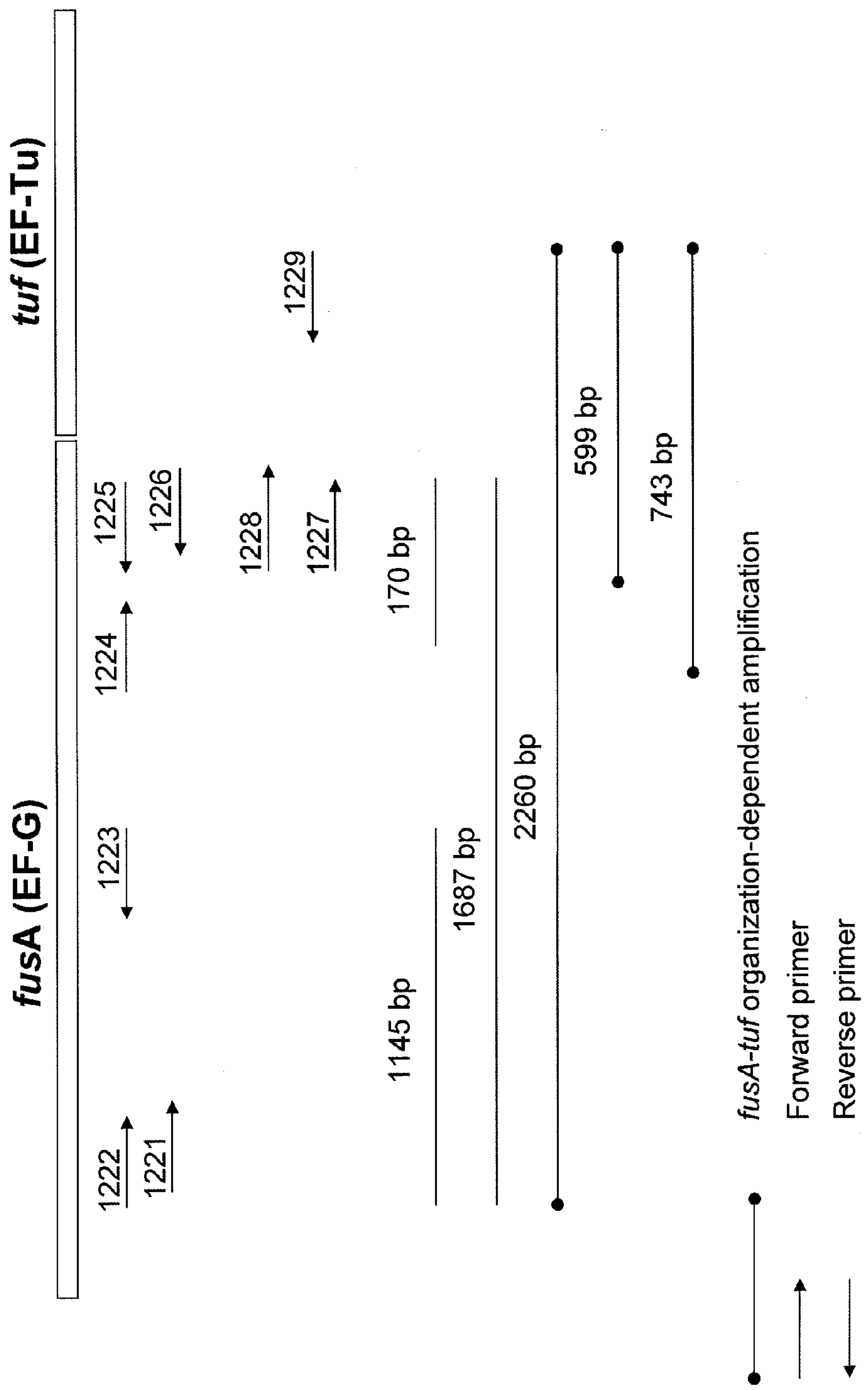
FIG. 3 illustrates the approach used to design specific amplification primers from fusA as well as from the region between the end of fusA and the beginning of tuf in the streptomycin (str) operon (referred to as the fusA-tuf intergenic spacer in Table 7). Shown is a schematic organization of universal amplification primers (SEQ ID NOs. 1221-1229) in the str operon. Amplicon sizes are given in bases pairs. Drawing not to scale, as the fusA-tuf intergenic spacer size varies depending on the bacterial species. Indicated amplicon lengths are for *E. coli.*

Thus, as targets to design primers and probes for the genetic detection of microorganisms, the present inventors have focused on the genes encoding these four proteins: tuf, the gene for elongation factor Tu (EF-Tu); fus, the gene for the elongation factor G (EF-G); atpD, the gene for β subunit of $F_0F_1$ type ATP-synthase; and recA, the gene encoding the RecA recombinase. In several bacterial genomes tuf is often found in two highly similar duplicated copies named tufA and tufB (Filer and Furano, 1981, J. Bacteriol. 148:1006-1011, Sela et al., 1989, J. Bacteriol. 171:581-584). In some particular cases, more divergent copies of the tuf genes can exist in some bacterial species such as some actinomycetes (Luiten et al. European patent application publication No. EP 0 446 251 A1; Vijgenboom et al., 1994, Microbiology 140:983-998) and, as revealed as part of this invention, in several enterococcal species. In several bacterial species, tuf is organized in an operon with its homolog gene for the elongation factor G (EF-G) encoded by the fusA gene (FIG. 3). This operon is often named the str operon. The tuf, fus, atpD and recA genes were chosen as they are well conserved in evolution and have highly conserved stretches as well as more variable segments. Moreover, these four genes have eukaryotic orthologs which are described in the present invention as targets to identify fungi and parasites. The eukaryotic homolog of elongation factor Tu is called elongation factor 1-alpha (EF-1α) (gene name: tef, tef1, ef1, ef-1 or EF-1). In fungi, the gene for EF-1α occurs sometimes in two or more highly similar duplicated copies (often named tef1, tef2, tef3 . . . ). In addition, eukaryotes have a copy of elongation factor Tu which is originating from their organelle genome ancestry (gene name: tuf1, tufM or tufA). For the purpose of the current invention, the genes for these four functionally and evolutionarily linked elongation factors (bacterial EF-Tu and EF-G, eukaryotic EF-1α, and organellar EF-Tu) will hereafter be designated as <<tuf nucleic acids and/or sequences>>. The eukaryotic (mitochondrial) $F_0F_1$ type ATP-synthase beta subunit gene is named atp2 in yeast. For the purpose of the current invention, the genes of catalytic sub-unit of either F or V-type ATP-synthase will hereafter be designated as <<atpD nucleic acids and/or sequences>>. The eukaryotic homologs of RecA are distributed in two families, typified by the Rad51 and Dmc1 proteins. Archaeal homologs of RecA are called RadA. For the purpose of the current invention, the genes corresponding to the latter proteins will hereafter be designated as <<recA nucleic acids and/or sequences>>.

In the description of this invention, the terms <<nucleic acids>> and <<sequences>> might be used interchangeably. However, <<nucleic acids>> are chemical entities while <<sequences>> are the pieces of information derived from (inherent to) these <<nucleic acids>>. Both nucleic acids and sequences are equivalently valuable sources of information for the matter pertaining to this invention.

Figure 1:
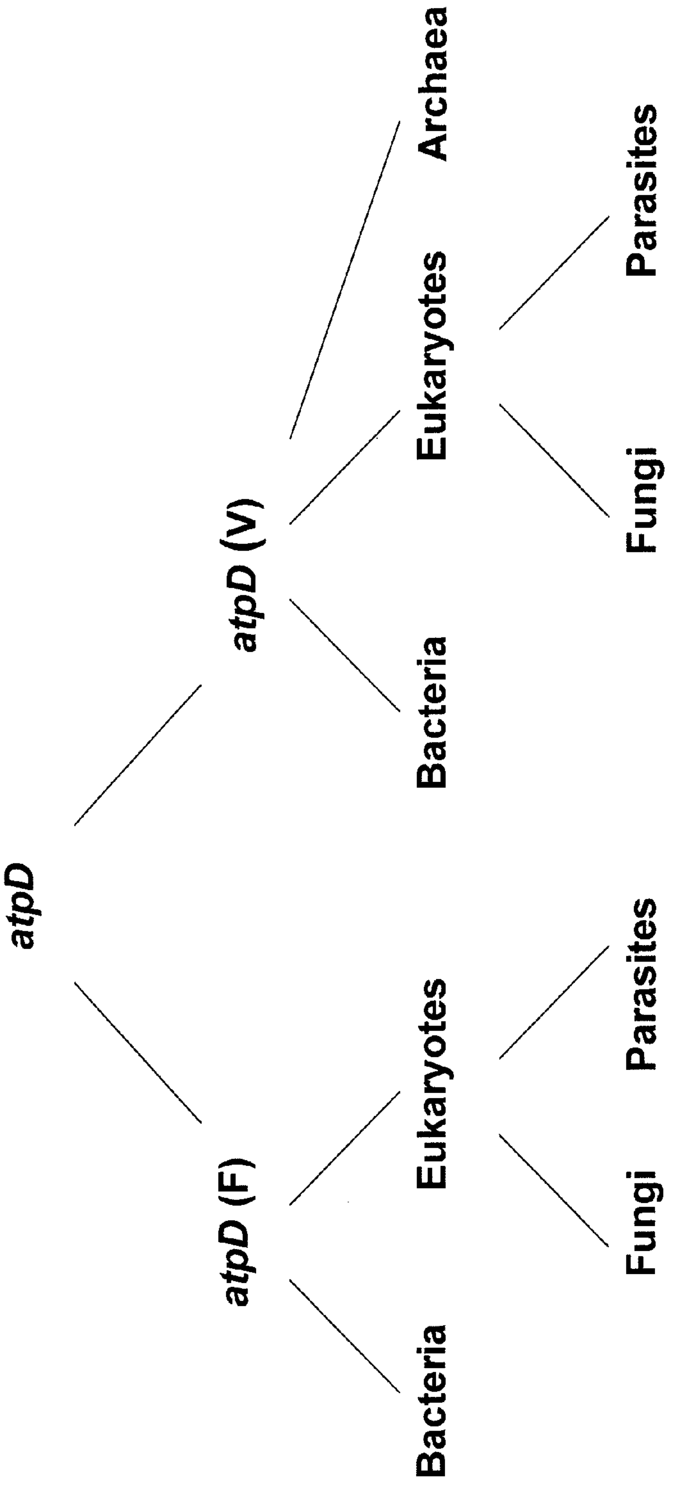
FIGS. 1 and 2 illustrate the principal subdivisions of the tuf and atpD sequences repertories, respectively. For the design of primers and probes, depending on the needs, one may want to use the complete data set illustrated on the top of the pyramid or use only a subset illustrated by the different branching points. Smaller subdivisions, representing groups, families, genus and species, could even be made to extend to the bottom of the pyramid. Because the tuf and atpD sequences are highly conserved and evolved with each species, the design of primers and probes does not need to include all the sequences within the database or its subdivisions. As illustrated in Annexes IV to XX, XXIII to XXXI, XXXVIII and XLII, depending on the use, sequences from a limited number of species can be carefully selected to represent: i) only the main phylogenetic branches from which the intended probes and primers need to be differentiating, and ii) only the species for which they need to be matching. However, for ubiquity purposes, and especially for primers and probes identifying large groups of species (genus, family, group or universal, or sequencing primers), the more data is included into the sequence analysis, the better the probes and primers will be suitable for each particular intended use. Similarly, for specificity purposes, a larger data set (or repertory) ensures optimal primers and probes design by reducing the chance of employing nonspecific oligonucleotides.
Figure 2:
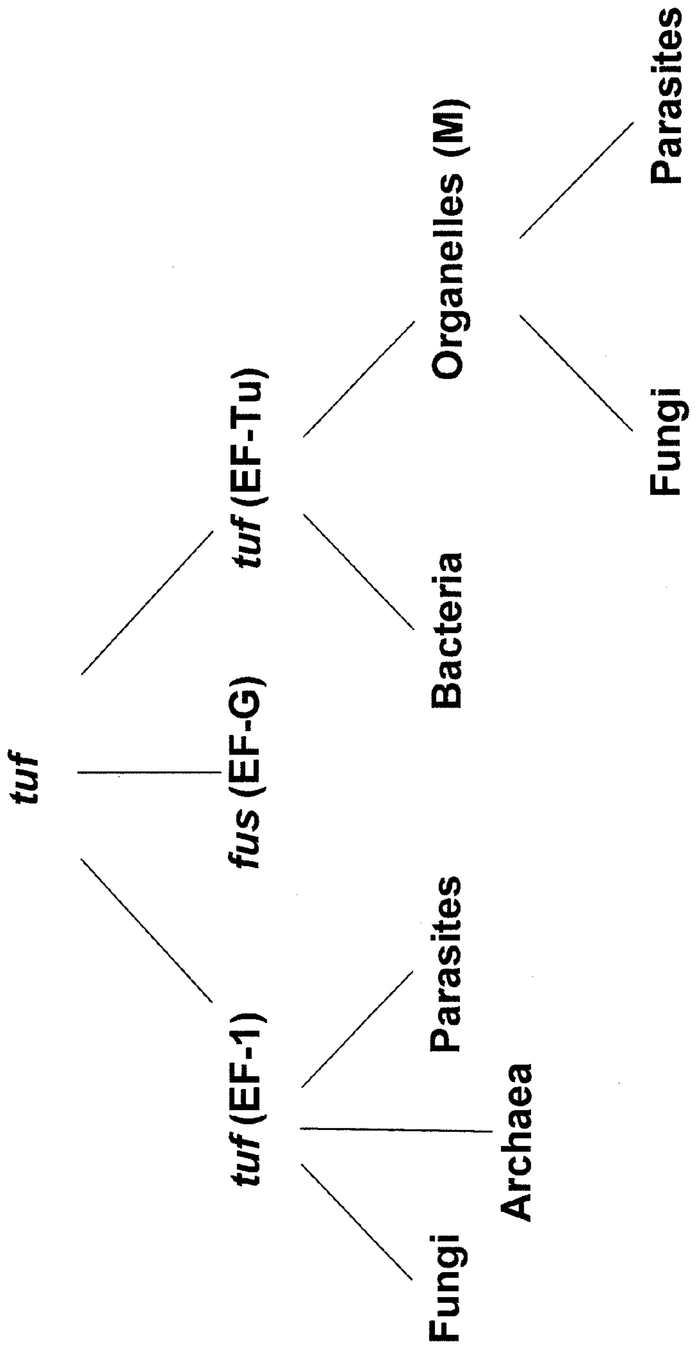

Analysis of multiple sequence alignments of tuf and atpD sequences permitted the design of oligonucleotide primers (and probes) capable of amplifying (or hybridizing to) segments of tuf (and/or fus) and atpD genes from a wide variety of bacterial species (see Examples 1 to 4, 24 and 26, and Table 7). Sequencing and amplification primer pairs for tuf nucleic acids and/or sequences are listed in Annex I and hybridization probes are listed in Annexes III and XLVII. Sequencing and amplification primer pairs for atpD nucleic acids and/or sequences are listed in Annex II. Analysis of the main subdivisions of tuf and atpD sequences (see FIGS. 1 and 2) permitted to design sequencing primers amplifying specifically each of these subdivisions. It should be noted that these sequencing primers could also be used as universal primers. However, since some of these sequencing primers include several variable sequence (degenerated) positions, their sensitivity could be lower than that of universal primers developed for diagnostic purposes. Further subdivisions could be done on the basis of the various phyla where these genes are encountered.

Similarly, analysis of multiple sequence alignments of recA sequences present in the public databases permitted the design of oligonucleotide primers capable of amplifying segments of recA genes from a wide variety of bacterial species. Sequencing and amplification primer pairs for recA sequences are listed in Annex XXI. The main subdivisions of recA nucleic acids and/or sequences comprise recA, radA, rad51 and dmc1. Further subdivisions could be done on the basis of the various phyla where these genes are encountered.

The present inventor's strategy is to get as much sequence data information from the four conserved genes (tuf, fus, atpD and recA). This ensemble of sequence data forming a repertory (with subrepertories corresponding to each target gene and their main sequence subdivisions) and then using the sequence information of the sequence repertory (or subrepertories) to design primer pairs that could permit either universal detection of algae or archaea or bacteria or fungi or parasites, detection of a family or group of microorganism (e.g. Enterobacteriaceae), detection of a genus (e.g. *Streptococcus*) or finally a specific species (e.g. *Staphylococcus aureus*). It should be noted that for the purpose of the present invention a group of microorganisms is defined depending on the needs of the particular diagnostic test. It does not need to respect a particular taxonomical grouping or phylum. See Example 12 where primers were designed to amplify a group a bacteria consisting of the 17 major bacterial species encountered as contaminants of platelet concentrates. Also remark that in that Example, the primers are not only able to sensitively and rapidly detect at least the 17 important bacterial species, but could also detect other species as well, as shown in Table 14. In these circumstances the primers shown in Example 12 are considered universal for platelet-contaminating bacteria. To develop an assay specific for the latter, one or more primers or probes specific to each species could be designed. Another example of primers and/or probes for group detection is given by the Pseudomonad group primers. These primers were designed based upon alignment of tuf sequences from real *Pseudomonas* species as well as from former *Pseudomonas* species such as *Stenotrophomonas maltophilia*. The resulting primers are able to amplify all *Pseudomonas* species tested as well as several species belonging to different genera, hence as being specific for a group including *Pseudomonas* and other species, we defined that group as Pseudomonads, as several members were former *Pseudomonas*.

For certain applications, it may be possible to develop a universal, group, family or genus-specific reaction and to proceed to species identification using sequence information within the amplicon to design species-specific internal probes or primers, or alternatively, to proceed directly by sequencing the amplicon. The various strategies will be discussed further below.

The ensembles formed by public and proprietary tuf, atpD and recA nucleic acids and/or sequences are used in a novel fashion so they constitute three databases containing useful information for the identification of microorganisms.

Sequence repertories of other gene targets were also built to solve some specific identification problems especially for microbial species genetically very similar to each other such as *E. coli* and *Shigella* (see Example 23). Based on tuf, atpD and recA sequences, *Streptococcus pneumoniae* is very difficult to differentiate from the closely related species *S. oralis* and *S. mitis*. Therefore, we elected to built a sequence repertory from hexA sequences (Example 19), a gene much more variable than our highly conserved tuf, atpD and recA nucleic acids and/or sequences.

For the detection of mutations associated with antibiotic resistance genes, we also built repertories to distinguish between point mutations reflecting only gene diversity and point mutations involved in resistance. This was done for pbp1a, pbp2b and pbp2x genes of penicillin-resistant and sensitive *Streptococcus pneumoniae* (Example 18) and also for gyrA and parC gene fragments of various bacterial species for which quinolone resistance is important to monitor.

Oligonucleotide Primers and Probes Design and Synthesis

The tuf, fus, atpD and recA DNA fragments sequenced by us and/or selected from public databases (GenBank and EMBL) were used to design oligonucleotides primers and probes for diagnostic purposes. Multiple sequence alignments were made using subsets of the tuf or atpD or recA sequences repertory. Subsets were chosen to encompass as much as possible of the targetted microorganism(s) DNA sequence data and also include sequence data from phylogenetically related microorganisms from which the targetted microorganism(s) should be distinguished. Regions suitable for primers and probes should be conserved for the targetted microorganism(s) and divergent for the microorganisms from which the targetted microorganism(s) should be distinguished. The large amount of tuf or atpD or recA sequences data in our repertory permits to reduce trial and errors in obtaining specific and ubiquitous primers and probes. We also relied on the corresponding peptide sequences of tuf, fus, atpD and recA nucleic acids and/or sequences to facilitate the identification of regions suitable for primers and probes design. As part of the design rules, all oligonucleotides (probes for hybridization and primers for DNA amplification by PCR) were evaluated for their suitability for hybridization or PCR amplification by computer analysis using standard programs (i.e. the Genetics Computer Group (GCG) programs and the primer analysis software Oligo™ 5.0). The potential suitability of the PCR primer pairs was also evaluated prior to the synthesis by verifying the absence of unwanted features such as long stretches of one nucleotide and a high proportion of G or C residues at the 3' end (Persing et al., 1993, Diagnostic Molecular Microbiology: Principles and Applications, American Society for Microbiology, Washington, D.C.). Oligonucleotide probes and amplification primers were synthesized using an automated DNA synthesizer (Perkin-Elmer Corp., Applied Bio systems Division).

The oligonucleotide sequence of primers or probes may be derived from either strand of the duplex DNA. The primers or probes may consist of the bases A, G, C, or T or analogs and they may be degenerated at one or more chosen nucleotide position(s). The primers or probes may be of any suitable length and may be selected anywhere within the DNA sequences from proprietary fragments or from selected database sequences which are suitable for (i) the universal detection of algae or archaea or bacteria or fungi or parasites, (ii) the species-specific detection and identification of any microorganism, including but not limited to: *Abiotrophia adiacens, Bacteroides fragilis, Bordetella pertussis, Candida albicans, Candida dubliniensis, Candida glabrata, Candida guilliermondii, Candida krusei, Candida lusitaniae, Candida parapsilosis, Candida tropicalis, Candida zeylanoides, Campylobacter jejuni* and *C. coli, Chlamydia pneumoniae, Chlamydia trachomatis, Cryptococcus neoformans, Cryptosporidium parvum, Enterococcus faecalis, Enterococcus faecium, Enterococcus gallinarum, Escherichia coli, Haemophilus influenzae, Legionella pneumophila, Mycoplasma pneumoniae, Neisseria gonorrhoeae, Pseudomonas aeruginosa, Staphylococcus aureus, Staphylococcus epidermidis, Staphylococcus haemolyticus, Staphylococcus hominis, Staphylococcus saprophyticus, Streptococcus agalactiae, Streptococcus pneumoniae, Trypanosoma brucei, Trypanosoma cruzi*, (iii) the genus-specific detection of *Bordetella* species, *Candida* species, *Clostridium* species, *Corynebacterium* species, *Cryptococcus* species, *Entamoeba species, Enterococcus* species, *Gemella* species, *Giardia* species, *Legionella* species, *Leishmania* species, *Staphylococcus* species, *Streptococcus* species, *Trypanosoma* species, (iv) the family-specific detection of Enterobacteriaceae family members, Mycobacteriaceae family members, Trypanosomatidae family members, (v) the detection of *Enterococcus casseliflavus-flavescens-gallinarum* group, *Enterococcus, Gemella* and *Abiotrophia adiacens* group, Pseudomonads extended group, Platelet-contaminating bacteria group, (vi) the detection of clinically important antimicrobial agents resistance genes listed in Table 5, (vii) the detection of clinically important toxin genes listed in Table 6.

Variants for a given target microbial gene are naturally occurring and are attributable to sequence variation within that gene during evolution (Watson et al., 1987, Molecular Biology of the Gene, 4th ed., The Benjamin/Cummings Publishing Company, Menlo Park, Calif.; Lewin, 1989, Genes IV, John Wiley & Sons, New York, N.Y.). For example, different strains of the same microbial species may have a single or more nucleotide variation(s) at the oligonucleotide hybridization site. The person skilled in the art is well aware of the existence of variant algal, archaeal, bacterial, fungal or parasitical DNA nucleic acids and/or sequences for a specific gene and that the frequency of sequence variations depends on the selective pressure during evolution on a given gene product. The detection of a variant sequence for a region between two PCR primers may be demonstrated by sequencing the amplification product. In order to show the presence of sequence variants at the primer hybridization site, one has to amplify a larger DNA target with PCR primers outside that hybridization site. Sequencing of this larger fragment will allow the detection of sequence variation at this site. A similar strategy may be applied to show variants at the hybridization site of a probe. Insofar as the divergence of the target nucleic acids and/or sequences or a part thereof does not affect the specificity and ubiquity of the amplification primers or probes, variant microbial DNA is under the scope of this invention. Variants of the selected primers or probes may also be used to amplify or hybridize to a variant DNA.

Sequencing of tuf Nucleic Acids and/or Sequences from a Variety of Archaeal, Bacterial, Fungal and Parasitical Species The nucleotide sequence of a portion of tuf nucleic acids and/or sequences was determined for a variety of archaeal, bacterial, fungal and parasitical species. The amplification primers (SEQ ID NOs. 664 and 697), which amplify a tuf gene portion of approximately 890 bp, were used along with newly designed sequencing primer pairs (See Annex I for the sequencing primers for tuf nucleic acids and/or sequences). Most primer pairs can amplify different copies of tuf genes (tufA and tufB). This is not surprising since it is known that for several bacterial species these two genes are nearly identical. For example, the entire tufA and tufB genes from *E. coli* differ at only 13 nucleotide positions (Neidhardt et al., 1996, *Escherichia coli* and *Salmonella*: Cellular and Molecular Biology, 2nd ed., American Society for Microbiology Press, Washington, D.C.). Similarly, some fungi are known to have two nearly identical copies of tuf nucleic acids and/or sequences (EF-1□). These amplification primers are degenerated at several nucleotide positions and contain inosines in order to allow the amplification of a wide range of tuf nucleic acids and/or sequences. The strategy used to select these amplification primers is similar to that illustrated in Annex I for the selection of universal primers. The tuf sequencing primers even sometimes amplified highly divergent copies of tuf genes (tufC) as illustrated in the case of some enterococcal species (SEQ ID NOs.: 73, 75, 76, 614 to 618, 621 and 987 to 989). To prove this, we have determined the enterococcal tuf nucleic acids and/or sequences from PCR amplicons cloned into a plasmid vector. Using the sequence data from the cloned amplicons, we designed new sequencing primers specific to the divergent (tufC) copy of enterococci (SEQ ID NOs.: 658-659 and 661) and then sequenced directly the tufC amplicons. The amplification primers (SEQ ID NOs.: 543, 556, 557, 643-645, 660, 664, 694, 696 and 697) could be used to amplify the tuf nucleic acids and/or sequences from any bacterial species. The amplification primers (SEQ ID NOs.: 558, 559, 560, 653, 654, 655, 813, 815, 1974-1984, 1999-2003) could be used to amplify the tuf (EF-1□ genes from any fungal and/or parasitical species. The amplification primers SEQ ID NOs. 1221-1228 could be used to amplify bacterial tuf nucleic acids and/or sequences of the EF-G subdivision (fusA) (FIG. 3). The amplification primers SEQ ID NOs. 1224, and 1227-1229 could be used to amplify bacterial tuf nucleic acids and/or sequences comprising the end of EF-G (fusA) and the beginning of EF-Tu (tuf), including the intergenic region, as shown in FIG. 3.

Most tuf fragments to be sequenced were amplified using the following amplification protocol: One μl of cell suspension (or of purified genomic DNA 0.1-100 ng/μl) was transferred directly to 19 μl of a PCR reaction mixture. Each PCR reaction contained 50 mM KCl, 10 mM Tris-HCl (pH 9.0), 0.1% Triton X-100, 2.5 mM $MgCl_2$, 1 μM of each of the 2 primers, 200 μM of each of the four dNTPs, 0.5 unit of Taq DNA polymerase (Promega Corp., Madison, Wis.). PCR reactions were subjected to cycling using a PTC-200 thermal cycler (MJ Research Inc., Watertown, Mass.) as follows: 3 min at 94-96° C. followed by 30-45 cycles of 1 min at 95° C. for the denaturation step, 1 min at 50-55° C. for the annealing step and 1 min at 72° C. for the extension step. Subsequently, twenty microliters of the PCR-amplified mixture were resolved by electrophoresis in a 1.5% agarose gel. The amplicons were then visualized by staining with methylene blue (Flores et al., 1992, Biotechniques, 13:203-205). The size of the amplification products was estimated by comparison with a 100-bp molecular weight ladder. The band corresponding to the specific amplification product was excised from the agarose gel and purified using the QIAquick™ gel extraction kit (QIAGEN Inc., Chatsworth, Calif.). The gel-purified DNA fragment was then used directly in the sequencing protocol. Both strands of the tuf genes amplification product were sequenced by the dideoxynucleotide chain termination sequencing method by using an Applied Biosystems automated DNA sequencer (model 377) with their Big Dye™ Terminator Cycle Sequencing Ready Reaction Kit (Applied Biosystems, Foster City, Calif.). The sequencing reactions were performed by using the same amplification primers and 10 ng/100 bp of the gel-purified amplicon per reaction. For the sequencing of long amplicons such as those of eukaryotic tuf (EF-1□ nucleic acids and/or sequences, we designed internal sequencing primers (SEQ ID NOs.: 654, 655 and 813) to be able to obtain sequence data on both strands for most of the fragment length. In order to ensure that the determined sequence did not contain errors attributable to the sequencing of PCR artifacts, we have sequenced two preparations of the gel-purified tuf amplification product originating from two independent PCR amplifications. For most target microbial species, the sequences determined for both amplicon preparations were identical. In case of discrepancies, amplicons from a third independent PCR amplification were sequenced. Furthermore, the sequences of both strands were 100% complementary thereby confirming the high accuracy of the determined sequence. The tuf nucleic acids and/or sequences determined using the above strategy are described in the Sequence Listing. Table 7 gives the originating microbial species and the source for each tuf sequence in the Sequence Listing.

The alignment of the tuf sequences determined by us or selected from databases revealed clearly that the length of the sequenced portion of the tuf genes is variable. There may be insertions or deletions of several amino acids. In addition, in several fungi introns were observed. Intron nucleic acids and/or sequences are part of tuf nucleic acids and/or sequences and could be useful in the design of species-specific primers and probes. This explains why the size of the sequenced tuf amplification products was variable from one fungal species to another. Consequently, the nucleotide positions indicated on top of each of Annexes IV to XX, XXIII to XXXI, XXXVIII and XLII do not correspond for sequences having insertions or deletions.

It should also be noted that the various tuf nucleic acids and/or sequences determined by us occasionally contain base ambiguities. These degenerated nucleotides correspond to sequence variations between tufA and tufB genes (or copies of the EF-G subdivision of tuf nucleic acids and/or sequences, or copies of EF-1□ subdivision of tuf nucleic acids and/or sequences for fungi and parasites) because the amplification primers amplify both tuf genes. These nucleotide variations were not attributable to nucleotide misincorporations by the Taq DNA polymerase because the sequence of both strands was identical and also because the sequences determined with both preparations of the gel-purified tuf amplicons obtained from two independent PCR amplifications were identical.

The Selection of Amplification Primers from tuf Nucleic Acids and/or Sequences

The tuf sequences determined by us or selected from public databases were used to select PCR primers for universal detection of bacteria, as well as for genus-specific, species-specific family-specific or group-specific detection and identification. The strategy used to select these PCR primers was based on the analysis of multiple sequence alignments of various tuf sequences. For more details about the selection of PCR primers from tuf sequences please refer to Examples 5, 7-14, 17, 22, 24, 28, 30-31, 33, 36, and 38-40, and to Annexes VI-IX, XI-XIX and XXV.

Sequencing of atpD and recA Nucleic Acids and/or Sequences from a Variety of Archaeal, Bacterial, Fungal and Parasitical Species The method used to obtain atpD and recA nucleic acids and/or sequences is similar to that described above for tuf nucleic acids and/or sequences.

The Selection of Amplification Primers from atpD or recA Nucleic Acids and/or Sequences The comparison of the nucleotide sequence for the atpD or recA genes from various archaeal, bacterial, fungal and parasitical species allowed the selection of PCR primers (refer to Examples 6, 13, 29, 34 and 37, and to Annexes IV, V, X, and XX).

DNA Amplification

For DNA amplification by the widely used PCR (polymerase chain reaction) method, primer pairs were derived from proprietary DNA fragments or from database sequences. Prior to synthesis, the potential primer pairs were analyzed by using the Oligo™ 5.0 software to verify that they were good candidates for PCR amplification.

During DNA amplification by PCR, two oligonucleotide primers binding respectively to each strand of the heat-denatured target DNA from the microbial genome are used to amplify exponentially in vitro the target DNA by successive thermal cycles allowing denaturation of the DNA, annealing of the primers and synthesis of new targets at each cycle (Persing et al, 1993, Diagnostic Molecular Microbiology: Principles and Applications, American Society for Microbiology, Washington, D.C.).

Briefly, the PCR protocols were as follows: Treated clinical specimens or standardized bacterial or fungal or parasitical suspensions (see below) or purified genomic DNA from bacteria, fungi or parasites were amplified in a 20 μl PCR reaction mixture. Each PCR reaction contained 50 mM KCl, 10 mM Tris-HCl (pH 9.0), 2.5 mM $MgCl_2$, 0.4 μM of each primer, 200 μM of each of the four dNTPs and 0.5 unit of Taq DNA polymerase (Promega) combined with the TaqStart™ antibody (Clontech Laboratories Inc., Palo Alto, Calif.). The TaqStart™ antibody, which is a neutralizing monoclonal antibody to Taq DNA polymerase, was added to all PCR reactions to enhance the specificity and the sensitivity of the amplifications (Kellogg et al., 1994, Biotechniques 16:1134-1137). The treatment of the clinical specimens varies with the type of specimen tested, since the composition and the sensitivity level required are different for each specimen type. It consists in a rapid protocol to lyse the microbial cells and eliminate or neutralize PCR inhibitors. For amplification from bacterial or fungal or parasitical cultures or from purified genomic DNA, the samples were added directly to the PCR amplification mixture without any pre-treatment step. An internal control was derived from sequences not found in the target microorganisms or in the human genome. The internal control was integrated into all amplification reactions to verify the efficiency of the PCR assays and to ensure that significant PCR inhibition was absent. Alternatively, an internal control derived from rRNA was also useful to monitor the efficiency of microbial lysis protocols.

PCR reactions were then subjected to thermal cycling (3 min at 94-96° C. followed by 30 cycles of 1 second at 95° C. for the denaturation step and 30 seconds at 50-65° C. for the annealing-extension step) using a PTC-200 thermal cycler (MJ Research Inc.). The number of cycles performed for the PCR assays varies according to the sensitivity level required. For example, the sensitivity level required for microbial detection directly from clinical specimens is higher for blood specimens than for urine specimens because the concentration of microorganisms associated with a septicemia can be much lower than that associated with a urinary tract infection. Consequently, more sensitive PCR assays having more thermal cycles are probably required for direct detection from blood specimens. Similarly, PCR assays performed directly from bacterial or fungal or parasitical cultures may be less sensitive than PCR assays performed directly from clinical specimens because the number of target organisms is normally much lower in clinical specimens than in microbial cultures.

The person skilled in the art of DNA amplification knows the existence of other rapid amplification procedures such as ligase chain reaction (LCR), transcription-mediated amplification (TMA), self-sustained sequence replication (3SR), nucleic acid sequence-based amplification (NASBA), strand displacement amplification (SDA), branched DNA (bDNA), cycling probe technology (CPT), solid phase amplification (SPA), rolling circle amplification technology (RCA), solid phase RCA, anchored SDA and nuclease dependent signal amplification (NDSA) (Lee et al., 1997, Nucleic Acid Amplification Technologies: Application to Disease Diagnosis, Eaton Publishing, Boston, Mass.; Persing et al., 1993, Diagnostic Molecular Microbiology: Principles and Applications, American Society for Microbiology, Washington, D.C.; Westin et al., 2000, Nat. Biotechnol. 18:199-204). The scope of this invention is not limited to the use of amplification by PCR, but rather includes the use of any rapid nucleic acid amplification method or any other procedure which may be used to increase the sensitivity and/or the rapidity of nucleic acid-based diagnostic tests. The scope of the present invention also covers the use of any nucleic acids amplification and detection technology including real-time or post-amplification detection technologies, any amplification technology combined with detection, any hybridization nucleic acid chips or arrays technologies, any amplification chips or combination of amplification and hybridization chips technologies. Detection and identification by any sequencing method is also under the scope of the present invention.

Any oligonucleotide suitable for the amplification of nucleic acids by approaches other than PCR or for DNA hybridization which are derived from the species-specific, genus-specific and universal DNA fragments as well as from selected antimicrobial agents resistance or toxin gene sequences included in this document are also under the scope of this invention.

Detection of Amplification Products

Classically, detection of amplification is performed by standard ethidium bromide-stained agarose gel electrophoresis. It is clear that other methods for the detection of specific amplification products, which may be faster and more practical for routine diagnosis, may be used. Such methods may be based on the detection of fluorescence after or during amplification. One simple method for monitoring amplified DNA is to measure its rate of formation by measuring the increase in fluorescence of intercalating agents such as ethidium bromide or SYBR® Green I (Molecular Probes). If more specific detection is required, fluorescence-based technologies can monitor the appearance of a specific product during the reaction. The use of dual-labeled fluorogenic probes such as in the TaqMan™ system (Applied Biosystems) which utilizes the 5'-3' exonuclease activity of the Taq polymerase is a good example (Livak K. J. et al. 1995, PCR Methods Appl. 4:357-362). TaqMan™ can be performed during amplification and this “real-time” detection can be done in a single closed tube hence eliminating post-PCR sample handling and consequently preventing the risk of amplicon carryover. Several other fluorescence-based detection methods can be performed in real-time. Fluorescence resonance energy transfer (FRET) is the principle behind the use of adjacent hybridization probes (Wittwer, C. T. et al. 1997. BioTechniques 22:130-138), molecular beacons (Tyagi S, and Kramer F. R. 1996. Nature Biotechnology 14:303-308) and scorpions (Whitcomb et al. 1999. Nature Biotechnology 17:804-807). Adjacent hybridization probes are designed to be internal to the amplification primers. The 3' end of one probe is labelled with a donor fluorophore while the 5' end of an adjacent probe is labelled with an acceptor fluorophore. When the two probes are specifically hybridized in closed proximity (spaced by 1 to 5 nucleotides) the donor fluorophore which has been excited by an external light source emits light that is absorbed by a second acceptor that emit more fluorescence and yields a FRET signal. Molecular beacons possess a stem-and-loop structure where the loop is the probe and at the bottom of the stem a fluorescent moiety is at one end while a quenching moiety is at the other end. The beacons undergo a fluorogenic conformational change when they hybridize to their targets hence separating the fluorochrome from its quencher. The FRET principle is also used in an air thermal cycler with a built-in fluorometer (Wittwer, C. T. et al. 1997. BioTechniques 22:130-138). The amplification and detection are extremely rapid as reactions are performed in capillaries: it takes only 18 min to complete 45 cycles. Those techniques are suitable especially in the case where few pathogens are searched for. Boehringer-Roche Inc. sells the LightCycler™, and Cepheid makes the SmartCycler. These two apparatus are capable of rapid cycle PCR combined with fluorescent SYBR® Green I or FRET detection. We recently demonstrated in our laboratory, real-time detection of 10 CFU in less than 40 minutes using adjacent hybridization probes on the LightCycler™. Methods based on the detection of fluorescence are particularly promising for utilization in routine diagnosis as they are very rapid, quantitative and can be automated.

Microbial pathogens detection and identification may also be performed by solid support or liquid hybridization using species-specific internal DNA probes hybridizing to an amplification product. Such probes may be generated from any sequence from our repertory and designed to specifically hybridize to DNA amplification products which are objects of the present invention. Alternatively, the internal probes for species or genus or family or group detection and identification may be derived from the amplicons produced by a universal, family-, group-, genus- or species-specific amplification assay(s). The oligonucleotide probes may be labeled with biotin or with digoxigenin or with any other reporter molecule (for more details see below the section on hybrid capture). Hybrization on a solid support is amendable to miniaturization.

At present the oligonucleotide nucleic acid microarray technology is appealing. Currently, available low to medium density arrays (Heller et al., An integrated microelectronics hybridization system for genomic research and diagnostic applications. In: Harrison, D. J., and van den Berg, A., 1998, Micro total analysis systems '98, Kluwer Academic Publisher, Dordrecht.) could specifically capture fluorescent-labelled amplicons. Detection methods for hybridization are not limited to fluorescence; potentiometry, colorimetry and plasmon resonance are some examples of alternative detection methods. In addition to detection by hybridization, nucleic acid microarrays could be used to perform rapid sequencing by hybridization. Mass spectrometry could also be applicable for rapid identification of the amplicon or even for sequencing of the amplification products (Chiu and Cantor, 1999, Clinical Chemistry 45:1578; Berkenkamp et al., 1998, Science 281:260).

For the future of our assay format, we also consider the major challenge of molecular diagnostics tools, i.e.: integration of the major steps including sample preparation, genetic amplification, detection, data analysis and presentation (Anderson et al., Advances in integrated genetic analysis. In: Harrison, D. J., and van den Berg, A., 1998, Micro total analysis systems '98, Kluwer Academic Publisher, Dordrecht.).

To ensure PCR efficiency, glycerol, dimethyl sulfoxide (DMSO) or other related solvents can be used to increase the sensitivity of the PCR and to overcome problems associated with the amplification of a target DNA having a high GC content or forming strong secondary structures (Dieffenbach and Dveksler, 1995, PCR Primer: A Laboratory Manual, Cold Spring Harbor Laboratory Press, Plainview, N.Y.). The concentration ranges for glycerol and DMSO are 5-15% (v/v) and 3-10% (v/v), respectively. For the PCR reaction mixture, the concentration ranges for the amplification primers and $MgCl_2$ are 0.1-1.5 μM and 1.0-10.0 mM, respectively. Modifications of the standard PCR protocol using external and nested primers (i.e. nested PCR) or using more than one primer pair (i.e. multiplex PCR) may also be used (Persing et al., 1993, Diagnostic Molecular Microbiology: Principles and Applications, American Society for Microbiology, Washington, D.C.). For more details about the PCR protocols and amplicon detection methods, see Examples.

Hybrid Capture and Chemiluminescence Detection of Amplification Products

Hybridization and detection of amplicons by chemiluminescence were adapted from Nikiforov et al. (1994, PCR Methods and Applications 3:285-291 and 1995, Anal. Biochem. 227:201-209) and from the DIG™ system protocol of Boehringer Mannheim. Briefly, 50 μl of a 25 picomoles solution of capture probe diluted in EDC {1-ethyl-3-(3-dimethylaminopropyl) carbodiimide hydrochloride} are immobilized in each well of 96-wells plates (Microlite™ 2, Dynex) by incubation overnight at room temperature. The next day, the plates are incubated with a solution of 1% BSA diluted into TNTw (10 mM Tris-HCl, pH 7.5; 150 mM NaCl; 0.05% Tween™ 20) for 1 hour at 37° C. The plates are then washed on a Wellwash Ascent™ (Labsystems) with TNTw followed by Washing Buffer (100 mM maleic acid pH7.5; 150 mM NaCl; 0.3% Tween™ 20).

The amplicons were labelled with DIG-11-dUTP during PCR using the PCR DIG Labelling Mix from Boehringer Mannheim according to the manufacturer's instructions. Hybridization of the amplicons to the capture probes is performed in triplicate at stringent temperature (generally, probes are designed to allow hybrization at 55° C., the stringent temperature) for 30 minutes in 1.5 M NaCl; 10 mM EDTA. It is followed by two washes in 2×SSC; 0.1% SDS, then by four washes in 0.1×SSC; 0.1% SDS at the stringent temperature (55° C.). Detection with 1,2 dioxetane chemiluminescent alkaline phosphatase substrates like CSPD® (Tropix Inc.) is performed according to the manufacturer's instructions but with shorter incubations times and a different antibody concentration. The plates are agitated at each step, the blocking incubation is performed for only 5 minutes, the anti-DIG-AP1 is used at a 1:1000 dilution, the incubation with antibody lasts 15 minutes, the plates are washed twice for only 5 minutes. Finally, after a 2 minutes incubation into the detection buffer, the plates are incubated 5 minutes with CSPD® at room temperature followed by a 10 minutes incubation at 37° C. without agitation. Luminous signal detection is performed on a Dynex Microtiter Plate Luminometer using RLU (Relative Light Units).

Specificity, Ubiquity and Sensitivity Tests for Oligonucleotide Primers and Probes The specificity of oligonucleotide primers and probes was tested by amplification of DNA or by hybridization with bacterial or fungal or parasitical species selected from a panel comprising closely related species and species sharing the same anatomo-pathological site (see Annexes and Examples). All of the bacterial, fungal and parasitical species tested were likely to be pathogens associated with infections or potential contaminants which can be isolated from clinical specimens. Each target DNA could be released from microbial cells using standard chemical and/or physical treatments to lyse the cells (Sambrook et al., 1989, Molecular Cloning: A Laboratory Manual, $2^{nd}$ ed., Cold Spring Harbor Laboratory Press, Cold Spring Harbor, N.Y.) or alternatively, genomic DNA purified with the GNOME™ DNA kit (Bio101, Vista, Calif.) was used. Subsequently, the DNA was subjected to amplification with the primer pairs. Specific primers or probes amplified only the target microbial species, genus, family or group.

Oligonucleotides primers found to amplify specifically the target species, genus, family or group were subsequently tested for their ubiquity by amplification (i.e. ubiquitous primers amplified efficiently most or all isolates of the target species or genus or family or group). Finally, the sensitivity of the primers or probes was determined by using 10-fold or 2-fold dilutions of purified genomic DNA from the targeted microorganism. For most assays, sensitivity levels in the range of 1-100 copies were obtained. The specificity, ubiquity and sensitivity of the PCR assays using the selected amplification primer pairs were tested either directly from cultures of microbial species or from purified microbial genomic DNA.

Probes were tested in hybrid capture assays as described above. An oligonucleotide probe was considered specific only when it hybridized solely to DNA from the species or genus or family or group from which it was selected. Oligonucleotide probes found to be specific were subsequently tested for their ubiquity (i.e. ubiquitous probes detected efficiently most or all isolates of the target species or genus or family or group) by hybridization to microbial DNAs from different clinical isolates of the species or genus or family or group of interest including ATCC reference strains. Similarly, oligonucleotide primers and probes could be derived from antimicrobial agents resistance or toxin genes which are objects of the present invention.

Reference Strains

The reference strains used to build proprietary tuf, atpD and recA sequence data subrepertories, as well as to test the amplification and hybridization assays were obtained from (i) the American Type Culture Collection (ATCC), (ii) the Laboratoire de santé publique du Québec (LSPQ), (iii) the Centers for Disease Control and Prevention (CDC), (iv) the National Culture Type Collection (NCTC) and (v) several other reference laboratories throughout the world. The identity of our reference strains was confirmed by phenotypic testing and reconfirmed by analysis of tuf, atpD and recA sequences (see Example 13).

Antimicrobial Agents Resistance Genes

Antimicrobial resistance complicates treatment and often leads to therapeutic failures. Furthermore, overuse of antibiotics inevitably leads to the emergence of microbial resistance. Our goal is to provide clinicians, in approximately one hour, the needed information to prescribe optimal treatments. Besides the rapid identification of negative clinical specimens with DNA-based tests for universal algal, archaeal, bacterial, fungal or parasitical detection and the identification of the presence of a specific pathogen in the positive specimens with species- and/or genus- and/or family- and/or group-specific DNA-based tests, clinicians also need timely information about the ability of the microbial pathogen to resist antibiotic treatments. We feel that the most efficient strategy to evaluate rapidly microbial resistance to antimicrobials is to detect directly from the clinical specimens the most common and clinically important antimicrobial agents resistance genes (i.e. DNA-based tests for the specific detection of antimicrobial agents resistance genes). Since the sequence from the most important and common antimicrobial agents resistance genes are available from public databases, our strategy is to use the sequence from a portion or from the entire resistance gene to design specific oligonucleotide primers or probes which will be used as a basis for the development of sensitive and rapid DNA-based tests. The list of each of the antimicrobial agents resistance genes selected on the basis of their clinical relevance (i.e. high incidence and importance) is given in Table 5; descriptions of the designed amplification primers and internal probes are given in Annexes XXXIV-XXXVII, XXXIX, XLV, and L-LI. Our approach is unique because the antimicrobial agents resistance genes detection and the microbial detection and identification can be performed simultaneously, or independently, or sequentially in multiplex or parallel or sequential assays under uniform PCR amplification conditions. These amplifications can also be done separately.

Toxin Genes

Toxin identification is often very important to prescribe optimal treatments. Besides the rapid identification of negative clinical specimens with DNA-based tests for universal bacterial detection and the identification of the presence of a specific pathogen in the positive specimens with species- and/or genus- and/or family- and/or group-specific DNA-based tests, clinicians sometimes need timely information about the ability of certain bacterial pathogens to produce toxins. Since the sequence from the most important and common bacterial toxin genes are available from public databases, our strategy is to use the sequence from a portion or from the entire toxin gene to design specific oligonucleotide primers or probes which will be used as a basis for the development of sensitive and rapid DNA-based tests. The list of each of the bacterial toxin genes selected on the basis of their clinical relevance (i.e. high incidence and importance) is given in Table 6; descriptions of the designed amplification primers and internal probes are given in Annexes XXII, XXXII and XXXIII. Our approach is unique because the toxin genes detection and the bacterial detection and identification can be performed simultaneously, or independently, or sequentially, in multiplex or parallel or sequential assays under uniform PCR amplification conditions. These amplifications can also be done separately.

Universal Bacterial Detection

In the routine microbiology laboratory, a high percentage of clinical specimens sent for bacterial identification are negative by culture. Testing clinical samples with universal amplification primers or universal probes to detect the presence of bacteria prior to specific identification and screening out the numerous negative specimens is thus useful as it reduces costs and may rapidly orient the clinical management of the patients. Several amplification primers and probes were therefore synthesized from highly conserved portions of bacterial sequences from the tuf, atpD and recA nucleic acids and/or sequences. The universal primers selection was based on a multiple sequence alignment constructed with sequences from our repertory.

All computer analysis of amino acid and nucleotide sequences were performed by using the GCG programs. Subsequently, optimal PCR primers for the universal amplification of bacteria were selected with the help of the Oligo™ program. The selected primers are degenerated at several nucleotide positions and contain several inosines in order to allow the amplification of all clinically relevant bacterial species. Inosine is a nucleotide analog able to specifically bind to any of the four nucleotides A, C, G or T. Degenerated oligonucleotides consist of an oligonucleotide mix having two or more of the four nucleotides A, C, G or T at the site of mismatches. The inclusion of inosine and/or of base ambiguities in the amplification primers allow mismatch tolerance thereby permitting the amplification of a wider array of target nucleotide sequences (Dieffenbach and Dveksler, 1995 PCR Primer: A Laboratory Manual, Cold Spring Harbor Laboratory Press, Plainview, N.Y.).

The amplification conditions with the universal primers are very similar to those used for the species- and genus-specific amplification assays except that the annealing temperature is slightly lower. The original universal PCR assay described in our assigned WO98/20157 (SEQ ID NOs. 23-24 of the latter application) was specific and nearly ubiquitous for the detection of bacteria. The specificity for bacteria was verified by amplifying genomic DNA isolated from the 12 fungal species as well as genomic DNA from *Leishmania donovani, Saccharomyces cerevisiae* and human lymphocytes. None of the above eukaryotic DNA preparations could be amplified by the universal assay, thereby suggesting that this test is specific for bacteria. The ubiquity of the universal assay was verified by amplifying genomic DNAs from 116 reference strains which represent 95 of the most clinically relevant bacterial species. These species have been selected from the bacterial species listed in Table 4. We found that at least 104 of these strains could be amplified. However, the assay could be improved since bacterial species which could not be amplified with the original tuf nucleic acids and/or sequences-based assay included species belonging to the following genera: *Corynebacterium* (11 species) and *Stenotrophomonas* (1 species). Sequencing of the tuf genes from these bacterial species and others has been performed in the scope of the present invention in order to improve the universal assay. This sequencing data has been used to select new universal primers which may be more ubiquitous and more sensitive. Also, we improved our primer and probes design strategy by taking into consideration the phylogeny observed in analysing our repertory of tuf, atpD and recA sequences. Data from each of the 3 main subrepertories (tuf, atpD and recA) was subjected to a basic phylogenic analysis using the Pileup command from version 10 of the GCG package (Genetics Computer Group, inc.). This analysis indicated the main branches or phyla reflecting the relationships between sequences. Instead of trying to design primers or probes able to hybridize to all phyla, we designed primers or probes able to hybridize to the main phyla while trying to use the largest phylum possible. This strategy should allow less degenerated primers hence improving sensitivity and by combining primers in a mutiplex assay, improve ubiquity. Universal primers SEQ ID NOs. 643-645 based on tuf sequences have been designed to amplify most pathogenic bacteria except Actinomyceteae, Clostridiaceae and the Cytophaga, Flexibacter and Bacteroides phylum (pathogenic bacteria of this phylum include mostly *Bacteroides, Porphyromonas* and *Prevotella* species). Primers to fill these gaps have been designed for Actinomyceteae (SEQ ID NOs. 646-648), Clostridiaceae (SEQ ID NOs. 796-797, 808-811), and the Cytophaga, Flexibacter and Bacteroides phylum (SEQ ID NOs. 649-651), also derived from tuf nucleic acids and/or sequences. These primers sets could be used alone or in conjunction to render the universal assay more ubiquitous.

Universal primers derived from atpD sequences include SEQ ID NOs. 562-565. Combination of these primers does not amplify human DNA but should amplify almost all pathogenic bacterial species except proteobacteria belonging to the epsilon subdivision (Campylobacter and Helicobacter), the bacteria from the Cytophaga, Flexibacter and Bacteroides group and some actinomycetes and *corynebacteria*. By analysing atpD sequences from the latter species, primers and probes to specifically fill these gaps could be designed and used in conjunction with primers SEQ ID NOs. 562-565, also derived from atpD nucleic acids and/or sequences.

In addition, universality of the assay could be expanded by mixing atpD sequences-derived primers with tuf sequences-derived primers. Ultimately, even recA sequences-derived primers could be added to fill some gaps in the universal assay.

It is important to note that the 95 bacterial species selected to test the ubiquity of the universal assay include all of the most clinically relevant bacterial species associated with a variety of human infections acquired in the community or in hospitals (nosocomial infections). The most clinically important bacterial and fungal pathogens are listed in Tables 1 and 2.

Amino Acid Sequences Derived from tuf, atpD and recA Nucleic Acids and/or Sequences The amino acid sequences translated from the repertory of tuf, atpD and recA nucleic acids and/or sequences are also an object of the present invention. The amino acid sequence data will be particularly useful for homology modeling of three-dimensional (3D) structure of the elongation factor Tu, elongation factor G, elongation factor 1a, ATPase subunit beta and RecA recombinase. For all these proteins, at least one structure model has been published using X-ray diffraction data from crystals. Based on those structural informations it is possible to use computer software to build 3D model structures for any other protein having peptide sequence homologies with the known structure (Greer, 1991, Methods in Enzymology, 202:239-252; Taylor, 1994, Trends Biotechnol., 12(5):154-158; SalI, 1995, Curr. Opin. Biotechnol. 6:437-451; Sanchez and Sali, 1997, Curr. Opin. Struct. Biol. 7:206-214; Fischer and Eisenberg, 1999, Curr. Opin. Struct. Biol. 9:208-211; Guex et al., 1999, Trends Biochem. Sci. 24: 364-367). Model structures of target proteins are used for the design or to predict the behavior of ligands and inhibitors such as antibiotics. Since EF-Tu and EF-G are already known as antibiotic targets (see above) and since the beta subunit of ATPase and RecA recombinase are essential to the survival of the microbial cells in natural conditions of infection, all four proteins could be considered antibiotic targets. Sequence data, especially the new data generated by us could be very useful to assist the creation of new antibiotic molecules with desired spectrum of activity. In addition, model structures could be used to improve protein function for commercial purposes such as improving antibiotic production by microbial strains or increasing biomass.

The following detailed embodiments and appended drawings are provided as illustrative examples of his invention, with no intention to limit the scope thereof.

EXAMPLES AND ANNEXES

For sake of clarity, here is a list of Examples and Annexes:

Example 1: Sequencing of bacterial atpD (F-type and V-type) gene fragments.

Example 2: Sequencing of eukaryotic atpD (F-type and V-type) gene fragments.

Example 3: Sequencing of eukaryotic tuf (EF-1) gene fragments.

Example 4: Sequencing of eukaryotic tuf (organelle origin, M) gene fragments.

Example 5: Specific detection and identification of *Streptococcus agalactiae* using tuf sequences.

Example 6: Specific detection and identification of *Streptococcus agalactiae* using atpD sequences.

Example 7: Development of a PCR assay for detection and identification of staphylococci at genus and species levels.

Example 8: Differentiating between the two closely related yeast species *Candida albicans* and *Candida dubliniensis*.

Example 9: Specific detection and identification of *Entamoeba histolytica*.

Example 10: Sensitive detection and identification of *Chlamydia trachomatis*.

Example 11: Genus-specific detection and identification of enterococci.

Example 12: Detection and identification of the major bacterial platelets contaminants using tuf sequences with a multiplex PCR test.

Example 13: The resolving power of the tuf and atpD sequences databases is comparable to the biochemical methods for bacterial identification.

Example 14: Detection of group B streptococci from clinical specimens.

Example 15: Simultaneous detection and identification of *Streptococcus pyogenes* and its pyrogenic exotoxin A.

Example 16: Real-time detection and identification of Shiga toxin-producing bacteria.

Example 17: Development of a PCR assay for the detection and identification of staphylococci at genus and species levels and its associated mecA gene.

Example 18: Sequencing of pbp1a, pbp2b and pbp2x genes of *Streptococcus pneumoniae*.

Example 19: Sequencing of hexA genes of *Streptococcus* species.

Example 20: Development of a multiplex PCR assay for the detection of *Streptococcus pneumoniae* and its penicillin resistance genes.

Example 21: Sequencing of the vancomycin resistance vanA, vanC1, vanC2 and vanC3 genes.

Example 22: Development of a PCR assay for the detection and identification of enterococci at genus and species levels and its associated resistance genes vanA and vanB.

Example 23: Development of a multiplex PCR assay for detection and identification of vancomycin-resistant *Enterococcus faecalis, Enterococcus faecium, Enterococcus gallinarum, Enterococcus casseliflavus*, and *Enterococcus flavescens*.

Example 24: Universal amplification involving the EF-G (fusA) subdivision of tuf sequences.

Example 25: DNA fragment isolation from *Staphylococcus saprophyticus* by arbitrarily primed PCR.

Example 26: Sequencing of prokaryotic tuf gene fragments.

Example 27: Sequencing of procaryotic recA gene fragments.

Example 28: Specific detection and identification of *Escherichia coli/Shigella* sp. using tuf sequences.

Example 29: Specific detection and identification of *Klebsiella pneumoniae* using atpD sequences.

Example 30: Specific detection and identification of *Acinetobacter baumanii* using tuf sequences.

Example 31: Specific detection and identification of *Neisseria gonorrhoeae* using tuf sequences.

Example 32: Sequencing of bacterial gyrA and parC gene fragments.

Example 33: Development of a PCR assay for the specific detection and identification of *Staphylococcus aureus* and its quinolone resistance genes gyrA and parC.

Example 34: Development of a PCR assay for the detection and identification of *Klebsiella pneumoniae* and its quinolone resistance genes gyrA and parC.

Example 35: Development of a PCR assay for the detection and identification of *Streptococcus pneumoniae* and its quinolone resistance genes gyrA and parC.

Example 36: Detection of extended-spectrum TEM-type β-lactamases in *Escherichia coli.*

Example 37: Detection of extended-spectrum SHV-type β-lactamases in *Klebsiella pneumoniae.*

Example 38: Development of a PCR assay for the detection and identification of *Neisseria gonorrhoeae* and its associated tetracycline resistance gene tetM.

Example 39: Development of a PCR assay for the detection and identification of *Shigella* sp. and their associated trimethoprim resistance gene dhfr1a.

Example 40: Development of a PCR assay for the detection and identification of *Acinetobacter baumanii* and its associated aminoglycoside resistance gene aph(3')-VIa.

Example 41: Specific detection and identification of *Bacteroides fragilis* using atpD (V-type) sequences.

Example 42: Evidence for horizontal gene transfer in the evolution of the elongation factor Tu in Enterococci.

Example 43: Elongation factor Tu (tuf) and the F-ATPase beta-subunit (atpD) as phylogenetic tools for species of the family Enterobacteriaceae.

Example 44: Testing new pairs of PCR primers selected from two species-specific genomic DNA fragments which are objects of U.S. Pat. No. 6,001,564.

Example 45: Testing modified versions of PCR primers derived from the sequence of several primers which are objects of U.S. Pat. No. 6,001,564.

The various Annexes show the strategies used for the selection of a variety of DNA amplification primers, nucleic acid hybridization probes and molecular beacon internal probes:

(i) Annex I shows the amplification primers used for nucleic acid amplification from tuf sequences.

(ii) Annex II shows the amplification primers used for nucleic acid amplification from atpD sequences.

(iii) Annex III shows the internal hybridization probes for detection of tuf sequences.

(iv) Annex IV illustrates the strategy used for the selection of the amplification primers specific for atpD sequences of the F-type.

(v) Annex V illustrates the strategy used for the selection of the amplification primers specific for atpD sequences of the V-type.

(vi) Annex VI illustrates the strategy used for the selection of the amplification primers specific for the tuf sequences of organelle lineage (M, the letter M is used to indicate that in most cases, the organelle is the mitochondria).

(vii) Annex VII illustrates the strategy used for the selection of the amplification primers specific for the tuf sequences of eukaryotes (EF-1).

(viii) Annex VIII illustrates the strategy for the selection of *Streptococcus agalactiae*-specific amplification primers from tuf sequences.

(ix) Annex IX illustrates the strategy for the selection of *Streptococcus agalactiae*-specific hybridization probes from tuf sequences.

(x) Annex X illustrates the strategy for the selection of *Streptococcus agalactiae*-specific amplification primers from atpD sequences.

(xi) Annex XI illustrates the strategy for the selection from tuf sequences of *Candida albicans/dubliniensis*-specific amplification primers, *Candida albicans*-specific hybridization probe and *Candida dubliniensis*-specific hybridization probe.

(xii) Annex XII illustrates the strategy for the selection of *Staphylococcus*-specific amplification primers from tuf sequences.

(xiii) Annex XIII illustrates the strategy for the selection of the *Staphylococcus*-specific hybridization probe from tuf sequences.

(xiv) Annex XIV illustrates the strategy for the selection of *Staphylococcus saprophyticus*-specific and *Staphylococcus haemolyticus*-specific hybridization probes from tuf sequences.

(xv) Annex XV illustrates the strategy for the selection of *Staphylococcus aureus*-specific and *Staphylococcus epidermidis*-specific hybridization probes from tuf sequences.

(xvi) Annex XVI illustrates the strategy for the selection of the *Staphylococcus hominis*-specific hybridization probe from tuf sequences.

(xvii) Annex XVII illustrates the strategy for the selection of the *Enterococcus*-specific amplification primers from tuf sequences.

(xviii) Annex XVIII illustrates the strategy for the selection of the *Enterococcus faecalis*-specific hybridization probe, of the *Enterococcus faecium*-specific hybridization probe and of the *Enterococcus casseliflavus-flavescens-gallinarum* group-specific hybridization probe from tuf sequences.

(xix) Annex XIX illustrates the strategy for the selection of primers from tuf sequences for the identification of platelets contaminants.

(xx) Annex XX illustrates the strategy for the selection of the universal amplification primers from atpD sequences.

(xxi) Annex XXI shows the amplification primers used for nucleic acid amplification from recA sequences.

(xxii) Annex XXII shows the specific and ubiquitous primers for nucleic acid amplification from speA sequences.

(xxiii) Annex XXIII illustrates the first strategy for the selection of *Streptococcus pyogenes*-specific amplification primers from speA sequences.

(xxiv) Annex XXIV illustrates the second strategy for the selection of *Streptococcus pyogenes*-specific amplification primers from speA sequences.

(xxv) Annex XXV illustrates the strategy for the selection of *Streptococcus pyogenes*-specific amplification primers from tuf sequences.

(xxvi) Annex XXVI illustrates the strategy for the selection of $stx_1$-specific amplification primers and hybridization probe.

(xxvii) Annex XXVII illustrates the strategy for the selection of $stx_2$-specific amplification primers and hybridization probe.

(xxviii) Annex XXVIII illustrates the strategy for the selection of vanA-specific amplification primers from van sequences.

(xxix) Annex XXIX illustrates the strategy for the selection of vanB-specific amplification primers from van sequences.

(xxx) Annex XXX illustrates the strategy for the selection of vanC-specific amplification primers from vanC sequences.

(xxxi) Annex XXXI illustrates the strategy for the selection of *Streptococcus pneumoniae*-specific amplification primers and hybridization probes from pbp1a sequences.

(xxxii) Annex XXXII shows the specific and ubiquitous primers for nucleic acid amplification from toxin gene sequences.

(xxxiii) Annex XXXIII shows the molecular beacon internal hybridization probes for specific detection of toxin sequences.

(xxxiv) Annex XXXIV shows the specific and ubiquitous primers for nucleic acid amplification from van sequences.

(xxxv) Annex XXXV shows the internal hybridization probes for specific detection of van sequences.

(xxxvi) Annex XXXVI shows the specific and ubiquitous primers for nucleic acid amplification from pbp sequences.

(xxxvii) Annex XXXVII shows the internal hybridization probes for specific detection of pbp sequences.

(xxxviii) Annex XXXVIII illustrates the strategy for the selection of vanAB-specific amplification primers and vanA- and vanB-specific hybridization probes from van sequences.

(xxxix) Annex XXXIX shows the internal hybridization probe for specific detection of mecA.

(xl) Annex XL shows the specific and ubiquitous primers for nucleic acid amplification from hexA sequences.

(xli) Annex XLI shows the internal hybridization probe for specific detection of hexA.

(xlii) Annex XLII illustrates the strategy for the selection of *Streptococcus pneumoniae* species-specific amplification primers and hybridization probe from hexA sequences.

(xliii) Annex XLIII shows the specific and ubiquitous primers for nucleic acid amplification from pcp sequences.

(xliv) Annex XLIV shows specific and ubiquitous primers for nucleic acid amplification of *S. saprophyticus* sequences of unknown coding potential.

(xlv) Annex XLV shows the molecular beacon internal hybridization probes for specific detection of antimicrobial agents resistance gene sequences.

(xlvi) Annex XLVI shows the molecular beacon internal hybridization probe for specific detection of *S. aureus* gene sequences of unknown coding potential.

(xlvii) Annex XLVII shows the molecular beacon hybridization internal probe for specific detection of tuf sequences.

(xlviii) Annex XLVIII shows the molecular beacon internal hybridization probes for specific detection of ddl and mtl sequences.

(xlix) Annex XLIX shows the internal hybridization probe for specific detection of *S. aureus* sequences of unknown coding potential.

(l) Annex L shows the amplification primers used for nucleic acid amplification from antimicrobial agents resistance genes sequences.

(li) Annex LI shows the internal hybridization probes for specific detection of antimicrobial agents resistance genes sequences.

(lii) Annex LII shows the molecular beacon internal hybridization probes for specific detection of atpD sequences.

(liii) Annex LIII shows the internal hybridization probes for specific detection of atpD sequences.

(liv) Annex LIVI shows the internal hybridization probes for specific detection of ddl and mtl sequences.

As shown in these Annexes, the selected amplification primers may contain inosines and/or base ambiguities. Inosine is a nucleotide analog able to specifically bind to any of the four nucleotides A, C, G or T. Alternatively, degenerated oligonucleotides which consist of an oligonucleotide mix having two or more of the four nucleotides A, C, G or T at the site of mismatches were used. The inclusion of inosine and/or of degeneracies in the amplification primers allows mismatch tolerance thereby permitting the amplification of a wider array of target nucleotide sequences (Dieffenbach and Dveksler, 1995 PCR Primer: A Laboratory Manual, Cold Spring Harbor Laboratory Press, Plainview, N.Y.).

EXAMPLES

Example 1

Sequencing of Bacterial atpD (F-Type and V-Type) Gene Fragments

As shown in Annex IV, the comparison of publicly available atpD (F-type) sequences from a variety of bacterial species revealed conserved regions allowing the design of PCR primers able to amplify atpD sequences (F-type) from a wide range of bacterial species. Using primers pairs SEQ ID NOs. 566 and 567, 566 and 814, 568 and 567, 570 and 567, 572 and 567, 569 and 567, 571 and 567, 700 and 567, it was possible to amplify and sequence atpD sequences SEQ ID NOs. 242-270, 272-398, 673-674, 737-767, 866-867, 942-955, 1245-1254, 1256-1265, 1527, 1576, 1577, 1600-1604, 1640-1646, 1649, 1652, 1655, 1657, 1659-1660, 1671, 1844-1845, and 1849-1865.

Similarly, Annex V shows the strategy to design the PCR primers able to amplify atpD sequences of the V-type from a wide range of archaeal and bacterial species. Using primers SEQ ID NOs. 681-683, it was possible to amplify and sequence atpD sequences SEQ ID NOs. 827-832, 929-931, 958 and 966. As the gene was difficult to amplify for several species, additional amplification primers were designed inside the original amplicon (SEQ ID NOs. 1203-1207) in order to obtain sequence information for these species. Other primers (SEQ ID NO. 1212, 1213, 2282-2285) were also designed to amplify regions of the atpD gene (V-type) in archaebacteria.

Example 2

Sequencing of Eukaryotic atpD (F-Type and V-Type) Gene Fragments

The comparison of publicly available atpD (F-type) sequences from a variety of fungal and parasitical species revealed conserved regions allowing the design of PCR primers able to amplify atpD sequences from a wide range of fungal and parasitical species. Using primers pairs SEQ ID NOs. 568 and 573, 574 and 573, 574 and 708, and 566 and 567, it was possible to amplify and sequence atpD sequences SEQ ID NOs. 458-497, 530-538, 663, 667, 676, 678-680, 768-778, 856-862, 889-896, 941, 1638-1639, 1647, 1650-1651, 1653-1654, 1656, 1658, 1684, 1846-1848, and 2189-2192.

In the same manner, the primers described in Annex V (SEQ ID NOs. 681-683) could amplify the atpD (V-type) gene from various fungal and parasitical species. This strategy allowed to obtain SEQ ID NOs. 834-839, 956-957, and 959-965.

Example 3

Sequencing of Eukaryotic tuf (EF-1) Gene Fragments

As shown in Annex VII, the comparison of publicly available tuf (EF-1) sequences from a variety of fungal and parasitical species revealed conserved regions allowing the design of PCR primers able to amplify tuf sequences from a wide range of fungal and parasitical species. Using primers pairs SEQ ID NOs. 558 and 559, 813 and 559, 558 and 815, 560 and 559, 653 and 559, 558 and 655, and 654 and 559, 1999 and 2000, 2001 and 2003, 2002 and 2003, it was possible to amplify and sequence tuf sequences SEQ ID NOs. 399-457, 509-529, 622-624, 677, 779-790, 840-842, 865, 897-903, 1266-1287, 1561-1571 and 1685.

Example 4

Sequencing of Eukaryotic tuf (Organelle Origin, M) Gene Fragments

As shown in Annex VI, the comparison of publicly available tuf (organelle origin, M) sequences from a variety of fungal and parasitical organelles revealed conserved regions allowing the design of PCR primers able to amplify tuf sequences of several organelles belonging to a wide range fungal and parasitical species. Using primers pairs SEQ ID NOs. 664 and 652, 664 and 561, 911 and 914, 912 and 914, 913 and 915, 916 and 561, 664 and 917, it was possible to amplify and sequence tuf sequences SEQ ID NOs. 498-508, 791-792, 843-855, 904-910, 1664, 1666-1667, 1669-1670, 1673-1683, 1686-1689, 1874-1876, 1879, 1956-1960, and 2193-2199.

Example 5

Specific Detection and Identification of *Streptococcus agalactiae* Using tuf Sequences As shown in Annex VIII, the comparison of tuf sequences from a variety of bacterial species allowed the selection of PCR primers specific for *S. agalactiae*. The strategy used to design the PCR primers was based on the analysis of a multiple sequence alignment of various tuf sequences. The multiple sequence alignment includes the tuf sequences of four bacterial strains from the target species as well as tuf sequences from other species and bacterial genera, especially representatives of closely related species. A careful analysis of this alignment allowed the selection of oligonucleotide sequences which are conserved within the target species but which discriminate sequences from other species and genera, especially from the closely related species, thereby permitting the species-specific, ubiquitous and sensitive detection and identification of the target bacterial species.

The chosen primer pair, oligos SEQ ID NO. 549 and SEQ ID NO. 550, gives an amplification product of 252 bp. Standard PCR was carried out using 0.4 μM of each primer, 2.5 mM $MgCl_2$, BSA 0.05 mM, 1× Taq Buffer (Promega), dNTP 0.2 mM (Pharmacia), 0.5 U Taq DNA polymerase (Promega) coupled with TaqStart™ antibody (Clontech Laboratories Inc., Palo Alto), 1 μl of genomic DNA sample in a final volume of 20 μl using a PTC-200 thermocycler (MJ Research Inc.). The optimal cycling conditions for maximum sensitivity and specificity were 3 minutes at 95° C. for initial denaturation, then forty cycles of two steps consisting of 1 second at 95° C. and 30 seconds at 62° C., followed by terminal extension at 72° C. for 2 minutes. Detection of the PCR products was made by electrophoresis in agarose gels (2%) containing 0.25 μg/ml of ethidium bromide.

Specificity of the assay was tested by adding into the PCR reactions, 0.1 ng of genomic DNA from each of the bacterial species listed in Table 8. Efficient amplification was observed only for the 5 *S. agalactiae* strains listed. Of the other bacterial species, including 32 species representative of the vaginal flora and 27 other streptococcal species, only *S. acidominimus* yielded amplification. The signal with 0.1 ng of *S. acidominimus* genomic DNA was weak and the detection limit for this species was 10 pg (corresponding to more than 4000 genome copies) while the detection limit for *S. agalactiae* was 2.5 fg (corresponding to one genome copy) of genomic DNA.

To increase the specificity of the assay, internal probes were designed for FRET (Fluorescence Resonance Energy Transfer) detection using the LightCycler™ (Idaho Technology). As illustrated in Annex IX, a multiple sequence alignment of streptococcal tuf sequence fragments corresponding to the 252 bp region amplified by primers SEQ ID NO. 549 and SEQ ID NO. 550, was used for the design of internal probes TSagHF436 (SEQ ID NO. 582) and TSagHF465 (SEQ ID NO. 583). The region of the amplicon selected for internal probes contained sequences unique and specific to *S. agalactiae*. SEQ ID NO. 583, the more specific probe, is labelled with fluorescein in 3', while SEQ ID NO. 582, the less discriminant probe, is labelled with CY5 in 5' and blocked in 3' with a phosphate group. However, since the FRET signal is only emitted if both probes are adjacently hybridized on the same target amplicon, detection is highly specific.

Real-time detection of PCR products using the LightCycler™ was carried out using 0.4 μM of each primer (SEQ ID NO. 549-550), 0.2 μM of each probe (SEQ ID NO. 582-583), 2.5 mM $MgCl_2$, BSA 450 μg/ml, 1× PC2 Buffer (AB Peptides, St-Louis, Mo.), dNTP 0.2 mM (Pharmacia), 0.5 U KlenTaq1™ DNA polymerase (AB Peptides) coupled with TaqStart™ antibody (Clontech Laboratories Inc., Palo Alto), 0.7 μl of genomic DNA sample in a final volume of 7 μl using a LightCycler thermocycler (Idaho Technology). The optimal cycling conditions for maximum sensitivity and specificity were 3 minutes at 94° C. for initial denaturation, then forty cycles of three steps consisting of 0 second (this setting meaning the LightCycler will reach the target temperature and stay at it for its minimal amount of time) at 94° C., 10 seconds at 64° C., 20 seconds at 72° C. Amplification was monitored during each annealing steps using the fluorescence ratio. The streptococcal species having close sequence homologies with the tuf sequence of *S. agalactiae* (*S. acidominimus, S. anginosus, S. Bovis, S. dysgalactiae, S. equi, S. ferus, S. gordonii, S. intermedius, S. parasanguis, S. parauberis, S. salivarius, S.*

*sanguis, S. suis*) as well as *S. agalactiae* were tested in the LightCycler with 0.07 ng of genomic DNA per reaction. Only *S. agalactiae* yielded an amplification signal, hence demonstrating that the assay is species-specific. With the LightCycler™ assay using the internal FRET probes, the detection limit for *S. agalactiae* was 1-2 genome copies of genomic DNA.

Example 6

Specific Detection and Identification of *Streptococcus agalactiae* Using atpD Sequences As shown in Annex X, the comparison of atpD sequences from a variety of bacterial species allowed the selection of PCR primers specific for *S. agalactiae*. The primer design strategy is similar to the strategy described in the preceding Example except that atpD sequences were used in the alignment.

Four primers were selected, ASag42 (SEQ ID NO. 627), ASag52 (SEQ ID NO. 628), ASag206 (SEQ ID NO. 625) and ASag371 (SEQ ID NO. 626). The following combinations of these four primers give four amplicons; SEQ ID NO. 627+SEQ ID NO. 625=190 bp, SEQ ID NO. 628+SEQ ID NO. 625=180 bp, SEQ ID NO. 627+SEQ ID NO. 626=355 bp, and SEQ ID NO. 628+SEQ ID NO. 626=345 bp.

Standard PCR was carried out on PTC-200 thermocyclers (MJ Research Inc) using 0.4 μM of each primers pair, 2.5 mM $MgCl_2$, BSA 0.05 mM, 1× taq Buffer (Promega), dNTP 0.2 mM (Pharmacia), 0.5 U Taq DNA polymerase (Promega) coupled with TaqStart™ antibody (Clontech Laboratories Inc., Palo Alto), 1 μl of genomic DNA sample in a final volume of 20 μL. The optimal cycling conditions for maximum sensitivity and specificity were adjusted for each primer pair. Three minutes at 95° C. for initial denaturation, then forty cycles of two steps consisting of 1 second at 95° C. and 30 seconds at the optimal annealing temperature specified below were followed by terminal extension at 72° C. for 2 minutes. Detection of the PCR products was made by electrophoresis in agarose gels (2%) containing 0.25 μg/ml of ethidium bromide. Since atpD sequences are relatively more specific than tuf sequences, only the most closely related species namely, the steptococcal species listed in Table 9, were tested.

All four primer pairs only amplified the six *S. agalactiae* strains. With an annealing temperature of 63° C., the primer pair SEQ ID NO. 627+SEQ ID NO. 625 had a sensitivity of 1-5 fg (equivalent to 1-2 genome copies). At 55° C., the primer pair SEQ ID NO. 628+SEQ ID NO. 625 had a sensitivity of 2.5 fg (equivalent to 1 genome copy). At 60° C., the primer pair SEQ ID NO. 627+SEQ ID NO. 626 had a sensitivity of 10 fg (equivalent to 4 genome copies). At 58° C., the primer pair SEQ ID NO. 628+SEQ ID NO. 626 had a sensitivity of 2.5-5 fg (equivalent to 1-2 genome copies). This proves that all four primer pairs can detect *S. agalactiae* with high specificity and sensitivity. Together with Example 5, this example demonstrates that both tuf and atpD sequences are suitable and flexible targets for the identification of microorganisms at the species level. The fact that 4 different primer pairs based on atpD sequences led to efficient and specific amplification of *S. agalactiae* demonstrates that the challenge is to find target genes suitable for diagnostic purposes, rather than finding primer pairs from these target sequences.

Example 7

Development of a PCR Assay for Detection and Identification of Staphylococci at Genus and Species Levels Materials and Methods Bacterial Strains.

The specificity of the PCR assay was verified by using a panel of ATCC (America Type Culture Collection) and DSMZ (Deutsche Sammlung von Mikroorganismen and Zellkulturen GmbH; German Collection of Microorganisms and Cell Cultures) reference strains consisting of 33 gram-negative and 47 gram-positive bacterial species (Table 12). In addition, 295 clinical isolates representing 11 different species of staphylococci from the microbiology laboratory of the Centre Hospitalier Universitaire de Québec, Pavillon Centre Hospitalier de l'Université Laval (CHUL) (Step-Foy, Québec, Canada) were also tested to further validate the *Staphylococcus*-specific PCR assay. These strains were all identified by using (i) conventional methods or (ii) the automated MicroScan Autoscan-4 system equipped with the Positive BP Combo Panel Type 6 (Dade Diagnostics, Mississauga, Ontario, Canada). Bacterial strains from frozen stocks kept at −80° C. in brain heart infusion (BHI) broth containing 10% glycerol were cultured on sheep blood agar or in BHI broth (Quelab Laboratories Inc, Montréal, Québec, Canada).

PCR Primers and Internal Probes.

Based on multiple sequence alignments, regions of the tuf gene unique to staphylococci were identified. *Staphylococcus*-specific PCR primers TStaG422 (SEQ ID NO. 553) and TStaG765 (SEQ ID NO. 575) were derived from these regions (Annex XII). These PCR primers are displaced by two nucleotide positions compared to original *Staphylococcus*-specific PCR primers described in our patent publication WO98/20157 (SEQ ID NOs. 17 and 20 in the said patent publication). These modifications were done to ensure specificity and ubiquity of the primer pair, in the light of new tuf sequence data revealed in the present patent application for several additional staphylococcal species and strains.

Similarly, sequence alignment analysis were performed to design genus and species-specific internal probes (see Annexes XIII to XVI). Two internal probes specific for *Staphylococcus* (SEQ ID NOs. 605-606), five specific for *S. aureus* (SEQ ID NOs. 584-588), five specific for *S. epidermidis* (SEQ ID NO. 589-593), two specific for *S. haemolyticus* (SEQ ID NOs. 594-595), three specific for *S. hominis* (SEQ ID NOs. 596-598), four specific for *S. saprophyticus* (SEQ ID NOs. 599-601 and 695), and two specific for coagulase-negative *Staphylococcus* species including *S. epidermidis, S. hominis, S. saprophyticus, S. auricularis, S. capitis, S. haemolyticus, S. lugdunensis, S. simulans, S. cohnii* and *S. warneri* (SEQ ID NOs. 1175-1176) were designed. The range of mismatches between the *Staphylococcus*-specific 371-bp amplicon and each of the 20-mer species-specific internal probes was from 1 to 5, in the middle of the probe when possible. No mismatches were present in the two *Staphylococcus*-specific probes for the 11 species analyzed: *S. aureus, S. auricularis, S. capitis, S. cohnii, S. epidermidis, S. haemolyticus, S. hominis, S. lugdunensis, S. saprophyticus, S. simulans* and *S. warneri*. In order to verify the intra-specific sequence conservation of the nucleotide sequence, sequences were obtained for the 371-bp amplicon from five unrelated ATCC and clinical strains for each of the species *S. aureus, S. epidermidis, S. haemolyticus, S. hominis* and *S. saprophyticus*. The Oligo™ (version 5.0) primer analysis software (National Biosciences, Plymouth, Minn.) was used to confirm the absence of self-complementary regions within and between the primers or probes. When required, the primers contained inosines or degenerated nucleotides at one or more variable positions. Oligonucleotide primers and probes were synthesized on a model 394 DNA synthesizer (Applied Biosystems, Mississauga, Ontario, Canada). Detection of the hybridization was performed with the DIG-labeled dUTP incorporated during amplification with the *Staphylococcus*-specific PCR assay, and the hybridization signal was detected with a luminometer (Dynex Technologies) as described above in the section on luminescent detection of amplification products. Annexes XIII to XVI illustrate the strategy for the selection of several internal probes.

PCR Amplification.

For all bacterial species, amplification was performed from purified genomic DNA or from a bacterial suspension whose turbidity was adjusted to that of a 0.5 McFarland standard, which corresponds to approximately $1.5\times10^8$ bacteria per ml. One nanogram of genomic DNA or 1 □l of the standardized bacterial suspension was transferred directly to a 19 □l PCR mixture. Each PCR reaction contained 50 mM KCl, 10 mM Tris-HCl (pH 9.0), 0.1% Triton X-100, 2.5 mM $MgCl_2$, 0.20 □M (each) of the two *Staphylococcus* genus-specific primers (SEQ ID NOs. 553 and 575), 200 □M (each) of the four deoxynucleoside triphosphates (Pharmacia Biotech), 3.3 □g/□l bovine serum albumin (BSA) (Sigma-Aldrich Canada Ltd, Oakville, Ontario, Canada), and 0.5 U Taq polymerase (Promega) coupled with TaqStart™ Antibody (Clontech). The PCR amplification was performed as follows: 3 min. at 94° C. for initial denaturation, then forty cycles of two steps consisting of 1 second at 95° C. and 30 seconds at 55° C., plus a terminal extension at 72° C. for 2 minutes. Detection of the PCR products was made by electrophoresis in agarose gels (2%) containing 0.25 µg/ml of ethidium bromide. Visualization of the PCR products was made under UV at 254 nm.

For determination of the sensitivities of the PCR assays, two-fold dilutions of purified genomic DNA were used to determine the minimal number of genome copies which can be detected.

Results

Amplifications with the *Staphylococcus* Genus-Specific PCR Assay.

The specificity of the assay was assessed by performing 30-cycle and 40-cycle PCR amplifications with the panel of gram-positive (47 species from 8 genera) and gram-negative (33 species from 22 genera) bacterial species listed in Table 12. The PCR assay was able to detect efficiently 27 of 27 staphylococcal species tested in both 30-cycle and 40-cycle regimens. For 30-cycle PCR, all bacterial species tested other than staphylococci were negative. For 40-cycle PCR, *Enterococcus faecalis* and *Macrococcus caseolyticus* were slightly positive for the *Staphylococcus*-specific PCR assay. The other species tested remained negative. Ubiquity tests performed on a collection of 295 clinical isolates provided by the microbiology laboratory of the Centre Hospitalier Universitaire de Québec, Pavillon Centre Hospitalier de l'Université Laval (CHUL), including *Staphylococcus aureus* (n=34), *S. auricularis* (n=2), *S. capitis* (n=19), *S. cohnii* (n=5), *S. epidermidis* (n=18), *S. haemolyticus* (n=21), *S. hominis* (n=73), *S. lugdunensis* (n=17), *S. saprophyticus* (n=6), *S. simulans* (n=3), *S. warneri* (n=32) and *Staphylococcus* sp. (n=65), showed a uniform amplification signal with the 30-cycle PCR assays and a perfect relation between the genotype and classical identification schemes.

The sensitivity of the *Staphylococcus*-specific assay with 30-cycle and 40-cycle PCR protocols was determined by using purified genomic DNA from the 11 staphylococcal species previously mentioned. For PCR with 30 cycles, a detection limit of 50 copies of genomic DNA was consistently obtained. In order to enhance the sensitivity of the assay, the number of cycles was increased. For 40-cycle PCR assays, the detection limit was lowered to a range of 5-10 genome copies, depending on the staphylococcal species tested.

Hybridization Between the *Staphylococcus*-Specific 371-bp Amplicon and Species-Specific or Genus-Specific Internal Probes.

Inter-species polymorphism was sufficient to generate species-specific internal probes for each of the principal species involved in human diseases (*S. aureus, S. epidermidis, S. haemolyticus, S. hominis* and *S. saprophyticus*). In order to verify the intra-species sequence conservation of the nucleotide sequence, sequence comparisons were performed on the 371-bp amplicon from five unrelated ATCC and clinical strains for each of the 5 principal staphylococcal species: *S. aureus, S. epidermidis, S. haemolyticus, S. hominis* and *S. saprophyticus*. Results showed a high level of conservation of nucleotide sequence between different unrelated strains from the same species. This sequence information allowed the development of staphylococcal species identification assays using species-specific internal probes hybridizing to the 371-bp amplicon. These assays are specific and ubiquitous for those five staphylococcal species. In addition to the species-specific internal probes, the genus-specific internals probes were able to recognize all or most *Staphylococcus* species tested.

Example 8

Differentiating Between the Two Closely Related Yeast Species *Candida albicans* and *Candida dubliniensis*

It is often useful for the clinician to be able to differentiate between two very closely related species of microorganisms. *Candida albicans* is the most important cause of invasive human mycose. In recent years, a very closely related species, *Candida dubliniensis*, was isolated in immunosuppressed patients. These two species are difficult to distinguish by classic biochemical methods. This example demonstrates the use of tuf sequences to differentiate *Candida albicans* and *Candida dubliniensis*. PCR primers SEQ ID NOs. 11-12, from previous patent publication WO98/20157, were selected for their ability to specifically amplify a tuf (elongation factor 1 alpha type) fragment from both species (see Annex XI for primer positions). Within this tuf fragment, a region differentiating *C. albicans* and *C. dubliniensis* by two nucleotides was selected and used to design two internal probes (see Annex XI for probe design, SEQ ID NOs. 577 and 578) specific for each species. Amplification of genomic DNA from *C. albicans* and *C. dubliniensis* was carried out using DIG-11-dUTP as described above in the section on chemiluminescent detection of amplification products. Internal probes SEQ ID NOs. 577 and 578 were immobilized on the bottom of individual microtiter plates and hybridization was carried out as described above in the above section on chemiluminescent detection of amplification products. Luminometer data showed that the amplicon from *C. albicans* hybridized only to probe SEQ ID NO. 577 while the amplicon from *C. dubliniensis* hybridized only to probe SEQ ID NO. 578, thereby demonstrating that each probe was species-specific.

Example 9

Specific Identification of *Entamoeba histolytica*

Upon analysis of tuf (elongation factor 1 alpha) sequence data, it was possible to find four regions where *Entamoeba histolytica* sequences remained conserved while other parasitical and eukaryotic species have diverged. Primers TEntG38 (SEQ ID NO. 703), TEntG442 (SEQ ID NO. 704), TEntG534 (SEQ ID NO. 705), and TEntG768 (SEQ ID NO. 706) were designed so that SEQ ID NO. 703 could be paired with the three other primers. On PTC-200 thermocyclers (MJ Research), the cycling conditions for initial sensitivity and specificity testing were 3 min. at 94° C. for initial denaturation, then forty cycles of two steps consisting of 1 second at 95° C. and 30 seconds at 55° C., followed by terminal extension at 72° C. for 2 minutes. Detection of the PCR products was made by electrophoresis in agarose gels (2%) containing 0.25 μg/ml of ethidium bromide. The three primer pairs could detect the equivalent of less than 200 *E. histolytica* genome copies. Specificity was tested using 0.5 ng of purified genomic DNA from a panel of microorganisms including *Babesia bovis, Babesia microtti, Candida albicans, Crithidia fasciculata, Leishmania major, Leishmania hertigi* and *Neospora caninum*. Only *E. histolytica* DNA could be amplified, thereby suggesting that the assay was species-specific.

Example 10

Sensitive Identification of *Chlamydia trachomatis*

Upon analysis of tuf sequence data, it was possible to find two regions where *Chlamydia trachomatis* sequences remained conserved while other species have diverged. Primers Ctr82 (SEQ ID NO. 554) and Ctr249 (SEQ ID NO. 555) were designed. With the PTC-200 thermocyclers (MJ Research), the optimal cycling conditions for maximum sensitivity and specificity were determined to be 3 min. at 94° C. for initial denaturation, then forty cycles of two steps consisting of 1 second at 95° C. and 30 seconds at 60° C., followed by terminal extension at 72° C. for 2 minutes. Detection of the PCR products was made by electrophoresis in agarose gels (2%) containing 0.25 μg/ml of ethidium bromide. The assay could detect the equivalent of 8 *C. trachomatis* genome copies. Specificity was tested with 0.1 ng of purified genomic DNA from a panel of microorganisms including 22 species commonly encountered in the vaginal flora (*Bacillus subtilis, Bacteroides fragilis, Candida albicans, Clostridium difficile, Corynebacterium cervicis, Corynebacterium urealyticum, Enterococcus faecalis, Enterococcus faecium, Escherichia coli, Fusobacterium nucleatum, Gardnerella vaginalis, Haemophilus influenzae, Klebsiella oxytoca, Lactobacillus acidophilus, Peptococcus niger, Peptostreptococcus prevotii, Porphyromonas asaccharolytica, Prevotella melaminogenica, Propionibacterium acnes, Staphylococcus aureus, Streptococcus acidominimus*, and *Streptococcus agalactiae*). Only *C. trachomatis* DNA could be amplified, thereby suggesting that the assay was species-specific.

Example 11

Genus-Specific Detection and Identification of Enterococci

Upon analysis of tuf sequence data and comparison with the repertory of tuf sequences, it was possible to find two regions where *Enterococcus* sequences remained conserved while other genera have diverged (Annex XVII). Primer pair Encg313dF and Encg599c (SEQ ID NOs. 1137 and 1136) was tested for its specificity by using purified genomic DNA from a panel of bacteria listed in Table 10. Using the PTC-200 thermocycler (MJ Research), the optimal cycling conditions for maximum sensitivity and specificity were determined to be 3 min. at 94° C. for initial denaturation, then forty cycles of two steps consisting of 1 second at 95° C. and 30 seconds at 55° C., followed by terminal extension at 72° C. for 2 minutes. Detection of the PCR products was made by electrophoresis in agarose gels (2%) containing 0.25 μg/ml of ethidium bromide. Visualization of the PCR products was made under UV at 254 nm. The 18 enterococcal species listed in Table 10 were all amplified efficiently. The only other species amplified were *Abiotrophia adiacens, Gemella haemolysans* and *Gemella morbillorum*, three gram-positive species. Sensitivity tested with several strains of *E. casseliflavus, E. faecium, E. faecalis, E. flavescens* and *E. gallinarum* and with one strain of each other *Enterococcus* species listed in Table 10 ranged from 1 to 10 copies of genomic DNA. The sequence variation within the 308-bp amplicon was sufficient so that internal probes could be used to speciate the amplicon and differenciate enterococci from *Abiotrophia adiacens, Gemella haemolysans* and *Gemella morbillorum*, thereby allowing to achieve excellent specificity. Species-specific internal probes were generated for each of the clinically important species, *E. faecalis* (SEQ ID NO. 1174), *E. faecium* (SEQ ID NO. 602), and the group including *E. casseliflavus, E. flavescens* and *E. gallinarum* (SEQ ID NO. 1122) (Annex XVIII). The species-specific internal probes were able to differentiate their respective *Enterococcus* species from all other *Enterococcus* species. These assays are sensitive, specific and ubiquitous for those five *Enterococcus* species.

Example 12

Identification of the Major Bacterial Platelets Contaminants Using tuf Sequences with a Multiplex PCR Test Blood platelets preparations need to be monitored for bacterial contaminations. The tuf sequences of 17 important bacterial contaminants of platelets were aligned. As shown in Annex XIX, analysis of these sequences allowed the design of PCR primers. Since in the case of contamination of platelet concentrates, detecting all species (not just the more frequently encountered ones) is desirable, perfect specificity of primers was not an issue in the design. However, sensitivity is important. That is why, to avoid having to put too much degeneracy, only the most frequent contaminants were included in primer design, knowing that the selected primers would anyway be able to amplify more species than the 17 used in the design because they target highly conserved regions of tuf sequences. Oligonucleotide sequences which are conserved in these 17 major bacterial contaminants of platelet concentrates were chosen (oligos Tplaq 769 and Tplaq 991, respectively SEQ ID NOs. 636 and 637) thereby permitting the detection of these bacterial species. However, sensitivity was slightly deficient with staphylococci. To ensure maximal sensitivity in the detection of all the more frequent bacterial contaminants, a multiplex assay also including oligonucleotide primers targeting the *Staphylococcus* genera (oligos Stag 422, SEQ ID NO. 553; and Stag 765, SEQ ID NO. 575) was developed. The bacterial species detected with the assay are listed in Table 14.

The primer pairs, oligos SEQ ID NO. 636 and SEQ ID NO. 637 that give an amplification product of 245 pb, and oligos SEQ ID NO. 553 and SEQ ID NO. 575 that give an amplification product of 368 pb, were used simultaneously in the multiplex PCR assay. Detection of these PCR products was made on the LightCycler thermocycler (Idaho Technology) using SYBR® Green I (Molecular Probe Inc.). SYBR® Green I is a fluorescent dye that binds specifically to double-stranded DNA.

Fluorogenic detection of PCR products with the LightCycler was carried out using 1.0 μM of both Tplaq primers (SEQ ID NOs. 636-637) and 0.4 μM of both TStaG primers (SEQ ID NOs. 553 and 575), 2.5 mM $MgCl_2$, BSA 7.5 μM, dNTP 0.2 mM (Pharmacia), 10 mM Tris-HCl (pH 8.3), 50 mM KCl, 0.5 U Taq DNA polymerase (Boerhinger Mannheim) coupled with TaqStart™ antibody (Clontech), and 0.07 ng of genomic DNA sample in a final volume of 7 μl. The optimal cycling conditions for maximum sensitivity and specificity were 1 minute at 94° C. for initial denaturation, then forty-five cycles of three steps consisting of 0 second at 95° C., 5 seconds at 60° C. and 9 seconds at 72° C. Amplification was monitored during each elongation cycle by measuring the level of SYBR® Green I. However, real analysis takes place after PCR. Melting curves are done for each sample and transformation of the melting peak allows determination of Tm. Thus primer-dimer and specific PCR product are discriminated. With this assay, all prominent bacterial contaminants of platelet concentrates listed in Annex XIX and Table 14 were detected. Sensitivity tests were performed on the 9 most frequent bacterial contaminants of platelets. The detection limit was less than 20 genome copies for *E. cloacae, B. cereus, S. choleraesuis* and *S. marcescens*; less than 15 genome copies for *P. aeruginosa*; and 2 to 3 copies were detected for *S. aureus, S. epidermidis, E. coli* and *K. pneumoniae*. Further refinements of assay conditions should increase sensitivity levels.

Example 13

The Resolving Power of the Tuf and atpD Sequences Databases is Comparable to the Biochemical Methods for Bacterial Identification The present gold standard for bacterial identification is mainly based on key morphological traits and batteries of biochemical tests. Here we demonstrate that the use of tuf and atpD sequences combined with simple phylogenetic analysis of databases formed by these sequences is comparable to the gold standard. In the process of acquiring data for the tuf sequences, we sequenced the tuf gene of a strain that was given to us labelled as *Staphylococcus hominis* ATCC 35982. That tuf sequence (SEQ ID NO. 192) was incorporated into the tuf sequences database and subjected to a basic phylogenic analysis using the Pileup command from version 10 of the GCG package (Genetics Computer Group). This analysis indicated that SEQ ID NO. 192 is not associated with other *S. hominis* strains but rather with the *S. warneri* strains. The ATCC 35982 strain was sent to the reference laboratory of the Laboratoire de santé publique du Québec (LSPQ). They used the classic identification scheme for staphylococci (Kloos and Schleifer, 1975., J. Clin. Microbiol. 1:82-88). Their results shown that although the colonial morphology could correspond to *S. hominis*, the more precise biochemical assays did not. These assays included discriminant mannitol, mannose and ribose acidification tests as well as rapid and dense growth in deep thioglycolate agar. The LSPQ report identified strain ATCC 35982 as *S. warneri* which confirms our database analysis. The same thing happened for *S. warneri* (SEQ ID NO. 187) which had initially been identified as *S. haemolyticus* by a routine clinical laboratory using a low resolving power automated system (MicroScan, AutoScan-4™). Again, the tuf and LSPQ analysis agreed on its identification as *S. warneri*. In numerous other instances, in the course of acquiring tuf and atpD sequence data from various species and genera, analysis of our tuf and/or atpD sequence databases permitted the exact identification of mislabelled or erroneously identified strains. These results clearly demonstrate the usefulness and the high resolving power of our sequence-based identification assays using the tuf and atpD sequences databases.

Example 14

Detection of Group B Streptococci from Clinical Specimens

Introduction

*Streptococcus agalactiae*, the group B *streptococcus* (GBS), is responsible for a severe illness affecting neonate infants. The bacterium is passed from the healthy carrier mother to the baby during delivery. To prevent this infection, it is recommended to treat expectant mothers susceptible of carrying GBS in their vaginal/anal flora. Carrier status is often a transient condition and rigorous monitoring requires cultures and classic bacterial identification weeks before delivery. To improve the detection and identification of GBS we developped a rapid, specific and sensitive PCR test fast enough to be performed right at delivery.

Materials and Methods

GBS Clinical Specimens.

A total of 66 duplicate vaginal/anal swabs were collected from 41 consenting pregnant women admitted for delivery at the Centre Hospitalier Universitaire de Québec, Pavillon Saint-Francois d'Assise following the CDC recommendations. The samples were obtained either before or after rupture of membranes. The swab samples were tested at the Centre de Recherche en Infectiologie de l'Université Laval within 24 hours of collection. Upon receipt, one swab was cut and then the tip of the swab was added to GNS selective broth for identification of group B streptococci (GBS) by the standard culture methods recommended by the CDC. The other swab was processed following the instruction of the IDI DNA extraction kit (Infectio Diagnotics (IDI) Inc.) prior to PCR amplification.

Oligonucleotides.

PCR primers, Tsag340 (SEQ ID NO. 549) and Tsag552 (SEQ ID NO. 550) complementary to the regions of the tuf gene unique for GBS were designed based upon a multiple sequence alignment using our repertory of tuf sequences. Oligo primer analysis software (version 5.0) (National Biosciences) was used to analyse primers annealing temperature, secondary structure potential as well as mispriming and dimerization potential. The primers were synthesized using a model 391 DNA synthesizer (Applied Biosystems).

A pair of fluorescently labeled adjacent hybridization probes Sag465-F (SEQ ID NO. 583) and Sag436-C (SEQ ID NO. 582) were synthesized and purified by Operon Technologies. They were designed to meet the recommendations of the manufacturer (Idaho Technology) and based upon multiple sequence alignment analysis using our repertory of tuf sequences to be specific and ubiquitous for GBS. These adjacent probes, which are separated by one nucleotide, allow fluorescence resonance energy transfer (FRET), generating an increased fluorescence signal when both hybridized simultaneously to their target sequences. The probe SEQ ID NO. 583 was labeled with FITC in 3 prime while SEQ ID NO. 582 was labeled with Cy5 in 5 prime. The Cy5-labeled probes contained a 3'-blocking phosphate group to prevent extension of the probes during the PCR reactions.

PCR Amplification.

Conventional amplifications were performed either from 2 μl of a purified genomic DNA preparation or cell lysates of vaginal/anal specimens. The 20 μl PCR mixture contained 0.4 μM of each GBS-specific primer (SEQ ID NOs. 549-550), 200 μM of each deoxyribonucleotide (Pharmacia Biotech), 10 mM Tris-HCl (pH 9.0), 50 mM KCl, 0.1% Triton X-100, 2.5 mM $MgCl_2$, 3.3 mg/ml bovine serum albumin (BSA) (Sigma), and 0.5 U of Taq polymerase (Promega) combined with the TaqStart™ antibody (Clontech). The TaqStart™ antibody, which is a neutralizing monoclonal antibody of Taq DNA polymerase, was added to all PCR reactions to enhance the efficiency of the amplification. The PCR mixtures were subjected to thermal cycling (3 min at 95° C. and then 40 cycles of 1 s at 95° C., and 30 s at 62° C. with a 2-min final extension at 72° C.) with a PTC-200 DNA Engine thermocycler (MJ research). The PCR-amplified reaction mixture was resolved by agarose gel electrophoresis.

The LightCycler™ PCR amplifications were performed with 1 μl of a purified genomic DNA preparation or cell lysates of vaginal/anal specimens. The 100 amplification mixture consisted of 0.4 μM each GBS-specific primer (SEQ ID NOs. 549-550), 200 μM each dNTP, 0.2 μM each fluorescently labeled probe (SEQ ID NOs. 582-583), 300 μg/ml BSA (Sigma), and 1 μl of 10×PC2 buffer (containing 50 mM Tris-HCl (pH 9.1), 16 mM ammonium sulfate, 3.5 mM $Mg^{2+}$, and 150 μg/ml BSA) and 0.5 U KlenTaq1™ (AB Peptides) coupled with TaqStart™ antibody (Clontech). KlenTaq1™ is a highly active and more heat-stable DNA polymerase without 5'-exonuclease activity. This prevents hydrolysis of hybridized probes by the 5' to 3' exonuclease activity. A volume of 7 μl of the PCR mixture was transferred into a composite capillary tube (Idaho Technology). The tubes were then centrifuged to move the reaction mixture to the tips of the capillaries and then cleaned with optical-grade methanol. Subsequently the capillaries were loaded into the carousel of a LC32 LightCycler™ (Idaho Technology), an instrument that combines rapid-cycle PCR with fluorescence analysis for continuous monitoring during amplification. The PCR reaction mixtures were subjected to a denaturation step at 94° C. for 3 min followed by 45 cycles of 0 s at 94° C., 20 s at 64° C. and 10 s at 72° C. with a temperature transition rate of 20° C./s. Fluorescence signals were obtained at each cycle by sequentially positioning each capillary on the carousel at the focus of optical elements affiliated to the built-in fluorimeter for 100 milliseconds. Complete amplification and analysis required about 35 min.

Specificity and sensitivity tests. The specificity of the conventional and LightCycler™ PCR assays was verified by using purified genomic DNA (0.1 ng/reaction) from a battery of ATCC reference strains representing 35 clinically relevant gram-positive species (*Abiotrophia defectiva* ATCC 49176, *Bifidobacterium breve* ATCC 15700, *Clostridium difficile* ATCC 9689, *Corynebacterium urealyticum* ATCC 43042, *Enterococcus casseliflavus* ATCC 25788, *Enterococcus durans* ATCC 19432, *Enterococcus faecalis* ATCC 29212, *Enterococcus faecium* ATCC 19434, *Enterococcus gallinarum* ATCC 49573, *Enterococcus raffinosus* ATCC 49427, *Lactobacillus* reuteri ATCC 23273, *Lactococcus lactis* ATCC 19435, *Listeria monocytogenes* ATCC 15313, *Peptococcus niger* ATCC 27731, *Peptostreptococcus anaerobius* ATCC 27337, *Peptostreptococcus prevotii* ATCC 9321, *Staphylococcus aureus* ATCC 25923, *Staphylococcus epidermidis* ATCC 14990, *Staphylococcus haemolyticus* ATCC 29970, *Staphylococcus saprophyticus* ATCC 15305, *Streptococcus agalactiae* ATCC 27591, *Streptococcus anginosus* ATCC 33397, *Streptococcus bovis* ATCC 33317, *Streptococcus constellatus* ATCC 27823, *Streptococcus dysgalactiae* ATCC 43078, *Streptococcus gordonii* ATCC 10558, *Streptococcus mitis* ATCC 33399, *Streptococcus mutans* ATCC 25175, *Streptococcus oralis* ATCC 35037, *Streptococcus parauberis* ATCC 6631, *Streptococcus pneumoniae* ATCC 6303, *Streptococcus pyogenes* ATCC 19615, *Streptococcus salivarius* ATCC 7073, *Streptococcus sanguinis* ATCC 10556, *Streptococcus uberis* ATCC 19436). These microbial species included 15 species of streptococci and many members of the normal vaginal and anal floras. In addition, 40 GBS isolates of human origin, whose identification was confirmed by a latex agglutination test (Streptex, Murex), were also used to evaluate the ubiquity of the assay.

For determination of the sensitivities (i.e., the minimal number of genome copies that could be detected) for conventional and LightCycler™ PCR assays, serial 10-fold or 2-fold dilutions of purified genomic DNA from 5 GBS ATCC strains were used.

Results

Evaluation of the GBS-Specific Conventional and LightCycler™ PCR Assays.

The specificity of the two assays demonstrated that only DNAs from GBS strains could be amplified. Both PCR assays did not amplify DNAs from any other bacterial species tested including 14 streptococcal species other than GBS as well as phylogenetically related species belonging to the genera *Enterococcus, Peptostreptococcus* and *Lactococcus*. Important members of the vaginal or anal flora, including coagulase-negative staphylococci, *Lactobacillus* sp., and *Bacteriodes* sp. were also negative with the GBS-specific PCR assay. The LightCycler™ PCR assays detected only GBS DNA by producing an increased fluorescence signal which was interpreted as a positive PCR result. Both PCR methods were able to amplify all of 40 GBS clinical isolates, showing a perfect correlation with the phenotypic identification methods.

The sensitivity of the assay was determined by using purified genomic DNA from the 5 ATCC strains of GBS. The detection limit for all of these 5 strains was one genome copy of GBS. The detection limit of the assay with the LightCycler™ was 3.5 fg of genomic DNA (corresponding to 1-2 genome copies of GBS). These results confirmed the high sensitivity of our GBS-specific PCR assay.

Direct Detection of GBS from Vaginal/Anal Specimens.

Among 66 vaginal/anal specimens tested, 11 were positive for GBS by both culture and PCR. There was one sample positive by culture only. The sensitivity of both PCR methods with vaginal/anal specimens for identifying colonization status in pregnant women at delivery was 91.7% when compared to culture results. The specificity and positive predictive values were both 100% and the negative predictive value was 97.8%. The time for obtaining results was approximately 45 min for LightCycler™ PCR, approximately 100 min for conventional PCR and 48 hours for culture.

Conclusion

We have developed two PCR assays (conventional and LightCycler™) for the detection of GBS, which are specific (i.e., no amplification of DNA from a variety of bacterial species other than GBS) and sensitive (i.e., able to detect around 1 genome copy for several reference ATCC strains of GBS). Both PCR assays are able to detect GBS directly from vaginal/anal specimens in a very short turnaround time. Using the real-time PCR assay on LightCycler™, we can detect GBS carriage in pregnant women at delivery within 45 minutes.

Example 15

Simultaneous Detection and Identification of *Streptococcus pyogenes* and its Pyrogenic Exotoxin A The rapid detection of *Streptococcus pyogenes* and of its pyrogenic exotoxin A is of clinical importance. We developed a multiplex assay which permits the detection of strains of *S. pyogenes* carrying the pyrogenic toxin A gene, which is associated with scarlet fever and other pathologies. In order to specifically detect *S. pyogenes*, nucleotide sequences of the pyrrolidone carboxylyl peptidase (pcp) gene were aligned to design PCR primers Spy291 (SEQ ID NO. 1211) and Spy473 (SEQ ID NO. 1210). Next, we designed primers for the specific detection of the pyrogenic exotoxin A. Nucleotide sequences of the speA gene, carried on the bacteriophage T12, were aligned as shown in Annex XXIII to design PCR primers Spytx814 (SEQ ID NO. 994) and Spytx 927 (SEQ ID NO. 995).

The primer pairs: oligos SEQ ID NOs. 1210-1211, yielding an amplification product of 207 bp, and oligos SEQ ID NOs. 994-995, yielding an amplification product of 135 bp, were used in a multiplex PCR assay.

PCR amplification was carried out using 0.4 μM of both pairs of primers, 2.5 mM $MgCl_2$, BSA 0.05 μM, dNTP 0.2 μM (Pharmacia), 10 mM Tris-HCl (pH 9.0), 0.1% Triton X-100, 2.5 mM $MgCl_2$, 0.5 U Taq DNA polymerase (Promega) coupled with TaqStart™ antibody (Clontech Laboratories Inc.), and 1 μl of genomic DNA sample in a final volume of 20 μl. PCR amplification was performed using a PTC-200 thermal cycler (MJ Research). The optimal cycling conditions for maximum specificity and sensitivity were 3 minutes at 94° C. for initial denaturation, then forty cycles of two steps consisting of 1 second at 95° C. and 30 seconds at 63° C., followed by a final step of 2 minutes at 72° C. Detection of the PCR products was made by electrophoresis in agarose gels (2%) containing 0.25 μg/ml of ethidium bromide. Visualization of the PCR products was made under UV at 254 nm.

The detection limit was less than 5 genome copies for both *S. pyogenes* and its pyrogenic exotoxin A. The assay was specific for pyrogenic exotoxin A-producing *S. pyogenes*: strains of the 27 other species of *Streptococcus* tested, as well as 20 strains of various gram-positive and gram-negative bacterial species were all negative.

A similar approach was used to design an alternative set of speA-specific primers (SEQ ID NOs. 996 to 998, see Annex XXIV). In addition, another set of primers based on the tuf gene (SEQ ID NOs. 999 to 1001, see Annex XXV) could be used to specifically detect *Streptococcus pyogenes.*

Example 16

Real-Time Detection and Identification of Shiga Toxin-Producing Bacteria

Shiga toxin-producing *Escherichia coli* and *Shigella dysenteriae* cause bloody diarrhea. Currently, identification relies mainly on the phenotypic identification of *S. dysenteriae* and *E. coli* serotype O157:H7. However, other serotypes of *E. coli* are increasingly found to be producers of type 1 and/or type 2 Shiga toxins. Two pairs of PCR primers targeting highly conserved regions present in each of the Shiga toxin genes $stx_1$ and $stx_2$ were designed to amplify all variants of those genes (see Annexes XXVI and XXVII). The first primer pair, oligonucleotides 1SLT224 (SEQ ID NO. 1081) and 1SLT385 (SEQ ID NO. 1080), yields an amplification product of 186 bp from the $stx_1$ gene. For this amplicon, the 1SLTB1-Fam (SEQ ID NO. 1084) molecular beacon was designed for the specific detection of $stx_1$ using the fluorescent label 6-carboxy-fluorescein. The 1SltS1-FAM (SEQ ID NO. 2012) molecular scorpion was also designed as an alternate way for the specific detection of $stx_1$. A second pair of PCR primers, oligonucleotides 2SLT537 (SEQ ID NO. 1078) and 2SLT678b (SEQ ID NO. 1079), yields an amplification product of 160 bp from the $stx_2$ gene. Molecular beacon 2SLTB1-Tet (SEQ ID NO. 1085) was designed for the specific detection of $stx_2$ using the fluorescent label 5-tetrachloro-fluorescein. Both primer pairs were combined in a multiplex PCR assay.

PCR amplification was carried out using 0.8 μM of primer pair SEQ ID NOs. 1080-1081, 0.5 μM of primer pair SEQ ID NOs. 1078-1079, 0.3 μM of each molecular beacon, 8 mM $MgCl_2$, 490 μg/mL BSA, 0.2 mM dNTPs (Pharmacia), 50 mM Tris-HCl, 16 mM $NH_4SO_4$, 1× TaqMaster (Eppendorf), 2.5 U KlenTaq1 DNA polymerase (AB Peptides) coupled with TaqStart™ antibody (Clontech Laboratories Inc.), and 1 μl of genomic DNA sample in a final volume of 25 μl. PCR amplification was performed using a SmartCycler thermal cycler (Cepheid). The optimal cycling conditions for maximum sensitivity and specificity were 60 seconds at 95° C. for initial denaturation, then 45 cycles of three steps consisting of 10 seconds at 95° C., 15 seconds at 56° C. and 5 seconds at 72° C. Detection of the PCR products was made in real-time by measuring the fluorescent signal emitted by the molecular beacon when it hybridizes to its target at the end of the annealing step at 56° C.

The detection limit was the equivalent of less than 5 genome copies. The assay was specific for the detection of both toxins, as demonstrated by the perfect correlation between PCR results and the phenotypic characterization performed using antibodies specific for each Shiga toxin type. The assay was successfully performed on several Shiga toxin-producing strains isolated from various geographic areas of the world, including 10 O157:H7 *E. coli,* 5 non-O157:H7 *E. coli* and 4 *S. dysenteriae.*

Example 17

Development of a PCR Assay for the Detection and Identification of Staphylococci at Genus and Species Levels and its Associated mecA Gene The *Staphylococcus*-specific PCR primers described in Example 7 (SEQ ID NOs. 553 and 575) were used in multiplex with the mecA-specific PCR primers and the *S. aureus*-specific primers described in our assigned U.S. Pat. No. 5,994,066 (SEQ ID NOs. 261 and 262 for mecA and SEQ ID NOs. 152 and 153 for *S. aureus* in the said patent). Sequence alignment analysis of 10 publicly available mecA gene sequences allowed to design an internal probe specific to mecA (SEQ ID NO. 1177). An internal probe was also designed for the *S. aureus*-specific amplicon (SEQ ID NO 1234). PCR amplification and agarose gel electrophoresis of the amplified products were performed as described in Example 7, with the exception that 0.4 μM (each) of the two *Staphylococcus*-specific primers (SEQ ID NOs. 553 and 575) and 0.4 μM (each) of the mecA-specific primers and 0.4 μM (each) of the *S. aureus*-specific primers were used in the PCR mixture. The specificity of the multiplex assay with 40-cycle PCR protocols was verified by using purified genomic DNA from five methicillin-resistant and fifteen methicillin-sensitive staphylococcal strains. The sensitivity of the multiplex assay with 40-cycle PCR protocols was determined by using purified genomic DNA from twenty-three methicillin-resistant and twenty-eight methicillin-sensitive staphylococcal strains. The detection limit was 2 to 10 genome copies of genomic DNA, depending on the staphylococcal species tested. Furthermore, the mecA-specific internal probe, the *S. aureus*-specific internal probe and the coagulase-negative staphylococci-specific internal probe (described in Example 7) were able to recognize twenty-three methicillin-resistant staphylococcal strains and twenty-eight methicillin-sensitive staphylococcal strains with high sensitivity and specificity.

The format of the assay is not limited to the one described above. A person skilled in the art could adapt the assay for different formats such as PCR with real-time detection using molecular beacon probes. Molecular beacon probes designed to be used in this assay include, but are not limited to, SEQ ID NO. 1232 for detection of the *S. aureus*-specific amplicon, SEQ ID NO. 1233 for detection of coagulase-negative staphylococci and SEQ ID NO. 1231 for detection of mecA.

Alternatively, a multiplex PCR assay containing the *Staphylococcus*-specific PCR primers described in Example 7 (SEQ ID NOs. 553 and 575) and the mecA-specific PCR primers described in our assigned U.S. Pat. No. 5,994,066 (SEQ ID NOs. 261 and 262 in the said patent) were developed. PCR amplification and agarose gel electrophoresis of the amplified products were performed as described in Example 7, with the exception that 0.4 µM (each) of the *Staphylococcus*-specific primers (SEQ ID NOs. 553 and 575) and 0.4 µM (each) of the mecA-specific primers described in our assigned U.S. Pat. No. 5,994,066 (SEQ ID NOs. 261 and 262 in the said patent) were used in the PCR mixture. The sensitivity of the multiplex assay with 40-cycle PCR protocols was determined by using purified genomic DNA from two methicillin-resistant and five methicillin-sensitive staphylococcal strains. The detection limit was 2 to 5 copies of genomic DNA, depending on the staphylococcal species tested. The specificity of the multiplex PCR assay coupled with capture-probe hybridization was tested with two strains of methicillin-resistant *S. aureus*, two strains of methicillin-sensitive *S. aureus* and seven strains of methicillin-sensitive coagulase-negative staphylococci. The mecA-specific internal probe (SEQ ID NO. 1177) and the *S. aureus*-specific internal probe (SEQ ID NO. 587) described in Example 7 were able to recognize all the strains with high specificity showing a perfect correlation with susceptibility to methicillin. The sensitivity of the PCR assay coupled with capture-probe hybridization was tested with one strain of methicillin-resistant *S. aureus*. The detection limit was around 10 copies of genomic DNA.

Example 18

Sequencing of pbp1a, pbp2b and pbp2x Genes of *Streptoccoccus Pneumoniae*

Penicillin resistance in *Streptococcus pneumoniae* involves the sequential alteration of up to five penicillin-binding proteins (PBPs) 1A, 1B, 2A, 2X and 2B in such a way that their affinity is greatly reduce toward the antibiotic molecule. The altered PBP genes have arisen as the result of interspecies recombination events from related streptococcal species. Among the PBPs usually found in *S. pneumoniae*, PBPs 1A, 2B, and 2X play the most important role in the development of penicillin resistance. Alterations in PBP 2B and 2X mediate low-level resistance to penicillin while additional alterations in PBP 1A plays a significant role in full penicillin resistance.

In order to generate a database for pbp sequences that can be used for design of primers and/or probes for the specific and ubiquitous detection of β-lactam resistance in *S. pneumoniae*, pbp1a, pbp2b and pbp2x DNA fragments sequenced by us or selected from public databases (GenBank and EMBL) from a variety of *S. pneumoniae* strains were used to design oligonucleotide primers. This database is essential for the design of specific and ubiquitous primers and/or probes for detection of β-lactam resistance in *S. pneumoniae* since the altered PBP 1A, PBP 2B and PBP 2X of β-lactam resistant *S. pneumoniae* are encoded by mosaic genes with numerous sequence variations among resistant isolates. The PCR primers were located in conserved regions of pbp genes and were able to amplify pbp1a, pbp2b, and pbp2X sequences of several strains of *S. pneumoniae* having various levels of resistance to penicillin and third-generation cephalosporins. Using primer pairs SEQ ID NOs. 1125 and 1126, SEQ ID NOs. 1142 and 1143, SEQ ID NOs. 1146 and 1147, it was possible to amplify and determine pbp1a sequences SEQ ID NOs. 1004-1018, 1648, 2056-2060 and 2062-2064, pbp2b sequences SEQ ID NOs. 1019-1033, and pbp2x sequences SEQ ID NOs. 1034-1048. Six other PCR primers (SEQ ID NOs. 1127-1128, 1144-1145, 1148-1149) were also designed and used to complete the sequencing of pbp1a, pbp2b and pbp2x amplification products. The described primers (SEQ ID NOs. 1125 and 1126, SEQ ID NOs. 1142 and 1143, SEQ ID NOs. 1146 and 1147, SEQ ID NOs. 1127-1128, 1144-1145, 1148-1149) represent a powerful tool for generating new pbp sequences for design of primers and/or probes for detection of β-lactam resistance in *S. pneumoniae*.

Example 19

Sequencing of hexa Genes of *Streptococcus* Species

The hexA sequence of *S. pneumoniae* described in our assigned U.S. Pat. No. 5,994,066 (SEQ ID NO. 31 in the said patent, SEQ ID NO. 1183 in the present application) allowed the design of a PCR primer (SEQ ID NO. 1182) which was used with primer Spn1401 described in our assigned U.S. Pat. No. 5,994,066 (SEQ ID NO. 156 in the said patent, SEQ ID NO. 1179 in the present application) to generate a database for hexA sequences that can be used to design primers and/or probes for the specific identification and detection of *S. pneumoniae* (Annex XLII) Using primers SEQ ID NO. 1179 and SEQ ID NO. 1182 (Annex XLII), it was possible to amplify and determine the hexA sequence from *S. pneumoniae* (4 strains) (SEQ ID NOs. 1184-1187), *S. mitis* (three strains) (SEQ ID NOs. 1189-1191) and *S. oralis* (SEQ ID NO. 1188).

Example 20

Development of Multiplex PCR Assays Coupled with Capture Probe Hybridization for the Detection and Identification of *Streptococcus pneumoniae* and its Penicillin Resistance Genes Two different assays were developed to identify *S. pneumoniae* and its susceptibility to penicillin.

Assay I:
Bacterial Strains.
The specificity of the multiplex PCR assay was verified by using a panel of ATCC (American Type Culture Collection) reference strains consisting of 33 gram-negative and 67 gram-positive bacterial species (Table 13). In addition, a total of 98 strains of *S. pneumoniae*, 16 strains of *S. mitis* and 3 strains of *S. oralis* from the American Type Culture Collection, the microbiology laboratory of the Centre Hospitalier Universitaire de Québec, Pavillon Centre Hospitalier de l'Université Laval (CHUL), (Step-Foy, Québec, Canada), the Laboratoire de santé publique du Québec, (Sainte-Anne-de-Bellevue, Québec, Canada), the Sunnybrook and Women's College Health Sciences Centre (Toronto, Canada), the Infectious Diseases Section, Department of Veterans Affairs Medical Center, (Houston, USA) were also tested to further validate the *Streptococcus pneumoniae*-specific PCR assay. The penicillin MICs (minimal inhibitory concentrations) were measured by the broth dilution method according to the recommended protocol of NCCLS.

PCR Primers and Internal Probes.

The analysis of hexA sequences from a variety of streptococcal species from the publicly available hexA sequence and from the database described in Example 19 (SEQ ID NOs. 1184-1191) allowed the selection of a PCR primer specific to *S. pneumoniae*, SEQ ID NO. 1181. This primer was used with the *S. pneumoniae*-specific primer SEQ ID NO. 1179 to generate an amplification product of 241 bp (Annex XLII). The PCR primer SEQ ID NO. 1181 is located 127 nucleotides downstream on the hexA sequence compared to the original *S. pneumoniae*-specific PCR primer Spn1515 described in our assigned U.S. Pat. No. 5,994,066 (SEQ ID NO. 157 in the said patent). These modifications were done to ensure the design of the *S. pneumoniae*-specific internal probe according to the new hexA sequences of several streptococcal species from the database described in Example 19 (SEQ ID NOs. 1184-1191).

The analysis of pbp1a sequences from *S. pneumoniae* strains with various levels of penicillin resistance from public databases and from the database described in Example 18 allowed the identification of amino acid substitutions Ile-459 to Met and Ser-462 to Ala that occur in isolates with high-level penicillin resistance (MICs≧1 μg/ml), and amino acid substitutions Ser-575 to Thr, Gln-576 to Gly and Phe-577 to Tyr that are common to all penicillin-resistant isolates with MICs≧0.25 μg/ml. As shown in Annex XXXI, PCR primer pair SEQ ID NOs. 1130 and 1131 were designed to detect high-level penicillin resistance (MICs≧1 μg/ml), whereas PCR primer pair SEQ ID NOs. 1129 and 1131 were designed to detect intermediate- and high-level penicillin resistance (MICs≧0.25 μg/ml).

The analysis of hexA sequences from the publicly avalaible hexA sequence and from the database described in Example 19 allowed the design of an internal probe specific to *S. pneumoniae* (SEQ ID NO. 1180) (Annex XLII). The range of mismatches between the *S. pneumoniae*-specific 241-bp amplicon was from 2 to 5, in the middle of the 19-bp probe. The analysis of pbp1a sequences from public databases and from the database described in Example 18 allowed the design of five internal probes containing all possible mutations to detect the high-level penicillin resistance 383-bp amplicon (SEQ ID NOs. 1197, 1217-1220). Alternatively, two other internal probes (SEQ ID NOs. 2024-2025) can also be used to detect the high-level penicillin resistance 383-bp amplicon. Five internal probes containing all possible mutations to detect the 157-bp amplicon which includes intermediate- and high-level penicillin resistance were also designed (SEQ ID NOs. 1094, 1192-1193, 1214 and 1216). Design and synthesis of primers and probes, and detection of the probe hybridization were performed as described in Example 7. Annex XXXI illustrates one of the internal probe for detection of the high-level penicillin resistance 383-bp amplicon (SEQ ID NO. 1197) and one of the internal probe for detection of the intermediate- and high-level penicillin resistance 157-bp amplicon (SEQ ID NO. 1193).

PCR Amplification.

For all bacterial species, amplification was performed from purified genomic DNA using a PTC-200 thermocycler (MJ Research). 1 μl of genomic DNA at 0.1 ng/μl, or 1 μl of a bacterial lysate, was transferred to a 19 μl PCR mixture. Each PCR reaction contained 50 mM KCl, 10 mM Tris-HCl (H 9.0), 0.1% Triton X-100, 2.5 mM $MgCl_2$, 0.1 μM (each) of the *S. pneumoniae*-specific primers SEQ ID NO. 1179 and SEQ ID NO. 1181, 0.2 μM of primer SEQ ID NO. 1129, 0.7 μM of primer SEQ ID NO. 1131, and 0.6 μM of primer SEQ ID NO. 1130, 0.05 mM bovine serum albumin (BSA), and 0.5 U Taq polymerase (Promega) coupled with TaqStart™ antibody. In order to generate Digoxigenin (DIG)-labeled amplicons for capture probe hybridization, 0.1× PCR DIG labeling four deoxynucleoside triphosphates mix (Boehringer Mannheim GmbH) was used for amplification.

For determination of the sensitivity of the PCR assays, 10-fold dilutions of purified genomic DNA were used to determine the minimal number of genome copies which can be detected.

Capture Probe Hybridization.

The DIG-labeled amplicons were hybridized to the capture probes bound to 96-well plates. The plates were incubated with anti-DIG-alkaline phosphatase and the chemiluminescence was measured by using a luminometer (MLX, Dynex Technologies Inc.) after incubation with CSPD and recorded as Relative Light Unit (RLU). The RLU ratio of tested sample with and without captures probes was then calculated. A ratio ≧2.0 was defined as a positive hybridization signal. All reactions were performed in duplicate.

Results

Amplifications with the Multiplex PCR Assay.

The specificity of the assay was assessed by performing 40-cycle PCR amplifications with the panel of gram-positive (67 species from 12 genera) and gram-negative (33 species from 17 genera) bacterial species listed in Table 13. All bacterial species tested other than *S. pneumoniae* were negative except *S. mitis* and *S. oralis*. Ubiquity tests were performed using a collection of 98 *S. pneumoniae* strains including high-level penicillin resistance (n=53), intermediate resistance (n=12) and sensitive (n=33) strains. There was a perfect correlation between PCR and standard susceptibility testing for 33 penicillin-sensitive isolates. Among 12 *S. pneumoniae* isolates with intermediate penicillin resistance based on susceptibility testing, 11 had intermediate resistance based on PCR, but one *S. pneumoniae* isolate with penicillin MIC of 0.25 μg/ml showed a high-level penicillin resistance based on genotyping. Among 53 isolates with high-level penicillin resistance based on susceptibility testing, 51 had high-level penicillin resistance based on PCR but two isolates with penicillin MIC>1 μg/ml showed an intermediate penicillin resistance based on genotyping. In general, there was a good correlation between the genotype and classical culture method for bacterial identification and susceptibility testing.

The sensitivity of the *S. pneumoniae*-specific assay with 40-cycle PCR protocols was determined by using purified genomic DNA from 9 isolates of *S. pneumoniae*. The detection limit was around 10 copies of genomic DNA for all of them.

Post-PCR Hybridization with Internal Probes.

The specificity of the multiplex PCR assay coupled with capture-probe hybridization was tested with 98 strains of *S. pneumoniae*, 16 strains of *S. mitis* and 3 strains of *S. oralis*. The internal probe specific to *S. pneumoniae* (SEQ ID NO. 1180) detected all 98 *S. pneunoniae* strains but did not hybridize to the *S. mitis* and *S. oralis* amplicons. The five internal probes specific to the high-level resistance amplicon (SEQ ID NOs. 1197, 1217-1220) detected all amplification patterns corresponding to high-level resistance. The two *S. pneumoniae* strains with penicillin MIC>1 µg/ml that showed an intermediate penicillin resistance based on PCR amplification were also intermediate resistance based on probe hybridization. Similarly, among 12 strains with intermediate-penicillin resistance based on susceptibility testing, 11 showed intermediate-penicillin resistance based on hybridization with the five internal probes specific to the intermediate and high-level resistance amplicon (SEQ ID NOs. 1094, 1192-1193, 1214 and 1216). The strain described above having a penicillin MIC of 0.25 µg/ml which was high-level penicillin resistance based on PCR amplification was also high-level resistance based on probe hybridization. In summary, the combination of the multiplex PCR and hybridization assays results in a highly specific test for the detection of penicillin-resistant *Streptococcus pneumoniae*.

Assay II:

Bacterial Strains.

The specificity of the multiplex PCR assay was verified by using the same strains as those used for the development of Assay I. The penicillin MICs (minimal inhibitory concentrations) were measured by the broth dilution method according to the recommended protocol of NCCLS.

PCR Primers and Internal Probes.

The analysis of pbp1a sequences from *S. pneumoniae* strains with various levels of penicillin resistance from public databases and from the database described in Example 18 allowed the design of two primers located in the constant region of pbp1a. PCR primer pair (SEQ ID NOs. 2015 and 2016) was designed to amplify a 888-bp variable region of pbp1a from all *S. pneumoniae* strains. A series of internal probes were designed for identification of the pbp1a mutations associated with penicillin resistance in *S. pneumoniae*. For detection of high-level penicillin resistance (MICs≧1 µg/ml), three internal probes were designed (SEQ ID NOs. 2017-2019). Alternatively, ten other internal probes were designed that can also be used for detection of high-level resistance within the 888-bp pbp1a amplicon: (1) three internal probes for identification of the amino acid substitutions Thr-371 to Ser or Ala within the motif S370TMK (SEQ ID NOs. 2031-2033); (2) two internal probes for detection of the amino acid substitutions Ile-459 to Met and Ser-462 to Ala near the motif S428RN (SEQ ID NOs. 1135 and 2026); (3) two internal probes for identification of the amino acid substitutions Asn-443 to Asp (SEQ ID NOs. 1134 and 2027); and (4) three internal probes for detection of all sequence variations within another region (SEQ ID NOs. 2028-2030). For detection of high-level and intermediate penicillin resistance (MICs≧0.25 µg/ml), four internal probes were designed (SEQ ID NOs. 2020-2023). Alternatively, six other internal probes were designed for detection of the four consecutive amino acid substitutions T574SQF to A574TGY near the motif K557TG (SEQ ID NOs. 2034-2039) that can also be used for detection of intermediate- and high-level resistance within the 888-bp pbp1a amplicon.

PCR Amplification.

For all bacterial species, amplification was performed from purified genomic DNA using a PTC-200 thermocycler (MJ Research). 1 µl of genomic DNA at 0.1 ng/µl, or 1 µl of a bacterial lysate, was transferred to a 19 µl PCR mixture. Each PCR reaction contained 50 mM KCl, 10 mM Tris-HCl (pH 9.0), 0.1% Triton X-100, 2.5 mM $MgCl_2$, 0.08 µM (each) of the *S. pneumoniae*-specific primers SEQ ID NO. 1179 and SEQ ID NO. 1181, 0.4 µM of the pbp1a-specific primer SEQ ID NO. 2015, 1.2 µM of pbp1a-specific primer SEQ ID NO. 2016, 0.05 mM bovine serum albumin (BSA), and 0.5 U Taq polymerase (Promega) coupled with TaqStart™ antibody. In order to generate Digoxigenin (DIG)-labeled amplicons for capture probe hybridization, 0.1× PCR DIG labeling four deoxynucleoside triphosphates mix (Boehringer Mannheim GmbH) was used for amplification.

For determination of the sensitivities of the PCR assays, 10-fold dilutions of purified genomic DNA were used to determine the minimal number of genome copies which can be detected.

Capture Probe Hybridization.

The DIG-labeled amplicons were hybridized to the capture probes bound to 96-well plates as described for Assay I.

Results

Amplifications with the Multiplex PCR Assay.

The specificity of the assay was assessed by performing 40-cycle PCR amplifications with the panel of gram-positive (67 species from 12 genera) and gram-negative (33 species from 17 genera) bacterial species listed in Table 13. All bacterial species tested other than *S. pneumoniae* were negative except *S. mitis* and *S. oralis*. Ubiquity tests were performed using a collection of 98 *S. pneumoniae* strains including high-level penicillin resistance (n=53), intermediate resistance (n=12) and sensitive (n=33) strains. All the above *S. pneumoniae* strains produced the 888-bp amplicon corresponding to pbp1a and the 241-bp fragment corresponding to hexA.

The sensitivity of the *S. pneumoniae*-specific assay with 40-cycle PCR protocols was determined by using purified genomic DNA from 9 isolates of *S. pneumoniae*. The detection limit was around 10 copies of genomic DNA for all of them.

Post-PCR Hybridization with Internal Probes.

The specificity of the multiplex PCR assay coupled with capture-probe hybridization was tested with 98 strains of *S. pneumoniae*, 16 strains of *S. mitis* and 3 strains of *S. oralis*. The internal probe specific to *S. pneumoniae* (SEQ ID NO. 1180) detected all 98 *S. pneunoniae* strains but did not hybridize to the *S. mitis* and *S. oralis* amplicons. The three internal probes (SEQ ID NOs 2017-2019) specific to high-level resistance detected all the 43 strains with high-level penicillin resistance based on susceptibility testing. Among 12 isolates with intermediate-penicillin resistance based on susceptibility testing, 11 showed intermediate-penicillin resistance based on hybridization with 4 internal probes (SEQ ID NOs. 2020-2023) and one strain having penicillin MIC of 0.25 µg/ml was misclassified as high-level penicillin resistance. In summary, the combination of the multiplex PCR and hybridization assays results in a highly specific test for the detection of penicillin-resistant *Streptococcus pneumoniae*.

Example 21

Sequencing of the Vancomycin Resistance vanaA van C1, vanC2 and vanC3 Genes

The publicly available sequences of the vanH-vanA-vanX-vanY locus of transposon Tn1546 from *E. faecalis*, vanC1 sequence from one strain of *E. gallinarum*, vanC2 and vanC3 sequences from a variety of *E. casseliflavus* and *E. flavescens* strains, respectively, allowed the design of PCR primers able to amplify the vanA, vanC1, vanC2 and vanC3 sequences of several *Enterococcus* species. Using primer pairs van6877 and van9106 (SEQ ID NOs. 1150 and 1155), vanC1-122 and vanC1-1315 (SEQ ID NOs. 1110 and 1109), and vanC2C3-1 and vanC2C3-1064 (SEQ ID NOs. 1108 and 1107), it was possible to amplify and determine vanA sequences SEQ ID NOs. 1049-1057, vanC1 sequences SEQ ID NOs. 1058-1059, vanC2 sequences SEQ ID NOs. 1060-1063 and vanC3 sequences SEQ ID NOs. 1064-1066, respectively. Four other PCR primers (SEQ ID NOs. 1151-1154) were also designed and used to complete the sequencing of vanA amplification products.

Example 22

Development of a PCR Assay for the Detection and Identification of Enterococci at Genus and Species Levels and its Associated Resistance Genes vanA and vanB The comparison of vanA and vanB sequences revealed conserved regions allowing the design of PCR primers specific to both vanA and vanB sequences (Annex XXXVIII). The PCR primer pair vanAB459 and vanAB830R (SEQ ID NOs. 1112 and 1111) was used in multiplex with the *Enterococcus*-specific primers Encg313dF and Encg599c (SEQ ID NOs. 1137 and 1136) described in Example 11. Sequence alignment analysis of vanA and vanB sequences revealed regions suitable for the design of internal probes specific to vanA (SEQ ID NO. 1170) and vanB (SEQ ID NO. 1171). PCR amplification and agarose gel electropheresis of the amplified products were performed as described in Example 11. The optimal cycling conditions for maximum sensitivity and specificity were found to be 3 min. at 94° C., followed by forty cycles of two steps consisting of 1 second at 95° C. and 30 seconds at 62° C., plus a terminal extension at 72° C. for 2 minutes. The specificity of the multiplex assay with 40-cycle PCR was verified by using 0.1 nanogram of purified genomic DNA from a panel of bacteria listed in Table 10. The sensitivity of the multiplex assay with 40-cycle PCR was verified with three strains of *E. casseliflavus*, eight strains of *E. gallinarum*, two strains of *E. flavescens*, two vancomycin-resistant strains of *E. faecalis* and one vancomycin-sensitive strain of *E. faecalis*, three vancomycin-resistant strains of *E. faecium*, one vancomycin-sensitive strain of *E. faecium* and one strain of each of the other enterococcal species listed in Table 10. The detection limit was 1 to 10 copies of genomic DNA, depending on the enterococcal species tested. The vanA- and vanB-specific internal probes (SEQ ID NOs. 1170 and 1171), as well as the *E. faecalis*- and *E. faecium*-specific internal probes (SEQ ID NOs. 1174 and 602) and the internal probe specific to the group including *E. casseliflavus, E. gallinarum* and *E. flavescens* (SEQ ID NO. 1122) described in Example 11, were able to recognize vancomycin-resistant enterococcal species with high sensitivity, specificity and ubiquity showing a perfect correlation between the genotypic and phenotypic analysis.

The format of the assay is not limited to the one described above. A person skilled in the art could adapt the assay for different formats such as PCR with real-time detection using molecular beacon probes. Molecular beacon probes designed to be used in this assay include, but are not limited to, SEQ ID NO. 1236 for the detection of *E. faecalis*, SEQ ID NO. 1235 for the detection of *E. faecium*, SEQ ID NO. 1240 for the detection of vanA, and SEQ ID NO. 1241 for the detection of vanB.

Example 23

Development of a Multiplex PCR Assay for Detection and Identification of Vancomycin-Resistant Organisms Including *Enterococcus faecalis, Enterococcus faecium* and the Group Including *Enterococcus gallinarum, Enterococcus Casseliflavus*, and *Enterococcus Flavescens*

The vanA and vanB genes encode the major glycopeptide resistance phenotypes in vancomycin resistant microorganisms. To design an assay to detect vancomycin resistant microorganisms, the nucleotide sequence of the vanA and vanB genes were analyzed. FIGS. 13 and 14 show a nucleotide sequence alignment of the vanA and vanB genes from the bacterial strains listed in Tables 26 and 27, respectively. Shown above the sequence alignments is a consensus DNA sequence derived from the multiple sequences. The analysis of vanA and vanB sequences revealed conserved regions allowing design of PCR primer pairs (SEQ ID NOs. 1089 and 1090 and SEQ ID NOs: 1090 and 1091) specific to vanA sequences (Annex XXVIII) and PCR primer pairs (SEQ ID NOs. 1095 and 1096 and SEQ ID NOs: 2298 and 1096) specific to vanB sequences (Annex XXIX). Shown below the sequence alignments in FIGS. 13 and 14 is the sequence and location of the vanA primers SEQ ID NO: 1090 and 1091 and the vanB primers SEQ ID NOs: 2298 and 1096, respectively. Also shown are the sequence and location of molecular beacon probes, SEQ ID NOs: 2299, 2300, designed for the detection of the vanA and vanB amplification products, respectively. SEQ ID NO: 2299. The vanA molecular beacon (SEQ ID NO: 2299) contains a 5' carboxyfluorescein (FAM) fluorophore. The vanB molecular beacon (SEQ ID NO: 2300) contains a sulforhodamine active ester (Texas Red) at its 5' end. Both beacons contain the nonfluorescent quencher moiety dabcyl chloride (DABCYL) at their 3' ends.

An internal control DNA, pERVd (SEQ ID NO: 2302) was designed for the vanR assay. The primers of SEQ ID NO: 1090 and SEQ ID NO: 1096 can hybridize to produce and amplification product from the internal control DNA. A molecular beacon probe (SEQ ID NO: 2301) was designed to detect the amplification product of the internal control DNA. SEQ ID NO: 2301 contains a 5' tetrachlorofluorescein (TET) fluorophore and the DABCYL quencher moiety at its 3' end.

In a first experiment, the vanA-specific PCR primer pair (SEQ ID NOs. 1089 and 1090) was used in multiplex with the vanB-specific PCR primer pair described in our assigned U.S. Pat. No. 5,994,066 (SEQ ID NOs. 1095 and 1096 in the present patent and SEQ ID NOs. 231 and 232 in the said patent). The comparison of vanC1, vanC2 and vanC3 sequences revealed conserved regions allowing design of PCR primers (SEQ ID NOs. 1101 and 1102) able to generate a 158-bp amplicon specific to the group including *E. gallinarum, E. casseliflavus* and *E. flavescens* (Annex XXX). The vanC-specific PCR primer pair (SEQ ID NOs. 1101 and 1102) was used in multiplex with the *E. faecalis*-specific PCR primer pair described in our assigned U.S. Pat. No. 5,994,066 (SEQ ID NOs. 40 and 41 in the said patent) and with the *E. faecium*-specific PCR primer pair described in our patent publication WO98/20157 (SEQ ID NOs. 1 and 2 in the said publication). For both multiplexes, the optimal cycling conditions for maximum sensitivity and specificity were found to be 3 min. at 94° C., followed by forty cycles of two steps consisting of 1 second at 95° C. and 30 seconds at 58° C., plus a terminal extension at 72° C. for 2 minutes. Detection of the PCR products was made by electrophoresis in agarose gels (2%) containing 0.25 μg/ml of ethidium bromide. The vanA-specific PCR primer pair (SEQ ID NOs. 1089 and 1090), the vanB-specific primer pair (SEQ ID NOs. 1095 and 1096) and the vanC-specific primer pair (SEQ ID NOs. 1101 and 1102) were tested for their specificity by using 0.1 nanogram of purified genomic DNA from a panel of 5 vancomycin-sensitive *Enterococcus* species, 3 vancomycin-resistant *Enterococcus* species, 13 other gram-positive bacteria and one gram-negative bacterium. Specificity tests were performed with the *E. faecium*-specific PCR primer pair described in our patent publication WO98/20157 (SEQ ID NOs. 1 and 2 in the said publication) and with the *E. faecalis*-specific PCR primer pair described in our assigned U.S. Pat. No. 5,994,066 (SEQ ID NOs. 40 and 41 in the said patent) on a panel of 37 gram-positive bacterial species. All *Enterococcus* strains were amplified with high specificity showing a perfect correlation between the genotypic and phenotypic analysis. The sensitivity of the assays was determined for several strains of *E. gallinarum, E. casseliflavus, E. flavescens* and vancomycin-resistant *E. faecalis* and *E. faecium*. Using each of the *E. faecalis*- and *E. faecium*-specific PCR primer pairs as well as vanA-, vanB- and vanC-specific PCR primers used alone or in multiplex as described above, the sensitivity ranged from 1 to 10 copies of genomic DNA.

The format of the assay is not limited to the one described above. A person skilled in the art could adapt the assay for different formats such as PCR with real-time detection using molecular beacon probes. Molecular beacon probes designed to be used in this assay include, but are not limited to, SEQ ID NO. 1238 for the detection of *E. faecalis*, SEQ ID NO. 1237 for the detection of *E. faecium*, SEQ ID NO. 1239 for the detection of vanA, and SEQ ID NO. 1241 for the detection of vanB.

Another PCR assay was developed for the detection of vancomycin-resistant *E. faecium* and vancomycin-resistant *E. faecalis*. This assay included two multiplex: (1) the first multiplex contained the vanA-specific primer pair (SEQ ID NOs. 1090-1091) and the vanB-specific PCR primer pair described in our assigned U.S. Pat. No. 5,994,066 (SEQ ID NOs. 1095 and 1096 in the present patent and SEQ ID NOs. 231 and 232 in the said patent), and (2) the second multiplex contained the *E. faecalis*-specific PCR primer pair described in our assigned U.S. Pat. No. 5,994,066 (SEQ ID NOs. 40 and 41 in the said patent) and the *E. faecium*-specific PCR primer pair described in our patent publication WO98/20157 (SEQ ID NOs. 1 and 2 in the said publication). For both multiplexes, the optimal cycling conditions for maximum sensitivity and specificity were found to be 3 min. at 94° C., followed by forty cycles of two steps consisting of 1 second at 95° C. and 30 seconds at 58° C., plus a terminal extension at 72° C. for 2 minutes. Detection of the PCR products was made by electrophoresis in agarose gels (2%) containing 0.25 μg/ml of ethidium bromide. The two multiplexes were tested for their specificity by using 0.1 nanogram of purified genomic DNA from a panel of two vancomycin-sensitive *E. faecalis* strains, two vancomycin-resistant *E. faecalis* strains, two vancomycin-sensitive *E. faecium* strains, two vancomycin-resistant *E. faecium* strains, 16 other enterococcal species and 31 other gram-positive bacterial species. All the *E. faecium* and *E. faecalis* strains were amplified with high specificity showing a perfect correlation between the genotypic analysis and the susceptibility to glycopeptide antibiotics (vancomycin and teicoplanin). The sensitivity of the assay was determined for two vancomycin-resistant *E. faecalis* strains and two vancomycin-resistant *E. faecium* strains. The detection limit was 5 copies of genomic DNA for all the strains.

This multiplex PCR assay was coupled with capture-probe hybridization. Four internal probes were designed: one specific to the vanA amplicon (SEQ ID NO. 2292), one specific to the vanB amplicon (SEQ ID NO. 2294), one specific to the *E. faecalis* amplicon (SEQ ID NO. 2291) and one specific to the *E. faecium* amplicon (SEQ ID NO. 2287). Each of the internal probes detected their specific amplicons with high specificity and sensitivity.

The VanR Assay

Development

In a next set of experiments, a multiplex real-time PCR reaction (the VanR assay) using the vanA primer pair SEQ ID NO: 1090 and 1091, the vanB primer pair SEQ ID NO: 1096 and 2298, the internal control DNA SEQ ID NO: 2302, and the molecular beacon probes SEQ ID NOs: 2299, 2300, and 2301 was performed.

For the template DNA, purified genomic DNA from vanA resistant *Enterococcus faecium* or vanB resistant *Enterococcus faecalis* was obtained from strains grown on blood agar plates under standard conditions. Genomic DNA was extracted from the cultures using the GNOME kit (QBIOgene, Carlsbad, Calif.) according to the manufacturer's instructions. Template DNA samples were treated with RNase piror to quanatitation. Genomic DNA concentration was determined and the quality of the genomic DNA preparations was confirmed using conventional methods.

Lyophilized reagents listed in Table 24 were used for the VanR assay. The lyophilized reagents were reconstituted with 225 μl diluent (116 mM Tris-HCl, pH 8.3, 11.6 mM KCl, 3.48 mM $MgCl_2$, 5.8 mM $NH_2SO_4$) and subsequently divided into 25 μl aliquots. 0.5, 2.5, 5, 10 or 20 copies of template DNA was added to each of 5 replicate reactions.

The VanR assay PCR was run in a SMART CYCLER™ PCR machine under the following conditions: 60° C. for 6 sec, followed by 95° C. for 900 sec, followed by 45 cycles of 95° C. for 5 seconds, 63° C. for 10 sec and 72° C. for 20 sec. The fluorescent readout from the FAM channel (vanA) and the Texas Red channel (vanB) of the reactions is shown in FIGS. 13A and 13B, respectively. The VanR assay is capable of detecting 5 copies of vanA target DNA in a sample (FIG. 13A) and of detecting 10 copies of vanB target DNA in a sample (FIG. 13B). For each concentration of template DNA, the number of positive assay results out of each of the five repliates was recorded (Table 15).

Specificity

To demonstrate the specificity of the VanR assay, vanC, vanD, vanE, and vanG resistant enterococci, other closely related bacteria, normal and pathogenic anal or fecal flora, or human DNA as listed in Tables 16-18 were assayed as follows: VanR assay lyophilized reagents (Table 38) were reconstituted with 225 μl diluent and aliquoted as described above. Template DNA was prepared using conventional methods and diluted in sample preparation buffer to a final concentration of 0.33 ng/μg. 3 μl template DNA was added to each master mix, and the reaction was carried out as described above in the SMART CYCLER™ PCR machine. 3 μl electrophoresis loading buffer was added to the reactions upon completion, and 15 μl of each reaction was run on an agarose gel to view the PCR amplification products, as shown in FIGS. 14-17.

To assess the specificity of the molecular beacons in the VanR assay, PCR assays were preformed to test cross-reactivity with amplified vanA and vanB target DNA and internal control DNA. The reaction components listed in Table 34 were each added to premix in Table 33. For each reaction, 25.8 μl of the final mix was combined with 3 μl template DNA (either 25 copies vanA DNA or 50 copies vanB DNA) or TE buffer (1×), as indicated. The reactions were performed in the SMART CYCLER™ PCR machine using the VanR assay conditions as described above. Table 35 shows the results of the experiment. Positive results were obtained in the FAM channel in every reaction that contained vanA template DNA and the vanA primers. Positive results were obtained in the Texas Red channel in every reaction that contained vanB template DNA and vanB primers. Positive results obtained in the TET channel in every reaction that contained internal control template DNA and internal control primers.

Negative results were obtained in each channel for every reaction that did not contain a target DNA that could be amplified and detected using the indicated molecular beacon probe. In other words, the molecular beacon probes did not cross-react with non-specific DNAs. FIGS. 18A-20B show the fluorescent readouts of the experiments.

Validation with Clinical Samples

To validate the VanR assay, the sensitivity of the VanR assay was performed on clinical samples. Briefly, the VanR assay lyophilized reagents listed in Table 38 were reconstituted in 225 μl diluent and aliquoted as described above. DNA isolation and quantitation was performed using conventional techniques. The samples were processed in a SMART CYCLER™ PCR machine using the VanR reaction conditions described above.

FIG. 21 shows the fluorescent readout in the FAM (vanA) channel and the Texas Red channel (vanB) from a specimen that is vanA resistant. The reaction gave a positive result in the FAM channel but not the Texas Red channel. FIG. 22 shows the fluorescent readaout in the FAM and Texas Red channels from a combination of a vanA resistant specimen and a vanB resistant specimen. Positive results were obtained in both the FAM and the Texas Red channel. FIG. 23 shows the fluorescent readout in the FAM and Texas Red channels from a vanB positive specimen. The results were negative in the FAM channel, and positive in the Texas Red channel.

Sensitivity

To assess the sensitivity of the VanR assay, template DNA isolated from enterococci from various geographic regions, and on template DNA from vanB resistant bacterial species other than enterococci was isolated and tested in the VanR assay as described above. Table 36 lists the enterococcal strains from various regions in the world tested in the assay. The table identifies the vanA and vanB phenotype of each strain. PCR amplification products were detected by running a sample of each reaction on an agarose gel, shown in FIG. 24. vanA or vanB PCR amplification products were detectable in each of the strains tested. Table 37 lists non-enterococcal, vanB resistant strains tested in the VanR assay. The PCR amplification products are shown in FIG. 25. The reaction produced an amplification product of the expected size for the vanB amplicon.

These results demonstrate that the VanR assay is sensitive and specific.

Example 24

Universal Amplification Involving the EF-G (fusA) Subdivision of tuf Sequences As shown in FIG. 3, primers SEQ ID NOs. 1228 and 1229 were designed to amplify the region between the end of fusA and the beginning of tuf genes in the str operon. Genomic DNAs from a panel of 35 strains were tested for PCR amplification with those primers. In the initial experiment, the following strains showed a positive result: *Abiotrophia adiacens* ATCC 49175, *Abiotrophia defectiva* ATCC 49176, *Bacillus subtilis* ATCC 27370, *Closridium difficile* ATCC 9689, *Enterococcus avium* ATCC 14025, *Enterococcus casseliflavus* ATCC 25788, *Enterococcus cecorum* ATCC 43198, *Enterococcus faecalis* ATCC 29212, *Enterococcus faecium* ATCC 19434, *Enterococcus flavescens* ATCC 49996, *Enterococcus gallinarum* ATCC 49573, *Enterococcus solitarius* ATCC 49428, *Escherichia coli* ATCC 11775, *Haemophilus influenzae* ATCC 9006, *Lactobacillus acidophilus* ATCC 4356, *Peptococcus niger* ATCC 27731, *Proteus mirabilis* ATCC 25933, *Staphylococcus aureus* ATCC 43300, *Staphylococcus auricularis* ATCC 33753, *Staphylococcus capitis* ATCC 27840, *Staphylococcus* epidemidis ATCC 14990, *Staphylococcus haemolyticus* ATCC 29970, *Staphylococcus hominis* ATCC 27844, *Staphylococcus lugdunensis* ATCC 43809, *Staphylococcus saprophyticus* ATCC 15305, *Staphylococcus simulans* ATCC 27848, and *Staphylococcus warneri* ATCC 27836. This primer pair could amplify additional bacterial species; however, there was no amplification for some species, suggesting that the PCR cycling conditions could be optimized or the primers modified. For example, SEQ ID NO. 1227 was designed to amplify a broader range of species.

In addition to other possible primer combinations to amplify the region covering fusA and tuf, FIG. 3 illustrates the positions of amplification primers SEQ ID NOs. 1221-1227 which could be used for universal amplification of fusA segments. All of the above mentioned primers (SEQ ID NOs. 1221-1229) could be useful for the universal and/or the specific detection of bacteria.

Moreover, different combinations of primers SEQ ID NOs. 1221-1229, sometimes in combination with tuf sequencing primer SEQ ID NO. 697, were used to sequence portions of the str operon, including the intergenic region. In this manner, the following sequences were generated: SEQ ID NOs. 1518-1526, 1578-1580, 1786-1821, 1822-1834, 1838-1843, 2184, 2187, 2188, 2214-2249, and 2255-2269.

Example 25

DNA Fragment Isolation from *Staphylococcus saprophyticus* by Arbitrarily Primed PCR DNA sequences of unknown coding potential for the species-specific detection and identification of *Staphylococcus saprophyticus* were obtained by the method of arbitrarily primed PCR (AP-PCR).

AP-PCR is a method which can be used to generate specific DNA probes for microorganisms (Fani et al., 1993, Molecular Ecology 2:243-250). A description of the AP-PCR protocol used to isolate a species-specific genomic DNA fragment from *Staphylococcus saprophyticus* follows. Twenty different oligonucleotide primers of 10 nucleotides in length (all included in the AP-PCR kit OPAD (Operon Technologies, Inc., Alameda, Calif.)) were tested systematically with DNAs from 5 bacterial strains of *Staphylococcus saprophyticus* as well as with bacterial strains of 27 other staphylococcal (non-*S. saprophyticus*) species. For all bacterial species, amplification was performed directly from one μL (0.1 ng/μL) of purified genomic DNA. The 25 μL PCR reaction mixture contained 50 mM KCl, 10 mM Tris-HCl (pH 9.0), 0.1% Triton X-100, 2.5 mM $MgCl_2$, 1.2 μM of only one of the 20 different AP-PCR primers OPAD, 200 μM of each of the four dNTPs, 0.5 U of Taq DNA polymerase (Promega Corp., Madison, Wis.) coupled with TaqStart™ antibody (Clontech Laboratories Inc., Palo Alto, Calif.). PCR reactions were subjected to cycling using a MJ Research PTC-200 thermal cycler as follows: 3 min at 96° C. followed by 42 cycles of 1 min at 94° C. for the denaturation step, 1 min at 31° C. for the annealing step and 2 min at 72° C. for the extension step. A final extension step of 7 min at 72° C. followed the 42 cycles to ensure complete extension of PCR products. Subsequently, twenty microliters of the PCR-amplified mixture were resolved by electrophoresis on a 1.5% agarose gel containing 0.25 μg/ml of ethidium bromide. The size of the amplification products was estimated by comparison with a 50-bp molecular weight ladder.

Amplification patterns specific for *Staphylococcus saprophyticus* were observed with the AP-PCR primer OPAD-16 (sequence: 5'-AACGGGCGTC-3'). Amplification with this primer consistently showed a band corresponding to a DNA fragment of approximately 380 bp for all *Staphylococcus saprophyticus* strains tested but not for any of the other staphylococcal species tested.

The band corresponding to the 380 bp amplicon, specific and ubiquitous for *S. saprophyticus* based on AP-PCR, was excised from the agarose gel and purified using the QIAquick™ gel extraction kit (QIAGEN Inc.). The gel-purified DNA fragment was cloned into the T/A cloning site of the pCR 2.1™ plasmid vector (Invitrogen Inc.) using T4 DNA ligase (New England BioLabs). Recombinant plasmids were transformed into *E. coli* DH5α competent cells using standard procedures. All reactions were performed according to the manufacturer's instructions. Plasmid DNA isolation was done by the method of Birnboim and Doly (Nucleic Acid Res., 1979, 7:1513-1523) for small-scale preparations. All plasmid DNA preparations were digested with the EcoRI restriction endonuclease to ensure the presence of the approximately 380 bp AP-PCR insert into the plasmid. Subsequently, a large-scale and highly purified plasmid DNA preparation was performed from two selected clones shown to carry the AP-PCR insert by using the QIAGEN plasmid purification kit (midi format). These large-scale plasmid preparations were used for automated DNA sequencing.

The 380 bp nucleotide sequence was determined for three strains of *S. saprophyticus* (SEQ ID NOs. 74, 1093, and 1198). Both strands of the AP-PCR insert from the two selected clones were sequenced by the dideoxynucleotide chain termination sequencing method with SP6 and T7 sequencing primers by using the Applied Biosystems automated DNA sequencer (model 373A) with their PRISM™ Sequenase™ Terminator Double-stranded DNA Sequencing Kit (Applied Biosystems, Foster City, Calif.).

Optimal species-specific amplification primers (SEQ ID NOs. 1208 and 1209) have been selected from the sequenced AP-PCR *Staphylococcus saprophyticus* DNA fragments with the help of the primer analysis software Oligo™ 5.0 (National BioSciences Inc.). The selected primers were tested in PCR assays to verify their specificity and ubiquity. Data obtained with DNA preparations from reference ATCC strains of 49 gram-positive and 31 gram-negative bacterial species, including 28 different staphylococcal species, indicate that the selected primer pairs are specific for *Staphylococcus saprophyticus* since no amplification signal has been observed with DNAs from the other staphylococcal or bacterial species tested. This assay was able to amplify efficiently DNA from all 60 strains of *S. saprophyticus* from various origins tested. The sensitivity level achieved for three *S. saprophyticus* reference ATCC strains was around 6 genome copies.

Example 26

Sequencing of Prokaryotic tuf Gene Fragments

The comparison of publicly available tuf sequences from a variety of bacterial species revealed conserved regions, allowing the design of PCR primers able to amplify tuf sequences from a wide range of bacterial species. Using primer pair SEQ ID NOs. 664 and 697, it was possible to amplify and determine tuf sequences SEQ ID NOs.: 1-73, 75-241, 607-618, 621, 662, 675, 717-736, 868-888, 932, 967-989, 992, 1002, 1572-1575, 1662-1663, 1715-1733, 1835-1837, 1877-1878, 1880-1881, 2183, 2185, 2200, 2201, and 2270-2272.

Example 27

Sequencing of Procaryotic recA Gene Fragments

The comparison of publicly available recA sequences from a variety of bacterial species revealed conserved regions, allowing the design of PCR primers able to amplify recA sequences from a wide range of bacterial species. Using primer pairs SEQ ID NOs. 921-922 and 1605-1606, it was possible to amplify and determine recA sequences SEQ ID NOs.: 990-991, 1003, 1288-1289, 1714, 1756-1763, 1866-1873 and 2202-2212.

Example 28

Specific Detection and Identification of *Escherichia coli/Shigella* Sp. Using tuf Sequences The analysis of tuf sequences from a variety of bacterial species allowed the selection of PCR primers (SEQ ID NOs. 1661 and 1665) and of an internal probe (SEQ ID NO. 2168) specific to *Escherichia coli/Shigella* sp. The strategy used to design the PCR primers was based on the analysis of a multiple sequence alignment of various tuf sequences. The multiple sequence alignment included the tuf sequences of *Escherichia coli/Shigella* sp. as well as tuf sequences from other species and bacterial genera, especially representatives of closely related species. A careful analysis of this alignment allowed the selection of oligonucleotide sequences which are conserved within the target species but which discriminate sequences from other species, especially from the closely related species, thereby permitting the species-specific and ubiquitous detection and identification of the target bacterial species.

The chosen primer pair, oligos SEQ ID NOs. 1661 and 1665, gives an amplification product of 219 bp. Standard PCR was carried out using 0.4 μM of each primer, 2.5 mM $MgCl_2$, BSA 0.05 mM, 50 mM KCl, 10 mM Tris-HCl (pH 9.0), 0.1% Triton X-100, dNTPs 0.2 mM (Pharmacia), 0.5 U Taq DNA polymerase (Promega) coupled with TaqStart™ antibody (Clontech Laboratories Inc.), 1 μl of genomic DNA sample in a final volume of 20 μl using a PTC-200 thermocycler (MJ Research). The optimal cycling conditions for maximum sensitivity and specificity were 3 minutes at 95° C. for initial denaturation, then forty cycles of two steps consisting of 1 second at 95° C. and 30 seconds at 60° C., followed by terminal extension at 72° C. for 2 minutes. Detection of the PCR products was made by electrophoresis in agarose gels (2%) containing 0.25 μg/ml of ethidium bromide. Visualization of the PCR products was made under UV at 254 nm.

Specificity of the assay was tested by adding to the PCR reactions 0.1 ng of genomic DNA from each of the following bacterial species: *Escherichia coli* (7 strains), *Shigella sonnei, Shigella flexneri, Shigella dysenteriae, Salmonella typhimyurium, Salmonella typhi, Salmonella enteritidis, Tatumella ptyseos, Klebsiella pneumoniae* (2 strains), *Enterobacter aerogenes, Citrobacter farmeri, Campylobacter jejuni, Serratia marcescens*. Amplification was observed only for the *Escherichia coli* and *Shigella* sp. strains listed and *Escherichia fergusonii*. The sensitivity of the assay with 40-cycle PCR was verified with one strain of *E. coli* and three strains of *Shigella* sp. The detection limit for *E. coli* and *Shigella* sp. was 1 to 10 copies of genomic DNA, depending on the strains tested.

Example 29

Specific Detection and Identification of *Klebsiella pneumoniae* Using atpD Sequences The analysis of atpD sequences from a variety of bacterial species allowed the selection of PCR primers specific to *K. pneumoniae*. The primer design strategy is similar to the strategy described in Example 28 except that atpD sequences were used in the alignment.

Two *K. pneumoniae*-specific primers were selected, (SEQ ID NOs. 1331 and 1332) which give an amplification product of 115 bp. Standard PCR was carried out on PTC-200 thermocyclers (MJ Research) using 0.4 μM of each primer as described in Example 28. The optimal cycling conditions for maximum sensitivity and specificity were as follow: three minutes at 95° C. for initial denaturation, then forty cycles of two steps consisting of 1 second at 95° C. and 30 seconds at 55° C., followed by terminal extension at 72° C. for 2 minutes.

Specificity of the assay was tested by adding to the PCR reactions 0.1 ng of genomic DNA from each of the following bacterial species: *Klebsiella pneumoniae* (2 strains), *Klebsiella ornitholytica, Klebsiella oxytoca* (2 strains), *Klebsiella planticola, Klebsiella terrigena, Citrobacter freundii, Escherichia coli, Salmonella cholerasuis typhi, Serratia marcescens, Enterobacter aerogenes, Proteus vulgaris, Kluyvera ascorbata, Kluyvera georgiana, Kluyvera cryocrescens* and *Yersinia enterolitica*. Amplification was detected for the two *K. pneumoniae* strains, *K. planticola, K terrigena* and the three *Kluyvera* species tested. Analysis of the multiple alignment sequence of the atpD gene allowed the design of an internal probe SEQ ID NO. 2167 which can discrimate *Klebsiella pneumoniae* from other *Klebsiella* sp. and *Kluyvera* sp. The sensitivity of the assay with 40-cycle PCR was verified with one strain of *K. pneumoniae*. The detection limit for *K. pneumoniae* was around 10 copies of genomic DNA.

Example 30

Specific Detection and Identification of *Acinetobacter* Baumannii Using atpD Sequences The analysis of atpD sequences from a variety of bacterial species allowed the selection of PCR primers specific to *Acinetobacter baumannii*. The primer design strategy is similar to the strategy described in Example 28.

Two *A. baumannii*-specific primers were selected, SEQ ID NOs. 1690 and 1691, which give an amplification product of 233 bp. Standard PCR was carried out on PTC-200 thermocyclers (MJ Research) using 0.4 μM of each primer as described in Example 28. The optimal cycling conditions for maximum sensitivity and specificity were as follow: three minutes at 95° C. for initial denaturation, then forty cycles of two steps consisting of 1 second at 95° C. and 30 seconds at 60° C., followed by terminal extension at 72° C. for 2 minutes.

Specificity of the assay was tested by adding to the PCR reactions 0.1 ng of genomic DNA from each of the following bacterial species: *Acinetobacter baumannii* (3 strains), *Acinetobacter anitratus, Acinetobacter lwoffi, Serratia marcescens, Enterobacter cloacae, Enterococcus faecalis, Pseudomonas aeruginosa, Psychrobacter phenylpyruvicus, Neisseria gonorrheoae, Haemophilus haemoliticus, Yersinia enterolitica, Proteus vulgaris, Eikenella corrodens, Escherichia coli*. Amplification was detected only for *A. baumannii, A anitratus* and *A. lwoffi*. The sensitivity of the assay with 40-cycle PCR was verified with two strains of *A. baumannii*. The detection limit for the two *A. baumannii* strains tested was 5 copies of genomic DNA. Analysis of the multiple alignment sequence of the atpD gene allowed the design of a *A. baumannii*-specific internal probe (SEQ ID NO. 2169).

Example 31

Specific Detection and Identification of *Neisseria gonorrhoeae* Using tuf Sequences The analysis of tuf sequences from a variety of bacterial species allowed the selection of PCR primers specific to *Neisseria gonorrhoeae*. The primer design strategy is similar to the strategy described in Example 28.

Two *N. gonorrhoeae*-specific primers were selected, SEQ ID NOs. 551 and 552, which give an amplification product of 139 bp. PCR amplification was carried out on PTC-200 thermocyclers (MJ Research) using 0.4 μM of each primer as described in Example 28. The optimal cycling conditions for maximum sensitivity and specificity were as follow: three minutes at 95° C. for initial denaturation, then forty cycles of two steps consisting of 1 second at 95° C. and 30 seconds at 65° C., followed by terminal extension at 72° C. for 2 minutes.

Specificity of the assay was tested by adding into the PCR reactions, 0.1 ng of genomic DNA from each of the following bacterial species: *Neisseria gonorrhoeae* (19 strains), *Neisseria meningitidis* (2 strains), *Neisseria lactamica, Neisseria flavescens, Neisseria animalis, Neisseria canis, Neisseria cuniculi, Neisseria elongata, Neisseria mucosa, Neisseria polysaccharea, Neisseria sicca, Neisseria subflava, Neisseria weaveri*. Amplification was detected only for *N. gonorrhoeae, N. sicca* and *N. polysaccharea*. The sensitivity of the assay with 40-cycle PCR was verified with two strains of *N. gonorrhoeae*. The detection limit for the *N. gonorrhoeae* strains tested was 5 copies of genomic DNA. Analysis of the multiple alignment sequence of the tuf gene allowed the design of an internal probe, SEQ ID NO. 2166, which can discriminate *N. gonorrhoeae* from *N. sicca* and *N. polysaccharea*.

Example 32

Sequencing of Bacterial gyrA and parC Gene Fragments

Sequencing of Bacterial gyrA and parC Fragments

One of the major mechanism of resistance to quinolone in various bacterial species is mediated by target changes (DNA gyrase and/or topoisomerase IV). These enzymes control DNA topology and are vital for chromosome function and replication. Each of these enzymes is a tetramer composed of two subunits: GyrA and GyrB forming $A_2B_2$ complex in DNA gyrase; and ParC and ParE forming and $C_2E_2$ complex in DNA topoisomerase IV. It has been shown that they are hotspots, called the quinolone-resistance-determining region (QRDR) for mutations within gyrA that encodes for the GyrA subunit of DNA gyrase and within parC that encodes the parC subunit of topoisomerase IV.

In order to generate a database for gyrA and parC sequences that can be used for design of primers and/or probes for the specific detection of quinolone resistance in various bacterial species, gyrA and parC DNA fragments selected from public database (GenBanK and EMBL) from a variety of bacterial species were used to design oligonucleotide primers.

Using primer pair SEQ ID NOs. 1297 and 1298, it was possible to amplify and determine gyrA sequences from *Klebsiella oxytoca* (SEQ ID NO. 1764), *Klebsiella pneumoniae* subsp. *ozaneae* (SEQ ID NO. 1765), *Klebsiella planticola* (SEQ ID NO. 1766), *Klebsiella pneumoniae* (SEQ ID NO. 1767), *Klebsiella pneumoniae* subsp. *pneumoniae* (two strains) (SEQ ID NOs. 1768-1769), *Klebsiella pneumoniae* subsp. *rhinoscleromatis* (SEQ ID NO. 1770), *Klebsiella terrigena* (SEQ ID NO. 1771), *Kluyvera ascorbata* (SEQ ID NO. 2013), *Kluyvera georgiana* (SEQ ID NO. 2014) and *Escherichia coli* (4 strains) (SEQ ID NOs. 2277-2280). Using primer pair SEQ ID NOs. 1291 and 1292, it was possible to amplify and determine gyrA sequences from *Legionella pneumophila* subsp. *pneumophila* (SEQ ID NO. 1772), *Proteus mirabilis* (SEQ ID NO. 1773), *Providencia rettgeri* (SEQ ID NO. 1774), *Proteus vulgaris* (SEQ ID NO. 1775) and *Yersinia enterolitica* (SEQ ID NO. 1776). Using primer pair SEQ ID NOs. 1340 and 1341, it was possible to amplify and determine gyrA sequence from *Staphylococcus aureus* (SEQ ID NO. 1255).

Using primers SEQ ID NOs. 1318 and 1319, it was possible to amplify and determine parC sequences from *K. oxytoca* (two strains) (SEQ ID NOs. 1777-1778), *Klebsiella pneumoniae* subsp. *ozaenae* (SEQ ID NO. 1779), *Klebsiella planticola* (SEQ ID NO. 1780), *Klebsiella pneumoniae* (SEQ ID NO. 1781), *Klebsiella pneumoniae* subsp. *pneumoniae* (two strains) (SEQ ID NOs. 1782-1783), *Klebsiella pneumoniae* subsp. *rhinoscleromatis* (SEQ ID NO. 1784) and *Klebsiella terrigena* (SEQ ID NO. 1785).

Example 33

Development of a PCR Assay for the Specific Detection and Identification of *Staphylococcus Aureus* and its Quinolone Resistance Genes gyrA and parC The analysis of gyrA and parC sequences from a variety of bacterial species revealed conserved regions allowing the design of PCR primers specific to the quinolone-resistance-determining region (QRDR) of gyrA and parC from *Staphylococcus aureus*. PCR primer pair SEQ ID NOs. 1340 and 1341 was designed to amplify the gyrA sequence of *S. aureus*, whereas PCR primer pair SEQ ID NOs. 1342 and 1343 was designed to amplify *S. aureus* parC. The comparison of gyrA and parC sequences from *S. aureus* strains with various levels of quinolone resistance allowed the identification of amino acid substitutions Ser-84 to Leu, Glu-88 to Gly or Lys in the GyrA subunit of DNA gyrase encoded by gyrA and amino acid changes Ser-80 to Phe or Tyr and Ala-116 to Glu in the ParC subunit of topoisomerase IV encoded by parC. These amino acid substitutions in GyrA and ParC subunits occur in isolates with intermediate- or high-level quinolone resistance. Internal probes for the specific detection of wild-type *S. aureus* gyrA (SEQ ID NO. 1940) and wild-type *S. aureus* parC (SEQ ID NO. 1941) as well as internal probes for the specific detection of each of the gyrA (SEQ ID NOs. 1333-1335) and parC mutations identified in quinolone-resistant *S. aureus* (SEQ ID NOs. 1336-1339) were designed.

The gyrA- and parC-specific primer pairs (SEQ ID NOs. 1340-1341 and SEQ ID NOs. 1342-1343) were used in multiplex. PCR amplification was carried out on PTC-200 thermocyclers (MJ Research) using 0.3, 0.3, 0.6 and 0.6 μM of each primers, respectively, as described in Example 28. The optimal cycling conditions for maximum sensitivity and specificity were 3 minutes at 95° C. for initial denaturation, then forty cycles of two steps consisting of 1 second at 95° C. and 30 seconds at 62° C., followed by terminal extension at 72° C. for 2 minutes. Detection of the PCR products was made by electrophoresis in agarose gels (2%) containing 0.25 μg/ml of ethidium bromide. The specificity of the multiplex assay with 40-cycle PCR was verified by using 0.1 ng of purified genomic DNA from a panel of gram-positive bacteria. The list included the following: *Abiotrophia adiacens, Abiotrophia defectiva, Bacillus cereus, Bacillus mycoides, Enterococcus faecalis* (2 strains), *Enterococcus flavescens, Gemella morbillorum, Lactococcus lactis, Listeria innocua, Listeria monocytogenes, Staphylococcus aureus* (5 strains), *Staphylococcus auricalis, Staphylococcus capitis* subsp. *urealyticus, Staphylococcus carnosus, Staphylococcus chromogenes, Staphylococcus epidermidis* (3 strains), *Staphylococcus gallinarum, Staphylococcus haemolyticus* (2 strains), *Staphylococcus hominis, Staphylococcus hominis* subsp *hominis, Staphylococcuslentus, Staphylococcus lugdunensis, Staphylococcus saccharolyticus, Staphylococcus saprophyticus* (3 strains), *Staphylococcus simulans, Staphylococcus warneri, Staphylococcus xylosus, Streptococcus agalactiae, Streptococcus pneumoniae*. Strong amplification of both gyrA and parC genes was only detected for the *S. aureus* strains tested. The sensitivity of the multiplex assay with 40-cycle PCR was verified with one quinolone-sensitive and four quinolone-resistant strains of *S. aureus*. The detection limit was 2 to 10 copies of genomic DNA, depending on the strains tested.

Detection of the hybridization with the internal probes was performed as described in Example 7. The internal probes specific to wild-type gyrA and parC of *S. aureus* and to the gyrA and parC variants of *S. aureus* were able to recognize two quinolone-resistant and one quinolone-sensitive *S. aureus* strains showing a perfect correlation with the susceptibility to quinolones.

The complete assay for the specific detection of *S. aureus* and its susceptibility to quinolone contains the *Staphylococcus*-specific primers (SEQ ID NOs. 553 and 575) described in Example 7 and the multiplex containing the *S. aureus* gyrA- and parC-specific primer pairs (SEQ ID NOs. 1340-1341 and SEQ ID NOs. 1342-1343). Amplification is coupled with post-PCR hybridization with the internal probe specific to *S. aureus* (SEQ ID NO. 587) described in Example 7 and the internal probes specific to wild-type *S. aureus* gyrA and parC (SEQ ID NOs. 1940-1941) and to the *S. aureus* gyrA and parC variants (SEQ ID NOs. 1333-1338).

An assay was also developed for the detection of quinolone-resistant *S. aureus* using the SmartCycler (Cepheid). Real-time detection is based on the use of *S. aureus* parC-specific primers (SEQ ID NOs. 1342 and 1343) and the *Staphylococcus*-specific primers (SEQ ID NOs. 553 and 575) described in Example 7. Internal probes were designed for molecular beacon detection of the wild-type *S. aureus* parC (SEQ ID NO.1939), for detection of the Ser-80 to Tyr or Phe amino acid substitutions in the ParC subunit encoded by *S. aureus* parC (SEQ ID NOs. 1938 and 1955) and for detection of *S. aureus* (SEQ ID NO. 2282).

Example 34

Development of a PCR Assay for the Detection and Identification of *Klebsiella Pneumoniae* and its Quinolone Resistance Genes gyrA and parC The analysis of gyrA and parC sequences from a variety of bacterial species from the public databases and from the database described in Example 32 revealed conserved regions allowing the design of PCR primers specific to the quinolone-resistance-determining region (QRDR) of gyrA and parC from *K. pneumoniae*. PCR primer pair SEQ ID NOs. 1936 and 1937, or pair SEQ ID NOs. 1937 and 1942, were designed to amplify the gyrA sequence of *K. pneumoniae*, whereas PCR primer pair SEQ ID NOs. 1934 and 1935 was designed to amplify *K. pneumoniae* parC sequence. An alternative pair, SEQ ID NOs. 1935 and 1936, can also amplify *K. pneumoniae* parC. The comparison of gyrA and parC sequences from *K. pneumoniae* strains with various levels of quinolone resistance allowed the identification of amino acid substitutions Ser-83 to Tyr or Phe and Asp-87 to Gly or Ala and Asp-87 to Asn in the GyrA subunit of DNA gyrase encoded by gyrA and amino acid changes Ser-80 to Be or Arg and Glu-84 to Gly or Lys in the ParC subunit of topoisomerase IV encoded by parC. These amino acid substitutions in the GyrA and ParC subunits occur in isolates with intermediate- or high-level quinolone resistance. Internal probes for the specific detection of wild-type *K. pneumoniae* gyrA (SEQ ID NO. 1943) and wild-type *K. pneumoniae* parC (SEQ ID NO. 1944) as well as internal probes for the specific detection of each of the gyrA (SEQ ID NOs. 1945-1949) and parC mutations identified in quinolone-resistant *K. pneumoniae* (SEQ ID NOs. 1950-1953) were designed.

Two multiplex using the *K. pneumoniae* gyrA- and parC-specific primer pairs were used: the first multiplex contained *K. pneumoniae* gyrA-specific primers (SEQ ID NOs. 1937 and 1942) and *K. pneumoniae* parC-specific primers (SEQ ID NOs. 1934 and 1935) and the second multiplex contained *K. pneumoniae* gyrA/parC-specific primer (SEQ ID NOs. 1936), *K. pneumoniae* gyrA-specific primer (SEQ ID NO. 1937) and *K. pneumoniae* parC-specific primer (SEQ ID NO. 1935). Standard PCR was carried out on PTC-200 thermocyclers (MJ Research) using for the first multiplex 0.6, 0.6, 0.4, 0.4 μM of each primer, respectively, and for the second multiplex 0.8, 0.4, 0.4 μM of each primer, respectively. PCR amplification and agarose gel electrophoresis of the amplified products were performed as described in Example 28. The optimal cycling conditions for maximum sensitivity and specificity were 3 minutes at 95° C. for initial denaturation, then forty cycles of two steps consisting of 1 second at 95° C. and 30 seconds at 62° C., followed by terminal extension at 72° C. for 2 minutes. The specificity of the two multiplex assays with 40-cycle PCR was verified by using 0.1 ng of purified genomic DNA from a panel of gram-negative bacteria. The list included: *Acinetobacter baumannii, Citrobacter freundii, Eikenella corrodens, Enterobacter aerogenes, Enterobacter cancerogenes, Enterobacter cloacae, Escherichia coli* (10 strains), *Haemophilus influenzae, Klebsiella pneumoniae, Klebsiella ornitholytica, Klebsiella oxytoca* (2 strains), *Klebsiella planticola, Klebsiella terrigena, Kluyvera ascorbata, Kluyvera cryocrescens, Kluyvera georgiana, Neisseria gonorrhoeae, Proteus mirabilis, Proteus vulgaris, Pseudomonas aeruginosa, Salmonella choleraesuis* subsp. *typhimurium, Salmonella enteritidis, Serratia liquefaciens, Serratia marcescens* and *Yersinia enterocolytica*. For both multiplex, strong amplification of both gyrA and parC was observed only for the *K. pneumoniae* strain tested. The sensitivity of the two multiplex assays with 40-cycle PCR was verified with one quinolone-sensitive strain of *K. pneumoniae*. The detection limit was around 10 copies of genomic DNA.

The complete assay for the specific detection of *K. pneumoniae* and its susceptibility to quinolone contains the *Klebsiella*-specific primers (SEQ ID NOs. 1331 and 1332) described in Example 29 and either the multiplex containing the *K. pneumoniae* gyrA- and parC-specific primers (SEQ ID NOs. 1935, 1936, 1937) or the multiplex containing the *K. pneumoniae* gyrA- and parC-specific primers (SEQ ID NOs. 1934, 1937, 1939, 1942). Amplification is coupled with post-PCR hybridization with the internal probe specific to *K. pneumoniae* (SEQ ID NO. 2167) described in Example 29 and the internal probes specific to wild-type *K. pneumoniae* gyrA and parC (SEQ ID NOs. 1943, 1944) and to the *K. pneumoniae* gyrA and parC variants (SEQ ID NOs. 1945-1949 and 1950-1953).

An assay was also developed for the detection of quinolone-resistant *K. pneumoniae* using the SmartCycler (Cepheid). Real-time detection is based on the use of resistant *K. pneumoniae* gyrA-specific primers (SEQ ID NOs. 1936 and 1937) and the *K. pneumoniae*-specific primers (SEQ ID NOs. 1331 and 1332) described in Example 29. Internal probes were designed for molecular beacon detection of the wild-type *K. pneumoniae* gyrA (SEQ ID NO. 2251), for detection of the Ser-83 to Tyr or Phe and/or Asp-87 to Gly or Asn in the GyrA subunit of DNA gyrase encoded by gyrA (SEQ ID NOs. 2250) and for detection of *K. pneumoniae* (SEQ ID NO. 2281).

Example 35

Development of a PCR Assay for Detection and Identification of *S. Pneumoniae* and its Quinolone Resistance Genes gyrA and parC The analysis of gyrA and parC sequences from a variety of bacterial species revealed conserved regions allowing the design of PCR primers able to amplify the quinolone-resistance-determining region (QRDR) of gyrA and parC from all *S. pneumoniae* strains. PCR primer pair SEQ ID NOs. 2040 and 2041 was designed to amplify the QRDR of *S. pneumoniae* gyrA, whereas PCR primer pair SEQ ID NOs. 2044 and 2045 was designed to amplify the QRDR of *S. pneumoniae* parC. The comparison of gyrA and parC sequences from *S. pneumoniae* strains with various levels of quinolone resistance allowed the identification of amino acid substitutions Ser-81 to Phe or Tyr in the GyrA subunit of DNA gyrase encoded by gyrA and amino acid changes Ser-79 to Phe in the ParC subunit of topoisomerase IV encoded by parC. These amino acid substitutions in the GyrA and ParC subunits occur in isolates with intermediate- or high-level quinolone resistance. Internal probes for the specific detection of each of the gyrA (SEQ ID NOs. 2042 and 2043) and parC (SEQ ID NO. 2046) mutations identified in quinolone-resistant *S. pneumoniae* were designed.

For all bacterial species, amplification was performed from purified genomic DNA. 1 μl of genomic DNA at 0.1 ng/μL was transferred directly to a 19 μl PCR mixture. Each PCR reaction contained 50 mM KCl, 10 mM Tris-HCl (pH 9.0), 0.1% Triton X-100, 2.5 mM $MgCl_2$, 0.4 μM (each) of the above primers SEQ ID NOs. 2040, 2041, 2044 and 2045, 0.05 mM bovine serum albumin (BSA) and 0.5 U Taq polymerase coupled with TaqStart™ antibody. The optimal cycling conditions for maximum sensitivity and specificity were 3 minutes at 95° C. for initial denaturation, then forty cycles of two steps consisting of 1 second at 95° C. and 30 seconds at 58° C., followed by terminal extension at 72° C. for 2 minutes. In order to generate Digoxigenin (DIG)-labeled amplicons for capture probe hybridization, 0.1× PCR DIG labeling four deoxynucleoside triphosphates mix (Boehringer Mannheim GmbH) was used for amplification.

The DIG-labeled amplicons were hybridized to the capture probes bound to 96-well plates. The plates were incubated with anti-DIG-alkaline phosphatase and the chemiluminescence was measured by using a luminometer (MLX, Dynex Technologies Inc.) after incubation with CSPD and recorded as Relative Light Unit (RLU). The RLU ratio of tested sample with and without captures probes was then calculated. A ratio 2.0 was defined as a positive hybridization signal. All reactions were performed in duplicate.

The specificity of the multiplex assay with 40-cycle PCR was verified by using 0.1 ng of purified genomic DNA from a panel of bacteria listed in Table 13. Strong amplification of both gyrA and parC was detected only for the *S. pneumoniae* strains tested. Weak amplification of both gyrA and parC genes was detected for *Staphylococcus simulans*. The detection limit tested with purified genomic DNA from 5 strains of *S. pneumoniae* was 1 to 10 genome copies. In addition, 5 quinolone-resistant and 2 quinolone-sensitive clinical isolates of *S. pneumoniae* were tested to further validate the developed multiplex PCR coupled with capture probe hybridization assays. There was a perfect correlation between detection of *S. pneumoniae* gyrA and parC mutations and the susceptibility to quinolone.

The complete assay for the specific detection of *S. pneumoniae* and its susceptibility to quinolone contains the *S. pneumoniae*-specific primers (SEQ ID NOs. 1179 and 1181) described in Example 20 and the multiplex containing the *S. pneumoniae* gyrA-specific and parC-specific primer pairs (SEQ ID NOS. 2040 and 2041 and SEQ ID NOs. 2044 and 2045). Amplification is coupled with post-PCR hybridization with the internal probe specific to *S. pneumoniae* (SEQ ID NO. 1180) described in Example and the internal probes specific to each of the *S. pneumoniae* gyrA and parC variants (SEQ ID NOs. 2042, 2043 and 2046).

Example 36

Detection of Extended-Spectrum TEM-Type β-Lactamases in *Escherichia coli*

The analysis of TEM sequences which confer resistance to third-generation cephalosporins and to β-lactamase inhibitors allowed the identification of amino acid substitutions Met-69 to Ile or Leu or Val, Ser-130 to Gly, Arg-164 to Ser or H is, Gly-238 to Ser, Glu-240 to Lys and Arg-244 to Ser or Cys or Thr or H is or Leu. PCR primers SEQ ID NOs. 1907 and 1908 were designed to amplify TEM sequences. Internal probes for the specific detection of wild-type TEM (SEQ ID NO. 2141) and for each of the amino acid substitutions (SEQ ID NOs. 1909-1926) identified in TEM variants were designed to detect resistance to third-generation cephalosporins and to β-lactamase inhibitors. Design and synthesis of primers and probes, and detection of the hybridization were performed as described in Example 7.

For all bacterial species, amplification was performed from purified genomic DNA. One μl of genomic DNA at 0.1 ng/μl was transferred directly to a 19 μl PCR mixture. Each PCR reaction contained 50 mM KCl, 10 mM Tris-HCl (pH 9.0); 0.1% Triton X-100, 2.5 mM $MgCl_2$, 0.4 μM of the TEM-specific primers SEQ ID NOs. 1907 and 1908, 200 μM (each) of the four deoxynucleoside triphosphates, 0.05 mM bovine serum albumin (BSA) and 0.5 U Taq polymerase (Promega) coupled with TaqStart™ antibody. PCR amplification and agarose gel analysis of the amplified products were performed as described in Example 28. The optimal cycling conditions for maximum sensitivity and specificity were 3 minutes at 95° C. for initial denaturation, then forty cycles of three steps consisting of 5 seconds at 95° C., 30 seconds at 55° C. and 30 seconds at 72° C., followed by terminal extension at 72° C. for 2 minutes.

The specificity of the TEM-specific primers with 40-cycle PCR was verified by using 0.1 ng of purified genomic from the following bacteria: three third-generation cephalosporin-resistant *Escherichia coli* strains (one with TEM-10, one with TEM-28 and the other with TEM-49), two third-generation cephalosporin-sensitive *Escherichia coli* strain (one with TEM-1 and the other without TEM), one third-generation cephalosporin-resistant *Klebsiella pneumoniae* strain (with TEM-47), and one β-lactamase-inhibitor-resistant *Proteus mirabilis* strain (with TEM-39). Amplification with the TEM-specific primers was detected only for strains containing TEM.

The sensitivity of the assay with 40-cycle PCR was verified with three *E. coli* strains containing TEM-1 or TEM-10 or TEM-49, one *K. pneumoniae* strain containing TEM-47 and one *P. mirabilis* strain containing TEM-39. The detection limit was 5 to 100 copies of genomic DNA, depending on the TEM-containing strains tested.

The TEM-specific primers SEQ ID NOs. 1907 and 1908 were used in multiplex with the *Escherichia coli/Shigella* sp.-specific primers SEQ ID NOs. 1661 and 1665 described in Example 28 to allow the complete identification of *Escherichia coli/Shigella* sp. and the susceptibility to β-lactams. PCR amplification with 0.4 μM of each of the primers and agarose gel analysis of the amplified products was performed as described above.

The specificity of the multiplex with 40-cycle PCR was verified by using 0.1 ng of purified genomic DNA from the following bacteria: three third-generation cephalosporin-resistant *Escherichia coli* strains (one with TEM-10, one with TEM-28 and the other with TEM-49), two third-generation cephalosporin-sensitive *Escherichia coli* strain (one with TEM-1 and the other without TEM), one third-generation cephalosporin-resistant *Klebsiella pneumoniae* strain (with TEM-47), and one β-lactamase-inhibitor-resistant *Proteus mirabilis* strain (with TEM-39). The multiplex was highly specific to *Escherichia coli* strains containing TEM.

The complete assay for detection of TEM-type β-lactamases in *E. coli* includes PCR amplification using the multiplex containing the TEM-specific primers (SEQ ID NOs. 1907 and 1908) and the *Escherichia coli/Shigella* sp.-specific primers (SEQ ID NOs. 1661 and 1665) coupled with post PCR-hybridization with the internal probes specific to wild-type TEM (SEQ ID NO. 2141) and to the TEM variants (SEQ ID NOs. 1909-1926).

Example 37

Detection of Extended-Spectrum SHV-Type β-Lactamases in *Klebsiella pneumoniae*

The comparison of SHV sequences, which confer resistance to third-generation cephalosporins and to β-lactamase inhibitors, allowed the identification of amino acid substitutions Ser-130 to Gly, Asp-179 to Ala or Asn, Gly-238 to Ser, and Glu-240 to Lys. PCR primer pair SEQ ID NOs. 1884 and 1885 was designed to amplify SHV sequences. Internal probes for the specific identification of wild-type SHV (SEQ ID NO. 1896) and for each of the amino acid substitutions (SEQ ID NOs. 1886-1895 and 1897-1898) identified in SHV variants were designed to detect resistance to third-generation cephalosporins and to β-lactamase inhibitors. Design and synthesis of primers and probes, and detection of the hybridization were performed as described in Example 7.

For all bacterial species, amplification was performed from purified genomic DNA. One μl of genomic DNA at 0.1 ng/μl was transferred directly to a 19 μl PCR mixture. Each PCR reaction contained 50 mM KCl, 10 mM Tris-HCl (pH 9.0), 0.1% Triton X-100, 2.5 mM $MgCl_2$, 0.4 μM of the SHV-specific primers SEQ ID NO. 1884 and 1885, 200 μM (each) of the four deoxynucleoside triphosphates, 0.05 mM bovine serum albumin (BSA) and 0.5 U Taq polymerase (Promega) coupled with TaqStart™ antibody. PCR amplification and agarose gel analysis of the amplified products were performed as described in Example 28. The optimal cycling conditions for maximum sensitivity and specificity were 3 minutes at 95° C. for initial denaturation, then forty cycles of three steps consisting of 5 seconds at 95° C., 30 seconds at 55° C. and 30 seconds at 72° C., followed by terminal extension at 72° C. for 2 minutes.

The specificity of the SHV-specific primers with 40-cycle PCR was verified by using 0.1 ng of purified genomic from the following bacteria: two third-generation cephalosporin-resistant *Klebsiella pneumoniae* strains (one with SHV-2a and the other with SHV-12), one third-generation cephalosporin-sensitive *Klebsiella pneumoniae* strain (with SHV-1), two third-generation cephalosporin-resistant *Escherichia coli* strains (one with SHV-8 and the other with SHV-7), and two third-generation cephalosporin-sensitive *Escherichia coli* strains (one with SHV-1 and the other without any SHV). Amplification with the SHV-specific primers was detected only for strains containing SHV.

The sensitivity of the assay with 40-cycle PCR was verified with four strains containing SHV. The detection limit was 10 to 100 copies of genomic DNA, depending on the SHV-containing strains tested.

The amplification was coupled with post-PCR hybridization with the internal probes specific for identification of wild-type SHV (SEQ ID NO. 1896) and for each of the amino acid substitutions (SEQ ID NOs. 1886-1895 and 1897-1898) identified in SHV variants. The specificity of the probes was verified with six strains containing various SHV enzymes, one *Klebsiella pneumoniae* strain containing SHV-1, one *Klebsiella pneumoniae* strain containing SHV-2a, one *Klebsiella pneumoniae* strain containing SHV-12, one *Escherichia coli* strain containing SHV-1, one *Escherichia coli* strain containing SHV-7 and one *Escherichia coli* strain containing SHV-8. The probes correctly detected each of the SHV genes and their specific mutations. There was a perfect correlation between the SHV genotype of the strains and the susceptibility to β-lactam antibiotics.

The SHV-specific primers SEQ ID NOs. 1884 and 1885 were used in multiplex with the *K. pneumoniae*-specific primers SEQ ID NOs. 1331 and 1332 described in Example 29 to allow the complete identification of *K. pneumoniae* and the susceptibility to β-lactams. PCR amplification with 0.4 μM of each of the primers and agarose gel analysis of the amplified products were performed as described above.

The specificity of the multiplex with 40-cycle PCR was verified by using 0.1 ng of purified genomic DNA from the following bacteria: three *K. pneumoniae* strains containing SHV-1, one *Klebsiella pneumoniae* strain containing SHV-2a, one *Klebsiella pneumoniae* strain containing SHV-12, one *K. rhinoscleromatis* strain containing SHV-1, one *Escherichia coli* strain without SHV. The multiplex was highly specific to *Klebsiella pneumoniae* strain containing SHV.

Example 38

Development of a PCR Assay for the Detection and Identification of *Neisseria Gonorrhoeae* and its Associated Tetracycline Resistance Gene tetM The analysis of publicly available tetM sequences revealed conserved regions allowing the design of PCR primers specific to tetM sequences. The PCR primer pair SEQ ID NOs. 1588 and 1589 was used in multiplex with the *Neisseria gonorrhoeae*-specific primers SEQ ID NOs. 551 and 552 described in Example 31. Sequence alignment analysis of tetM sequences revealed regions suitable for the design of an internal probe specific to tetM (SEQ ID NO. 2254). PCR amplification was carried out on PTC-200 thermocyclers (MJ Research) using 0.4 μM of each primer pair as described in Example 28. The optimal cycling conditions for maximum sensitivity and specificity were as follow: three minutes at 95° C. for initial denaturation, then forty cycles of two steps consisting of 1 second at 95° C. and 30 seconds at 60° C., followed by terminal extension at 72° C. for 2 minutes.

The specificity of the multiplex PCR assay with 40-cycle PCR was verified by using 0.1 ng of purified genomic DNA from the following bacteria: two tetracycline-resistant *Escherichia coli* strains (one containing the tetracycline-resistant gene tetB and the other containing the tetracycline-resistant gene tetC), one tetracycline-resistant *Pseudomonas aeruginosa* strain (containing the tetracycline-resistant gene tetA), nine tetracycline-resistant *Neisseria gonorrhoeae* strains, two tetracycline-sensitive *Neisseria meningitidis* strains, one tetracycline-sensitive *Neisseria* polysaccharea strain, one tetracycline-sensitive *Neisseria sicca* strain and one tetracycline-sensitive *Neisseria subflava* strain. Amplification with both the tetM-specific and *Neisseria gonorrhoeae*-specific primers was detected only for *N. gonorrhoeae* strains containing tetM. There was a weak amplification signal using *Neisseria gonorrhoeae*-specific primers for the following species: *Neisseria sicca, Neisseria polysaccharea* and *Neisseria meningitidis*. There was a perfect correlation between the tetM genotype and the tetracycline susceptibility pattern of the *Neisseria gonorrhoeae* strains tested. The internal probe specific to *N. gonorrhoeae* SEQ ID NO. 2166 described in Example 31 can discriminate *Neisseria gonorrhoeae* from the other *Neisseria* sp.

The sensitivity of the assay with 40-cycle PCR was verified with two tetracycline resistant strains of *N. gonorrhoeae*. The detection limit was 5 copies of genomic DNA for both strains.

Example 39

Development of a PCR Assay for the Detection and Identification of *Shigella* Sp. and Their Associated Trimethoprim Resistance Gene dhfrIa The analysis of publicly available dhfrIa and other dhfr sequences revealed regions allowing the design of PCR primers specific to dhfrIa sequences. The PCR primer pair (SEQ ID NOs. 1459 and 1460) was used in multiplex with the *Escherichia coli/Shigella* sp.-specific primers SEQ ID NOs. 1661 and 1665 described in Example 28. Sequence alignment analysis of dhfrIa sequences revealed regions suitable for the design of an internal probe specific to dhfrIa (SEQ ID NO. 2253). PCR amplification and agarose gel analysis of the amplified products were performed as described in Example 28 with an annealing temperature of 60° C. The specificity of the multiplex assay with 40-cycle PCR was verified by using 0.1 ng of purified genomic DNA from a panel of bacteria. The list included the following trimethoprim-sensitive strains, *Salmonella typhimyurium, Salmonella typhi, Salmonella enteritidis, Tatumella ptyseos, Klebsiella pneumoniae, Enterobacter aerogenes, Citrobacter farmeri, Campylobacter jejuni, Serratia marcescens, Shigella dysenteriae, Shigella flexneri, Shigella sonnei*, six trimethoprim-resistant *Escherichia coli* strains (containing dhfrIa or dhfrV or dhfrVII or dhfrXII or dhfrXIII or dhfrXV), four trimethoprim-resistant strains containing dhfrIa (*Shigella sonnei, Shigella flexneri, Shigella dysenteriae* and *Escherichia coli*). There was a perfect correlation between the dhfrIa genotype and the trimethoprim susceptibility pattern of the *Escherichia coli* and *Shigella* sp. strains tested. The dhfrIa primers were specific to the dhfrIa gene and did not amplify any of the other trimethoprim-resistant dhfr genes tested. The sensitivity of the multiplex assay with 40-cycle PCR was verified with three strains of trimethoprim-resistant strains of *Shigella* sp. The detection limit was 5 to 10 genome copies of DNA, depending on the *Shigella* sp. strains tested.

Example 40

Development of a PCR Assay for the Detection and Identification of *Acinetobacter baumannii* and its Associated Aminoglycoside Resistance Gene pph(3')-VIa The comparison of publicly available aph(3')-VIa sequence revealed regions allowing the design of PCR primers specific to aph(3')-VIa. The PCR primer pair (SEQ ID NOs. 1404 and 1405) was used in multiplex with the *Acinetobacter* baumannii-specific primers SEQ ID NOs. 1692 and 1693 described in Example 30. Analysis of the aph(3')-VIa sequence revealed region suitable for the design of an internal probe specific to aph(3')-VIa (SEQ ID NO. 2252). PCR amplification and agarose gel analysis of the amplified products were performed as described in Example 28. The specificity of the multiplex assay with 40-cycle PCR was verified by using 0.1 ng of purified genomic DNA from a panel of bacteria including: two aminoglycoside-resistant *A. baumanni* strains (containing aph(3')-VIa), one aminoglycoside-sensitive *A. baumani* strain, one of each of the following aminoglycoside-resistant bacteria, one *Serratia marcescens* strain containing the aminoglycoside-resistant gene aacC1, one *Serratia marcescens* strain containing the aminoglycoside-resistant gene aacC4, one *Enterobacter cloacae* strain containing the aminoglycoside-resistant gene aacC2, one *Enterococcus faecalis* containing the aminoglycoside-resistant gene aacA-aphD, one *Pseudomonas aeruginosa* strain containing the aminoglycoside-resistant gene aac6IIa and one of each of the following aminoglycoside-sensitive bacterial species, *Acinetobacter anitratus, Acinetobacter lwoffi, Psychobbacter phenylpyruvian, Neisseria gonorrhoeae, Haemophilus haemolyticus, Haemophilus influenzae, Yersinia enterolitica, Proteus vulgaris, Eikenella corrodens, Escherichia coli*. There was a perfect correlation between the aph(3')-VIa genotype and the aminoglycoside susuceptibility pattern of the *A. baumannii* strains tested. The aph(3')-VIa-specific primers were specific to the aph(3')-VIa gene and did not amplify any of the other aminoglycoside-resistant genes tested. The sensitivity of the multiplex assay with 40-cycle PCR was verified with two strains of aminoglycoside-resistant strains of *A. baumannii*. The detection limit was 5 genome copies of DNA for both *A. baumannii* strains tested.

Example 41

Specific Identification of *Bacteroides fragilis* Using atpD (V-Type) Sequences The comparison of atpD (V-type) sequences from a variety of bacterial species allowed the selection of PCR primers for *Bacteroides fragilis*. The strategy used to design the PCR primers was based on the analysis of a multiple sequence alignment of various atpD sequences from *B. fragilis*, as well as atpD sequences from the related species *B. dispar*, bacterial genera and archaea, especially representatives with phylogenetically related atpD sequences. A careful analysis of this alignment allowed the selection of oligonucleotide sequences which are conserved within the target species but which discriminate sequences from other species, especially from closely related species *B. dispar*, thereby permitting the species-specific and ubiquitous detection and identification of the target bacterial species.

The chosen primer pair, SEQ ID NOs. 2134-2135, produces an amplification product of 231 bp. Standard PCR was carried out on PTC-200 thermocyclers (MJ Research Inc.) using 0.4 μM of each primers pair as described in Example 28. The optimal cycling conditions for maximum sensitivity and specificity were as follows: three minutes at 95° C. for initial denaturation, then forty cycles of two steps consisting of 1 second at 95° C. and 30 seconds at 60° C., followed by terminal extension at 72° C. for 2 minutes.

The format of this assay is not limited to the one described above. A person skilled in the art could adapt the assay for different formats such as PCR with real-time detection using molecular beacon probes. Molecular beacon probes designed to be used in this assay include, but are not limited to, SEQ ID NO. 2136 for the detection of the *B. fragilis* amplicon.

Example 42

Evidence for Horizontal Gene Transfer in the Evolution of the Elongation Factor Tu in Enterococci Overview The elongation factor Tu, encoded by tuf genes, is a GTP binding protein that plays a central role in protein synthesis. One to three tuf genes per genome are present depending on the bacterial species. Most low G+C gram-positive bacteria carry only one tuf gene. We have designed degenerate PCR primers derived from consensus sequences of the tuf gene to amplify partial tuf sequences from 17 enterococcal species and other phylogenetically related species. The amplified DNA fragments were sequenced either by direct sequencing or by sequencing cloned inserts containing putative amplicons. Two different tuf genes (tufA and tufB) were found in 11 enterococcal species, including *Enterococcus avium, E. casseliflavus, E. dispar, E. durans, E. faecium, E. gallinarum, E. hirae, E. malodoratus, E. mundtii, E. pseudoavium*, and *E. raffinosus*. For the other six enterococcal species (*E. cecorum, E. columbae, E. faecalis, E. sulfureus, E. saccharolyticus*, and *E. solitarius*), only the tufA gene was present. Based on 16S rRNA gene sequence analysis, the 11 species having two tuf genes all share a common ancestor, while the six species having only one copy diverged from the enterococcal lineage before that common ancestor. The presence of one or two copies of the tuf gene in enterococci was confirmed by Southern hybridization. Phylogenetic analysis of tuf sequences demonstrated that the enterococcal tufA gene branches with the *Bacillus, Listeria* and *Staphylococcus* genera, while the enterococcal tufB gene clusters with the genera *Streptococcus* and *Lactococcus*. Primary structure analysis showed that four amino acid residues within the sequenced regions are conserved and unique to the enterococcal tufB genes and the tuf genes of streptococci and *L. lactis*. The data suggest that an ancestral *streptococcus* or a *streptococcus*-related species may have horizontally transferred a tuf gene to the common ancestor of the 11 enterococcal species which now carry two tuf genes.

Introduction

The elongation factor Tu (EF-Tu) is a GTP binding protein playing a central role in protein synthesis. It mediates the recognition and transport of aminoacyl-tRNAs and their positioning to the A-site of the ribosome. The highly conserved function and ubiquitous distribution render the elongation factor a valuable phylogenetic marker among eubacteria and even throughout the archaebacterial and eukaryotic kingdoms. The tuf genes encoding elongation factor Tu are present in various copy numbers per bacterial genome. Most gram-negative bacteria contain two tuf genes. As found in *Escherichia coli*, the two genes, while being almost identical in sequence, are located in different parts of the bacterial chromosome. However, recently completed microbial genomes revealed that only one tuf gene is found in *Helicobacter pylori* as well as in some obligate parasitic bacteria, such as *Borrelia burgdorferi, Rickettsia prowazekii*, and *Treponema pallidum*, and in some cyanobacteria. In most gram-positive bacteria studied so far, only one tuf gene was found. However, Southern hybridization showed that there are two tuf genes in some clostridia as well as in *Streptomyces coelicolor* and *S. lividans*. Up to three tuf-like genes have been identified in *S. ramocissimus*.

Although massive prokaryotic gene transfer is suggested to be one of the factors responsible for the evolution of bacterial genomes, the genes encoding components of the translation machinery are thought to be highly conserved and difficult to be transferred horizontally due to the complexity of their interactions. However, a few recent studies demonstrated evidence that horizontal gene transfer has also occurred in the evolution of some genes coding for the translation apparatus, namely, 16S rRNA and some aminoacyl-tRNA synthetases. No further data suggest that such a mechanism is involved in the evolution of the elongation factors. Previous studies concluded that the two copies of tuf genes in the genomes of some bacteria resulted from an ancient event of gene duplication. Moreover, a study of the tuf gene in *R. prowazekii* suggested that intrachromosomal recombination has taken place in the evolution of the genome of this organism.

To date, little is known about the tuf genes of enterococcal species. In this study, we analyzed partial sequences of tuf genes in 17 enterococcal species, namely, *E. avium, E. casseliflavus, E. cecorum, E. columbae, E. dispar, E. durans, E. faecalis, E. faecium, E. gallinarum, E. hirae, E. malodoratus, E. mundtii, E. pseudoavium, E. raffinosus, E. saccharolyticus, E. solitarius*, and *E. sulfureus*. We report here the presence of two divergent copies of tuf genes in 11 of these enterococcal species. The 6 other species carried a single tuf gene. The evolutionary implications are discussed.

Materials and Methods

Bacterial Strains.

Seventeen enterococcal strains and other gram-positive bacterial strains obtained from the American Type Culture Collection (ATCC, Manassas, Va.) were used in this study (Table 16). All strains were grown on sheep blood agar or in brain-heart infusion broth prior to DNA isolation.

DNA Isolation.

Bacterial DNAs were prepared using the G NOME DNA extraction kit (Bio101, Vista, Calif.) as previously described.

Sequencing of Putative tuf Genes.

In order to obtain the tuf gene sequences of enterococci and other gram-positive bacteria, two sequencing approaches were used: 1) sequencing of cloned PCR products and 2) direct sequencing of PCR products. A pair of degenerate primers (SEQ ID NOs. 664 and 697) were used to amplify an 886-bp portion of the tuf genes from enterococcal species and other gram-positive bacteria as previously described. For *E. avium, E. casseliflavus, E. dispar, E. durans, E. faecium, E. gallinarum, E. hirae, E. mundtii, E. pseudoavium*, and *E. raffinosus*, the amplicons were cloned using the Original TA cloning kit (Invitrogen, Carlsbad, Calif.) as previously described. Five clones for each species were selected for sequencing. For *E. cecorum, E. faecalis, E. saccharolyticus*, and *E. solitarius* as well as the other gram-positive bacteria, the sequences of the 886-bp amplicons were obtained by direct sequencing. Based on the results obtained from the earlier rounds of sequencing, two pairs of primers were designed for obtaining the partial tuf sequences from the other enterococcal species by direct sequencing. One pair of primers (SEQ ID NOs. 543 and 660) were used to amplify the enterococcal tuf gene fragments from *E. columbae, E. malodoratus*, and *E. sulfureus*. Another pair of primers (SEQ ID NOs. 664 and 661) were used to amplify the second tuf gene fragments from *E. avium, E. malodoratus*, and *E. pseudoavium.*

Prior to direct sequencing, PCR products were electrophoresed on 1% agarose gel at 120V for 2 hours. The gel was then stained with 0.02% methylene blue for 30 minutes and washed twice with autoclaved distilled water for 15 minutes. The gel slices containing PCR products of the expected sizes were cut out and purified with the QIAquick gel extraction kit (QJAgen Inc., Mississauga, Ontario, Canada) according to the manufacturer's instructions. PCR mixtures for sequencing were prepared as described previously. DNA sequencing was carried out with the Big Dye™ Terminator Ready Reaction cycle sequencing kit using a 377 DNA sequencer (PE Applied Biosystems, Foster City, Calif.). Both strands of the amplified DNA were sequenced. The sequence data were verified using the Sequencer™ 3.0 software (Gene Codes Corp., Ann Arbor, Mich.).

Sequence Analysis and Phylogenetic Study.

Nucleotide sequences of the tuf genes and their respective flanking regions for *E. faecalis, Staphylococcus aureus*, and *Streptococcus pneumoniae*, were retrieved from the TIGR microbial genome database and S. pyo genes from the University of Oklahoma database. DNA sequences and deduced protein sequences obtained in this study were compared with those in all publicly available databases using the BLAST and FASTA programs. Unless specified, sequence analysis was conducted with the programs from GCG package (Version 10; Genetics Computer Group, Madison, Wis.). Sequence alignment of the tuf genes from 74 species representing all three kingdoms of life (Tables 16 and 17) were carried out by use of Pileup and corrected upon visual analysis. The N- and C-termini extremities of the sequences were trimmed to yield a common block of 201 amino acids sequences and equivocal residues were removed. Phylogenetic analysis was performed with the aid of PAUP 4.0b4 written by Dr. David L. Swofford (Sinauer Associates, Inc., Publishers, Sunderland, Mass.). The distance matrix and maximum parsimony were used to generate phylogenetic trees and bootstrap resampling procedures were performed using 500 and 100 replications in each analysis, respectively.

Protein Structure Analysis.

The crystal structures of (i)*Thermus aquaticus* EF-Tu in complex with Phe-tRNA$^{Phe}$ and a GTP analog and (ii) *E. coli* EF-Tu in complex with GDP served as templates for constructing the equivalent models for enterococcal EF-Tu. Homology modeling of protein structure was performed using the SWISS-MODEL server and inspected using the SWISS-PDB viewer version 3.1.

Southern Hybridization.

In a previous study, we amplified and cloned an 803-bp PCR product of the tuf gene fragment from *E. faecium*. Two divergent sequences of the inserts, which we assumed to be tufA and tufB genes, were obtained. The recombinant plasmid carrying either tufA or tufB sequence was used to generate two probes labeled with Digoxigenin (DIG)-11-dUTP by PCR incorporation following the instructions of the manufacturer (Boehringer Mannheim, Laval, Québec, Canada). Enterococcal genomic DNA samples (1-2 μg) were digested to completion with restriction endonucleases BglII and XbaI as recommended by the supplier (Amersham Pharmacia Biotech, Mississauga, Ontario, Canada). These restriction enzymes were chosen because no restriction sites were observed within the amplified tuf gene fragments of most enterococci. Southern blotting and filter hybridization were performed using positively charged nylon membranes (Boehringer Mannheim) and QuikHyb hybridization solution (Stratagene Cloning Systems, La Jolla, Calif.) according to the manufacturers' instructions with modifications. Twenty μl of each digestion were electrophoresed for 2 h at 120V on a 0.8% agarose gel. The DNA fragments were denatured with 0.5 M NaOH and transferred by Southern blotting onto a positively charged nylon membrane (Boehringer Mannheim). The filters were pre-hybridized for 15 min and then hybridized for 2 h in the QuikHyb solution at 68° C. with either DIG-labeled probe. Posthybridization washings were performed twice with 0.5×SSC, 1% SDS at room temperature for 15 min and twice in the same solution at 60° C. for 15 min. Detection of bound probes was achieved using disodium 3-(4-methoxyspiro(1,2-dioxetane-3,2'-(5'-chloro)tricyclo(3,3.1.1$^{3.7}$) decan)-4-yl) phenyl phosphate (CSPD) (Boehringer Mannheim) as specified by the manufacturer.

GenBank Submission.

The GenBank accession numbers for partial tuf gene sequences generated in this study are given in Table 16.

Results

Sequencing and nucleotide sequence analysis. In this study, all gram-positive bacteria other than enterococci yielded a single tuf sequence of 886 bp using primers SEQ ID NOs. 664 and 697 (Table 16). Each of four enterococcal species including E. cecorum, *E. faecalis, E. saccharolyticus*, and *E. solitarius* also yielded one 886-bp tuf sequence. On the other hand, for *E. avium, E. casseliflavus, E. dispar, E. durans, E. faecium, E. gallinarum, E. hirae, E. mundtii, E. pseudoavium*, and *E. raffinosus*, direct sequencing of the 886-bp fragments revealed overlapping peaks according to their sequence chromatograms, suggesting the presence of additional copies of the tuf gene. Therefore, the tuf gene fragments of these 10 species were cloned first and then sequenced. Sequencing data revealed that two different types of tuf sequences (tufA and tufB) are found in eight of these species including *E. casseliflavus, E. dispar, E. durans, E. faecium, E. gallinarum, E. hirae, E. mundtii*, and *E. raffinosus*. Five clones from *E. avium* and *E. pseudoavium* yielded only a single tuf sequence. These new sequence data allowed the design of new primers specific for the enterococcal tufA or tufB sequences. Primers SEQ ID NOs. 543 and 660 were designed to amplify only enterococcal tufA sequences and a 694-bp fragment was amplified from all 17 enterococcal species. The 694-bp sequences of tufA genes from *E. columbae, E. malodoratus*, and *E. sulfureus* were obtained by direct sequencing using these primers. Primers SEQ ID NOs. 664 and 661 were designed for the amplification of 730-bp portion of tufB genes and yielded the expected fragments from 11 enterococcal species, including *E. malodoratus* and the 10 enterococcal species in which heterogeneous tuf sequences were initially found. The sequences of the tufB fragments for *E. avium, E. malodoratus* and *E. pseudoavium* were determined by direct sequencing using the primers SEQ ID NOs. 664 and 661. Overall, tufA gene fragments were obtained from all 17 enterococcal species but tufB gene fragments were obtained with only 11 enterococcal species (Table 16).

The identities between tufA and tufB for each enterococcal species were 68-79% at the nucleotide level and 81 to 89% at the amino acid level. The tufA gene is highly conserved among all enterococcal species with identities varying from 87% to 99% for DNA and 93% to 99% for amino acid sequences, while the identities among tufB genes of enterococci varies from 77% to 92% for DNA and 91% to 99% for amino acid sequences, indicating their different origins and evolution (Table 18). Since *E. solitarius* has been transferred to the genus *Tetragenococcus*, which is also a low G+C gram-positive bacterium, our sequence comparison did not include this species as an *enterococcus*. G+C content of enterococcal tufA sequences ranged from 40.8% to 43.1%, while that of enterococcal tufB sequences varied from 37.8% to 46.3%. Based on amino acid sequence comparison, the enterococcal tufA gene products share higher identities with those of *Abiotrophia adiacens, Bacillus subtilis, Listeria monocytogenes, S. aureus*, and *S. epidermidis*. On the other hand, the enterococcal tufB gene products share higher percentages of amino acid identity with the tuf genes of *S. pneumoniae, S. pyogenes* and *Lactococcus lactis* (Table 18).

Figure 4:
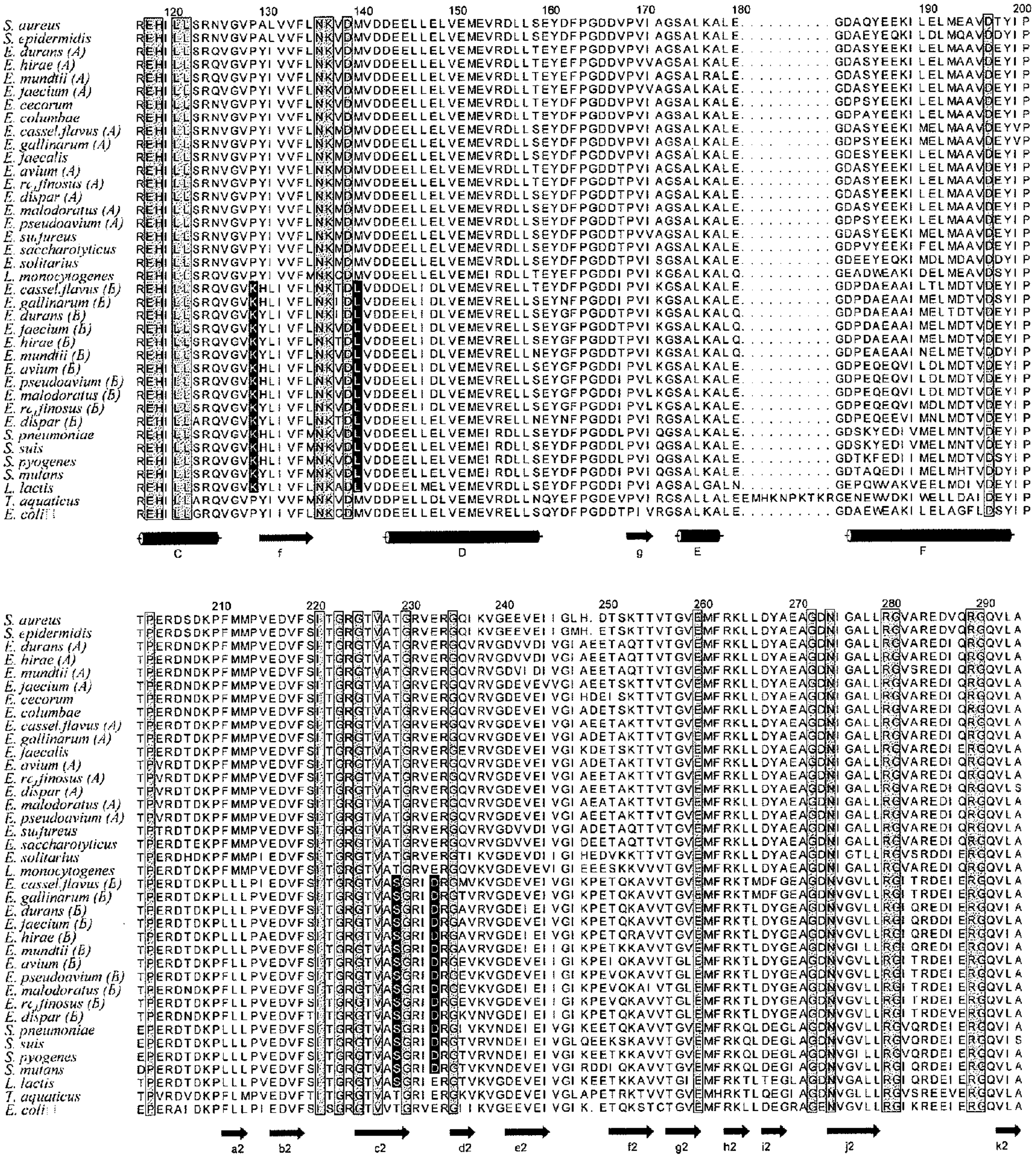

In order to elucidate whether the two enterococcal tuf sequences encode genuine EF-Tu, the deduced amino acid sequences of both genes were aligned with other EF-Tu sequences available in SWISSPROT (Release 38). Sequence alignment demonstrated that both gene products are highly conserved and carry all conserved residues present in this portion of prokaryotic EF-Tu (FIG. 4). Therefore, it appears that both gene products could fulfill the function of EF-Tu. The partial tuf gene sequences encode the portion of EF-Tu from residues 117 to 317, numbered as in *E. coli*. This portion makes up of the last four cc helices and two β-strands of domain I, the entire domain II and the N-terminal part of domain III on the basis of the determined structures of *E. coli* EF-Tu.

Based on the deduced amino acid sequences, the enterococcal tufB genes have unique conserved residues Lys129, Leu140, Ser230, and Asp234 (*E. coli* numbering) that are also conserved in streptococci and *L. lactis*, but not in the other bacteria (FIG. 4). All these residues are located in loops except for Ser230. In other bacteria the residue Ser230 is substituted for highly conserved Thr, which is the 5$^{th}$ residue of the third β-strand of domain II. This region is partially responsible for the interaction between the EF-Tu and aminoacyl-tRNA by the formation of a deep pocket for any of the 20 naturally occurring amino acids. According to our three-dimensional model (data not illustrated), the substitution Thr230→Ser in domain II of EF-Tu may have little impact on the capability of the pocket to accommodate any amino acid. However, the high conservation of Thr230 comparing to the unique Ser substitution found only in streptococci and 11 enterococci could suggest a subtle functional role for this residue.

The tuf gene sequences obtained for *E. faecalis, S. aureus, S. pneumoniae* and *S. pyogenes* were compared with their respective incomplete genome sequence. Contigs with more than 99% identity were identified. Analysis of the *E. faecalis* genome data revealed that the single *E. faecalis* tuf gene is located within an str operon where tuf is preceded by fus that encodes the elongation factor G. This str operon is present in *S. aureus* and *B. subtilis* but not in the two streptococcal genomes examined. The 700-bp or so sequence upstream the *S. pneumoniae* tuf gene has no homology with any known gene sequences. In *S. pyogenes*, the gene upstream of tuf is similar to a cell division gene, ftsW, suggesting that the tuf genes in streptococci are not arranged in a str operon.

Phylogenetic Analysis.

Figure 5:
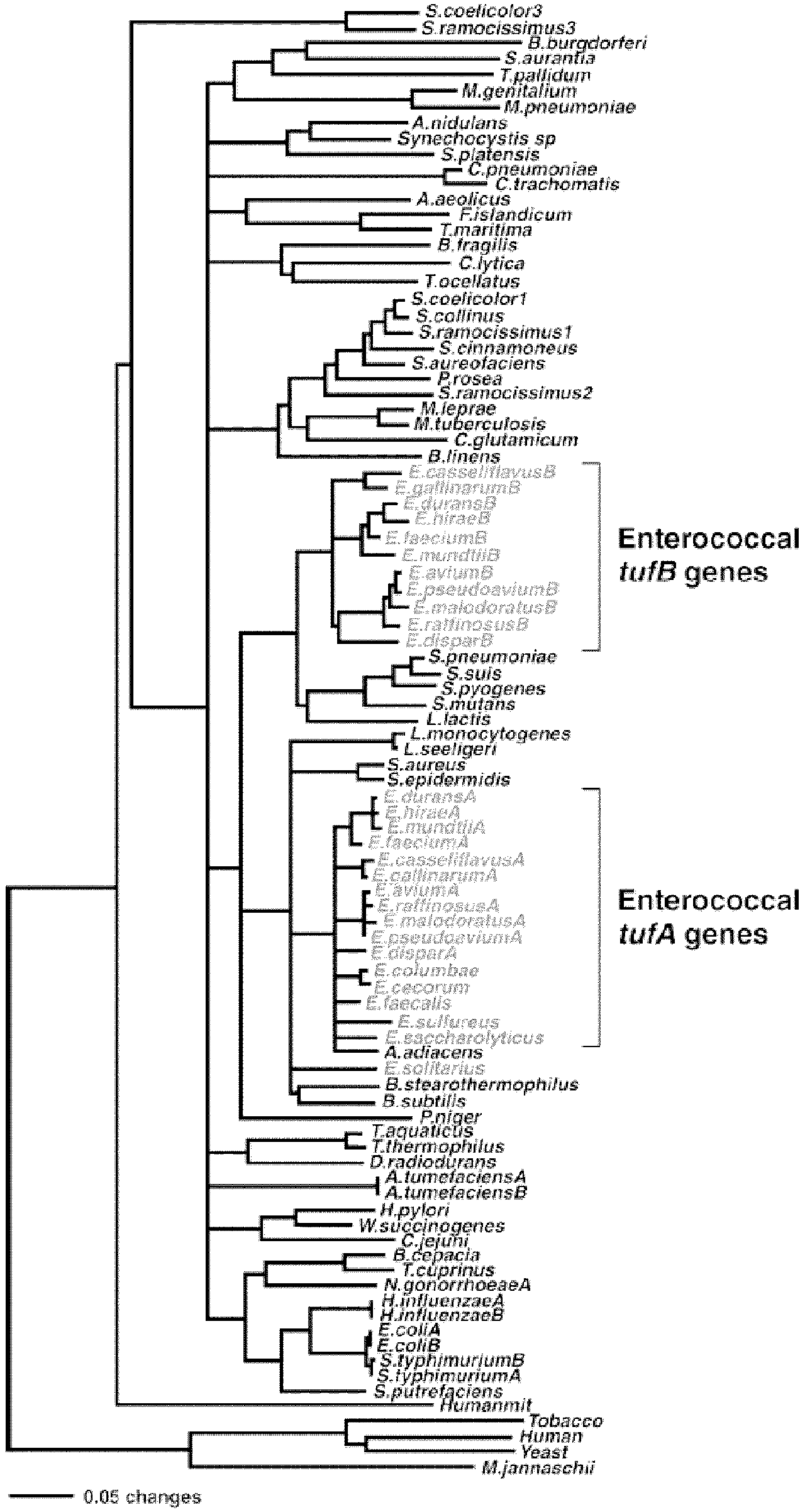

Phylogenetic analysis of the tuf amino acid sequences with representatives of eubacteria, archeabacteria, and eukaryotes using neighbor-joining and maximum parsimony methods showed three major clusters representing the three kingdoms of life. Both methods gave similar topologies consistent with the rRNA gene data (data not shown). Within the bacterial Glade, the tree is polyphyletic but tufA genes from all enterococcal species always clustered with those from other low G+C gram-positive bacteria (except for streptococci and lactococci), while the tufB genes of the 11 enterococcal species form a distinct cluster with streptococci and *L. lactis* (FIG. 5). Duplicated genes from the same organism do not cluster together, thereby not suggesting evolution by recent gene duplication.

Southern Hybridization.

Figure 6:
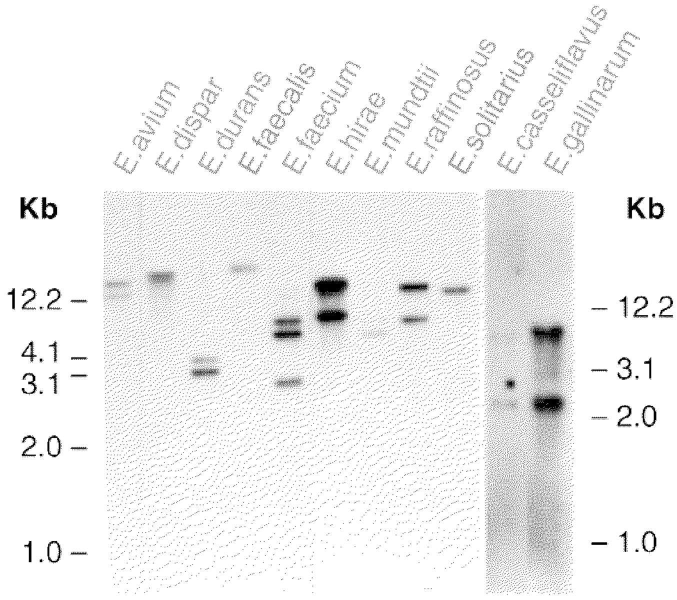

Southern hybridization of BglII/XbaI digested genomic DNA from 12 enterococcal species tested with the tufA probe (DIG-labeled tufA fragment from *E. faecium*) yielded two bands of different sizes in 9 species, which also carried two divergent tuf sequences according to their sequencing data. For *E. faecalis* and *E. solitarius*, a single band was observed indicating that one tuf gene is present (FIG. 6). A single band was also found when digested genomic DNA from *S. aureus, S. pneumoniae*, and *S. pyogenes* were hybridized with the tufA probe (data not shown). For *E. faecium*, the presence of three bands can be explained by the existence of a XbaI restriction site in the middle of the tufA sequence, which was confirmed by sequencing data. Hybridization with the tufB probe (DIG-labeled tufB fragment of *E. faecium*) showed a banding profile similar to the one obtained with the tufA probe (data not shown).

Discussion

In this study, we have shown that two divergent copies of genes encoding the elongation factor Tu are present in some enterococcal species. Sequence data revealed that both genes are highly conserved at the amino acid level. One copy (tufA) is present in all enterococcal species, while the other (tufB) is present only in 11 of the 17 enterococcal species studied. Based on 16S rRNA sequence analysis, these 11 species are members of three different enterococcal subgroups (*E. avium, E. faecium*, and *E. gallinarum* species groups) and a distinct species (E. dispar). Moreover, 16S rDNA phylogeny suggests that these 11 species possessing 2 tuf genes all share a common ancestor before they further evolved to become the modern species. Since the six other species having only one copy diverged from the enterococcal lineage before that common ancestor, it appears that the presence of one tuf gene in these six species is not attributable to gene loss.

Two clusters of low G+C gram-positive bacteria were observed in the phylogenetic tree of the tuf genes: one contains a majority of low G+C gram-positive bacteria and the other contains lactococci and streptococci. This is similar to the finding on the basis of phylogenetic analysis of the 16S rRNA gene and the hrcA gene coding for a unique heat-shock regulatory protein. The enterococcal tufA genes branched with most of the low G+C gram-positive bacteria, suggesting that they originated from a common ancestor. On the other hand, the enterococcal tufB genes branched with the genera *Streptococcus* and *Lactococcus* that form a distinct lineage separated from other low G+C gram-positive bacteria (FIG. 5). The finding that these EF-Tu proteins share some conserved amino acid residues unique to this branch also supports the idea that they may share a common ancestor. Although these conserved residues might result from convergent evolution upon a specialized function, such convergence at the sequence level, even for a few residues, seems to be rare, making it an unlikely event. Moreover, no currently known selective pressure, if any, would account for keeping one versus two tuf genes in bacteria. The G+C contents of enterococcal tufA and tufB sequences are similar, indicating that they both originated from low G+C gram-positive bacteria, in accordance with the phylogenetic analysis.

The tuf genes are present in various copy numbers in different bacteria. Furthermore, the two tuf genes are normally associated with characteristic flanking genes. The two tuf gene copies commonly encountered within gram-negative bacteria are part of the bacterial str operon and tRNA-tufB operon, respectively. The arrangement of tufA in the str operon was also found in a variety of bacteria, including *Thermotoga maritima*, the most ancient bacteria sequenced so far, *Aquifex aeolicus*, cyanobacteria, *Bacillus* sp., *Micrococcus luteus, Mycobacterium tuberculosis*, and *Streptomyces* sp. Furthermore, the tRNA-tufB operon has also been identified in *Aquifex aeolicus, Thermus thermophilus*, and *Chlamydia trachomatis*. The two widespread tuf gene arrangements argue in favor of their ancient origins. It is noteworthy that most obligate intracellular parasites, such as *Mycoplasma* sp., *R. prowazekii, B. burgdorferi*, and *T. pallidum*, contain only one tuf gene. Their flanking sequences are distinct from the two conserved patterns as a result of selection for effective propagation by an extensive reduction in genome size by intragenomic recombination and rearrangement.

Most gram-positive bacteria with low G+C content sequenced to date contain only a single copy of the tuf gene as a part of the str operon. This is the case for *B. subtilis, S. aureus* and *E. faecalis*. PCR amplification using a primer targeting a conserved region of the fus gene and the tufA-specific primer SEQ ID NO. 660, but not the tufB-specific primer SEQ ID NO. 661, yielded the expected amplicons for all 17 enterococcal species tested, indicating the presence of the fus-tuf organization in all enterococci (data not shown). However, in the genomes of *S. pneumoniae* and *S. pyogenes*, the sequences flanking the tuf genes varies although the tuf gene itself remains highly conserved. The enterococcal tufB genes are clustered with streptococci, but at present we do not have enough data to identify the genes flanking the enterococcal tufB genes. Furthermore, the functional role of the enterococcal tufB genes remains unknown. One can only postulate that the two divergent gene copies are expressed under different conditions.

The amino acid sequence identities between the enterococcal tufA and tufB genes are lower than either i) those between the enterococcal tufA and the tuf genes from other low G+C gram-positive bacteria (streptococci and lactococci excluded) or ii) those between the enterococcal tufB and streptococcal and lactococcal tuf genes. These findings suggest that the enterococcal tufA genes share a common ancestor with other low G+C gram-positive bacteria via the simple scheme of vertical evolution, while the enterococcal tufB genes are more closely related to those of streptococci and lactococci. The facts that some enterococci possess an additional tuf gene and that the single streptococcal tuf gene is not clustered with other low G+C gram-positive bacteria cannot be explained by the mechanism of gene duplication or intrachromosomal recombination. According to sequence and phylogenetic analysis, we propose that the presence of the additional copy of the tuf genes in 11 enterococcal species is due to horizontal gene transfer. The common ancestor of the 11 enterococcal species now carrying tufB genes acquired a tuf gene from an ancestral *streptococcus* or a *streptococcus*-related species during enterococcal evolution through gene transfer before the diversification of modern enterococci. Further study of the flanking regions of the gene may provide more clues for the origin and function of this gene in enterococci.

Recent studies of genes and genomes have demonstrated that considerable horizontal transfer occurred in the evolution of aminoacyl-tRNA synthetases in all three kingdoms of life. The heterogeneity of 16S rRNA is also attributable to horizontal gene transfer in some bacteria, such as *Streptomyces, Thermomonospora chromogena* and *Mycobacterium* celatum. In this study, we provide the first example in support of a likely horizontal transfer of the tuf gene encoding the elongation factor Tu. This may be an exception since stringent functional constraints do not allow for frequent horizontal transfer of the tuf gene as with other genes. However, enterococcal tuf genes should not be the only such exception as we have noticed that the phylogeny of *Streptomyces* tuf genes is equally or more complex than that of enterococci. For example, the three tuf-like genes in a high G+C gram-positive bacterium, *S. ramocissimus*, branched with the tuf genes of phylogenetically divergent groups of bacteria (FIG. 5). Another example may be the tuf genes in clostridia, which represent a phylogenetically very broad range of organisms and form a plethora of lines and groups of various complexities and depths. Four species belonging to three different clusters within the genus *Clostridium* have been shown by Southern hybridization to carry two copies of the tuf gene. Further sequence data and phylogenetic analysis may help interpreting the evolution of the elongation factor Tu in these gram-positive bacteria. Since the tuf genes and 16S rRNA genes are often used for phylogenetic study, the existence of duplicate genes originating from horizontal gene transfer may alter the phylogeny of microorganisms when the laterally acquired copy of the gene is used for such analysis. Hence, caution should be taken in interpreting phylogenetic data. In addition, the two tuf genes in enterococci have evolved separately and are distantly related to each other phylogenetically. The enterococcal tufB genes are less conserved and unique to the 11 enterococcal species only. We previously demonstrated that the enterococcal tufA genes could serve as a target to develop a DNA-based assay for identification of enterococci. The enterococcal tufB genes would also be useful in identification of these 11 enterococcal species.

Example 43

Elongation Factor Tu (tuf) and the F-ATPase Beta-Subunit (atpD) as Phylogenetic Tools for Species of the Family Enterobacteriaceae Summary The phylogeny of enterobacterial species commonly found in clinical samples was analyzed by comparing partial sequences of their elongation factor Tu (tuf) genes and their F-ATPase beta-subunit (atpD) genes. A 884-bp fragment for tuf and a 884- or 871-bp fragment for atpD were sequenced for 88 strains of 72 species from 25 enterobacterial genera. The atpD sequence analysis revealed a specific indel to *Pantoea* and *Tatumella* species showing for the first time a tight phylogenetic affiliation between these two genera. Comprehensive tuf and atpD phylogenetic trees were constructed and are in agreement with each other. Monophyletic genera are *Yersinia, Pantoea, Edwardsiella, Cedecea, Salmonella, Serratia, Proteus*, and *Providencia*. Analogous trees were obtained based on available 16S rDNA sequences from databases. tuf and atpD phylogenies are in agreement with the 16S rDNA analysis despite the smaller resolution power for the latter. In fact, distance comparisons revealed that tuf and atpD genes provide a better resolution for pairs of species belonging to the family Enterobacteriaceae. However, 16S rDNA distances are better resolved for pairs of species belonging to different families. In conclusion, tuf and atpD conserved genes are sufficiently divergent to discriminate different species inside the family Enterobacteriaceae and offer potential for the development of diagnostic tests based on DNA to identify enterobacterial species.

Introduction

Members of the family Enterobacteriaceae are facultatively anaerobic gram-negative rods, catalase-positive and oxydase-positive (Brenner, 1984). They are found in soil, water, plants, and in animals from insects to man. Many enterobacteria are opportunistic pathogens. In fact, members of this family are responsible for about 50% of nosocomial infections in the United States (Brenner, 1984). Therefore, this family is of considerable clinical importance.

Major classification studies on the family Enterobacteriaceae are based on phenotypic traits (Brenner et al., 1999; Brenner et al., 1980; Dickey & Zumoff, 1988; Farmer III et al., 1980; Farmer III et al., 1985b; Farmer III et al., 1985a) such as biochemical reactions and physiological characteristics. However, phenotypically distinct strains may be closely related by genotypic criteria and may belong to the same genospecies (Bercovier et al., 1980; Hartl & Dykhuizen, 1984). Also, phenotypically close strains (biogroups) may belong to different genospecies, like *Klebsiella pneumoniae* and *Enterobacter aerogenes* (Brenner, 1984) for example. Consequently, identification and classification of certain species may be ambiguous with techniques based on phenotypic tests (Janda et al., 1999; Kitch et al., 1994; Sharma et al., 1990).

More advances in the classification of members of the family Enterobacteriaceae have come from DNA-DNA hybridization studies (Brenner et al., 1993; Brenner et al., 1986; Brenner, et al., 1980; Farmer III, et al., 1980; Farmer III, et al., 1985b; Izard et al., 1981; Steigerwalt et al., 1976). Furthermore, the phylogenetic significance of bacterial classification based on 16S rDNA sequences has been recognized by many workers (Stackebrandt & Goebel, 1994; Wayne et al., 1987). However, members of the family Enterobacteriaceae have not been subjected to extensive phylogenetic analysis of 16S rDNA (Spröer et al., 1999). In fact, this molecule was not thought to solve taxonomic problems concerning closely related species because of its very high degree of conservation (Brenner, 1992; Sproer, et al., 1999). Another drawback of the 16S rDNA gene is that it is found in several copies within the genome (seven in *Escherichia coli* and *Salmonella typhimurium*) (Hill & Harnish, 1981). Due to sequence divergence between the gene copies, direct sequencing of PCR products is often not suitable to achieve a representative sequence (Cilia et al., 1996; Hill & Harnish, 1981). Other genes such as gap and ompA (Lawrence et al., 1991), rpoB (Mollet et al., 1997), and infB (Hedegaard et al., 1999) were used to resolve the phylogeny of enterobacteria. However, none of these studies covered an extensive number of species.

tuf and atpD are the genes encoding the elongation factor Tu (EF-Tu) and the F-ATPase beta-subunit, respectively. EF-Tu is involved in peptide chain formation (Ludwig et al., 1990). The two copies of the tuf gene (tufA and tufB) found in enterobacteria (Sela et al., 1989) share high identity level (99%) in *Salmonella typhimurium* and in *E. coli*. The recombination phenomenon could explain sequence homogenization between the two copies (Abdulkarim & Hughes, 1996; Grunberg-Manago, 1996). F-ATPase is present on the plasma membranes of eubacteria (Nelson & Taiz, 1989). It functions mainly in ATP synthesis (Nelson & Taiz, 1989) and the beta-subunit contains the catalytic site of the enzyme. EF-Tu and F-ATPase are highly conserved throughout evolution and shows functional constancy (Amann et al., 1988; Ludwig, et al., 1990). Recently, phylogenies based on protein sequences from EF-Tu and F-ATPase beta-subunit showed good agreement with each other and with the rDNA data (Ludwig et al., 1993).

We elected to sequence 884-bp fragments of tuf and atpD from 88 clinically relevant enterobacterial strains representing 72 species from 25 genera. These sequences were used to create phylogenetic trees that were compared with 16S rDNA trees. These trees revealed good agreement with each others and demonstrated the high resolution of tuf and atpD phylogenies at the species level.

Materials and Methods

Bacterial Strains and Genomic Material.

All bacterial strains used in this study were obtained from the American Type Culture Collection (ATCC) or the Deutsche Sammlung von Mikroorganismen and Zellkulturen GmbH (DSMZ). These enterobacteria can all be recovered from clinical specimens, but not all are pathogens. Whenever possible, we choose type strains. Identification of all strains was confirmed by classical biochemical tests using the automated system MicroScan WalkAway-96 system equipped with a Negative BP Combo Panel Type 15 (Dade Behring Canada). Genomic DNA was purified using the G NOME DNA kit (Bio 101). Genomic DNA from *Yersinia pestis* was kindly provided by Dr. Robert R. Brubaker. Strains used in this study and their descriptions are shown in Table 19.

PCR Primers.

The eubacterial tuf and atpD gene sequences available from public databases were analyzed using the GCG package (version 8.0) (Genetics Computer Group). Based on multiple sequence alignments, two highly conserved regions were chosen for each genes, and PCR primers were derived from these regions with the help of Oligo primer analysis software (version 5.0) (National Biosciences). A second 5' primer was design to amplify the gene atpD for few enterobacteria difficult to amplifiy with the first primer set. When required, the primers contained inosines or degeneracies to account for variable positions. Oligonucleotide primers were synthesized with a model 394 DNA/RNA synthesizer (PE Applied Biosystems). PCR primers used in this study are listed in Table 20.

DNA sequencing. An 884-bp portion of the tuf gene and an 884-bp portion (or alternatively an 871-bp portion for a few enterobacterial strains) of the atpD gene were sequenced for all enterobacteria listed in the first strain column of Table 19. Amplification was performed with 4 ng of genomic DNA. The 40-μl PCR mixtures used to generate PCR products for sequencing contained 1.0 μM each primer, 200 μM each deoxyribonucleoside triphosphate (Pharmacia Biotech), 10 mM Tris-HCl (pH 9.0 at 25° C.), 50 mM KCl, 0.1% (w/v) Triton X-100, 2.5 mM $MgCl_2$, 0.05 mM BSA, 0.3 U of Taq DNA polymerase (Promega) coupled with TaqStart™ antibody (Clontech Laboratories). The TaqStart™ neutralizing monoclonal antibody for Taq DNA polymerase was added to all PCR mixtures to enhance efficiency of amplification (Kellogg et al., 1994). The PCR mixtures were subjected to thermal cycling (3 min at 95° C. and then 35 cycles of 1 min at 95° C., 1 min at 55° C. for tuf or 50° C. for atpD, and 1 min at 72° C., with a 7-min final extension at 72° C.) using a PTC-200 DNA Engine thermocycler (MJ Research). PCR products having the predicted sizes were recovered from an agarose gel stained for 15 min with 0.02% of methylene blue followed by washing in sterile distilled water for 15 min twice (Flores et al., 1992). Subsequently, PCR products having the predicted sizes were recovered from gels using the QIAquick gel extraction kit (QIAGEN).

Both strands of the purified amplicons were sequenced using the ABI Prism BigDye Terminator Cycle Sequencing Ready Reaction Kit (PE Applied Biosystems) on an automated DNA sequencer (Model 377). Amplicons from two independent PCR amplifications were sequenced for each strain to ensure the absence of sequencing errors attributable to nucleotide miscorporations by the Taq DNA polymerase. Sequence assembly was performed with the aid of Sequencer 3.0 software (Gene Codes).

Phylogenetic Analysis.

Multiple sequence alignments were performed using PileUp from the GCG package (Version 10.0) (Genetics Computer Group) and checked by eye with the editor SeqLab to edit sequences if necessary and to note which regions were to be excluded for phylogenetic analysis. *Vibrio cholerae* and *Shewanella putrefaciens* were used as outgroups. Bootstrap subsets (750 sets) and phylogenetic trees were generated with the Neighbor Joining algorithm from Dr. David Swofford's PAUP (Phylogenetic Analysis Using Parsimony) Software version 4.0b4 (Sinauer Associates) and with tree-bisection branch-swapping. The distance model used was Kimura (1980) two-parameter. Relative rate test was performed with the aid of Phyltest program version 2.0 (c).

Results and Discussion

DNA Amplification, Sequencing and Sequence Alignments

A PCR product of the expected size of 884 bp was obtained for tuf and of 884 or 871 bp for atpD from all bacterial strains tested. After subtracting for biased primer regions and ambiguous single strand data, sequences of at least 721 bp for tuf and 713 bp for atpD were submitted to phylogenetic analyses. These sequences were aligned with tuf and atpD sequences available in databases to verify that the nucleotide sequences indeed encoded a part of tested genes. Gaps were excluded to perform phylogenetic analysis.

Signature Sequences

From the sequence alignments obtained from both tested genes, only one insertion was observed. This five amino acids insertion is located between the positions 325 and 326 of atpD gene of *E. coli* strain K-12 (Saraste et al., 1981) and can be considered a signature sequence of *Tatumella ptyseos* and *Pantoea* species (FIG. 7). The presence of a conserved indel of defined length and sequence and flanked by conserved regions could suggest a common ancestor, particularly when members of a given taxa share this indel (Gupta, 1998). To our knowledge, high relatedness between the genera *Tatumella* and *Pantoea* is demonstrated for the first time.

*Enterobacter agglomerans* ATCC 27989 sequence does not possess the five amino acid indel (FIG. 7). This indel could represent a useful marker to help resolve the *Enterobacter agglomerans* and *Pantoea* classification. Indeed, the transfer of *Enterobacter agglomerans* to *Pantoea agglomerans* was proposed in 1989 by Gavini et al. (Gavini et al., 1989). However, some strains are provisionally classified as *Pantoea* sp. until their interrelatedness is elucidated (Gavini, et al., 1989). Since the transfer was proposed, the change of nomenclature has not yet been made for all *Enterobacter agglomerans* in the ATCC database. The absence of the five amino acids indel suggests that some strains of *Enterobacter agglomerans* most likely do not belong to the genus *Pantoea.*

Phylogenetic Trees Based on Partial Tuf Sequences, Atpd Sequences, and Published 16S Rdna Data Of Members Of The Enterobacteriaceae Representative trees constructed from tuf and atpD sequences with the neighbor-joining method are shown in FIG. 8. The phylogenetic trees generated from partial tuf sequences and atpD sequences are very similar. Nevertheless, atpD tree shows more monophyletic groups corresponding to species that belong to the same genus. These groups are more consistent with the actual taxonomy. For both genes, some genera are not monophyletic. These results support previous phylogenies based on the genes gap and ompA (Lawrence, et al., 1991), rpoB (Mollet, et al., 1997), and infB (Hedegaard, et al., 1999) which all showed that the genera *Escherichia* and *Klebsiella* are polyphyletic. There were few differences in branching between tuf and atpD genes.

Even though *Pantoea agglomerans* and *Pantoea dispersa* indels were excluded for phylogenetic analysis, these two species grouped together and were distant from *Enterobacter agglomerans* ATCC 27989, adding another evidence that the latter species is heterogenous and that not all members of this species belong to the genus *Pantoea*. In fact, the *E. agglomerans* strain ATCC 27989 exhibits branch lengths similar to others *Enterobacter* species with both genes. Therefore, we suggest that this strain belong to the genus *Enterobacter* until further reclassification of that genus.

tuf and atpD trees exhibit very short genetic distances between taxa belonging to the same genetic species including species segregated for clinical considerations. This first concern *E. coli* and *Shigella* species that were confirmed to be the same genetic species by hybridization studies (Brenner et al., 1972; Brenner et al., 1972; Brenner et al., 1982) and phylogenies based on 16S rDNA (Wang et al., 1997) and rpoB genes (Mollet, et al., 1997). Hybridization studies (Bercovier, et al., 1980) and phylogeny based on 16S rDNA genes (Ibrahim et al., 1994) demonstrated also that *Yersinia pestis* and E pseudotuberculosis are the same genetic species. Among *Yersinia pestis* and E pseudotuberculosis, the three *Klebsiella pneumoniae subspecies, E. coli*-Shigella species, and *Salmonella* choleraesuis subspecies, *Salmonella* is a less tightly knit species than the other genetic species. The same is true for *E. coli* and *Shigella* species.

*Escherichia fergusonii* is very close to *E. coli*-Shigella genetic species. This observation is corroborated by 16S rDNA phylogeny (McLaughlin et al., 2000) but not by DNA hybridization values. In fact, *E. fergusonii* is only 49% to 63% related to *E. coli-Shigella* (Farmer III, et al., 1985b). It was previously observed that very recently diverged species may not be recognizable based on 16S rDNA sequences although DNA hybridization established them as different species (Fox et al., 1992). Therefore, *E. fergusonii* could be a new "quasi-species".

atpD phylogeny revealed *Salmonella* subspecies *divisions* consistent with the actual taxonomy. This result was already observed by Christensen et al. (Christensen & Olsen, 1998). Nevertheless, tuf partial sequences discriminate less than atpD between *Salmonella* subspecies.

Overall, tuf and atpD phylogenies exhibit enough divergence between species to ensure efficient discrimination. Therefore, it could be easy to distinguish phenotypically close enterobacteria belonging to different genetic species such as *Klebsiella pneumoniae* and *Enterobacter aerogenes.*

Phylogenetic relationships between *Salmonella, E. coli* and *C. freundii* are not well defined. 16S rDNA and 23S rDNA sequence data reveals a closer relationship between *Salmonella* and *E. coli* than between *Salmonella* and *C. freundii* (Christensen et al., 1998), while DNA homology studies (Selander et al., 1996) and infB phylogeny (Hedegaard, et al., 1999) showed that *Salmonella* is more closely related to *C. freundii* than to *E. coli.* In that regard, tuf and atpD phylogenies are coherent with 16S rDNA and 23S rDNA sequence analysis.

Phylogenetic analyses were also performed using amino acids sequences. tuf tree based on amino acids is characterized by a better resolution between taxa outgroup and taxa ingroup (enterobacteria) than tree based on nucleic acids whereas atpD trees based on amino acids and nucleic acids give almost the same resolution between taxa outgroup and ingroup (data not shown).

Relative rate test (or two cluster test (Takezaki et al., 1995)) evaluates if evolution is constant between two taxa. Before to apply the test, the topology of a tree is determined by tree-building method without the assumption of rate constancy. Therefore, two taxa (or two groups of taxa) are compared with a third taxon that is an outgroup of the first two taxa (Takezaki, et al., 1995). Few pairs of taxa that exhibited a great difference between their branch lengths at particular nodes were chosen to perform the test. This test reveals that tuf and atpD are not constant in their evolution within the family Enterobacteriaceae. For tuf, for example, the hypothesis of rate constancy is rejected (Z value higher than 1.96) between *Yersinia* species. The same is true for *Proteus* species. For atpD, for example, evolution is not constant between *Proteus* species, between *Proteus species* and *Providencia* species, and between *Yersinia species* and *Escherichia coli*. For 16S rDNA, for example, evolution is not constant between two *E. coli*, between *E. coli* and *Enterobacter aerogenes*, and between *E. coli* and *Proteus vulgaris*. These results suggest that tuf, atpD and 16S rDNA could not serve as a molecular clock for the entire family Enterobacteriaceae.

Since the number and the nature of taxa can influence topology of trees, phylogenetic trees from tuf and atpD were reconstructed using sequences corresponding to strains for which 16S rDNA genes were published in GenEMBL. These trees were similar to those generated using 16S rDNA (FIG. 9). Nevertheless, 16S rDNA tree gave poorer resolution power than tuf and atpD gene trees. Indeed, these latter exhibited less multifurcation (polytomy) than the 16S rDNA tree.

Comparison of Distances Based on tuf, Atpd, and 16S rDNA Data tuf, atpD, and 16S rDNA distances (i.e. the number of differences per nucleotide site) were compared with each other for each pair of strains. We found that the tuf and atpD distances were respectively 2.268±0.965 and 2.927±0.896 times larger than 16S rDNA distances (FIGS. 10*a* and *b*). atpD distances were 1.445±0.570 times larger than tuf distances (FIG. 10*c*). FIG. 10 also shows that the tuf, atpD, and 16S rDNA distances between members of different species of the same genus (0.053±0.034, 0.060±0.020, and 0.024±0.010, respectively) were in mean smaller than the distances between members of different genera belonging to the same family (0.103±0.053, 0.129±0.051, and 0.044±0.013, respectively). However, the overlap exhibits with standard deviations add to a focus of evidences that some enterobacterial genera are not well defined (Brenner, 1984). In fact, many distances for pairs of species especially belonging to the genera *Escherichia, Shigella, Enterobacter, Citrobacter, Klebsiella*, and *Kluyvera* overlap distances for pairs of species belonging to the same genus (FIG. 10). For example, distances for pairs composed by species of *Citrobacter* and species of *Klebsiella* overlap distances for pairs composed by two *Citrobacter* or by two *Klebsiella*.

Observing the distance distributions, 16S rDNA distances reveal a clear separation between the families Enterobacteriaceae and Vibrionaceae despite the fact that the family Vibrionaceae is genetically very close to the Enterobacteriaceae (FIGS. 10*a* and *b*). Nevertheless, tuf and atpD show higher discriminating power below the family level (FIGS. 10*a* and *b*).

There were some discrepancies in the relative distances for the same pairs of taxa between the two genes studied. First, distances between *Yersinia* species are at least two times lower for atpD than for tuf (FIG. 10*c*). Also, distances at the family level (between Enterobacteriaceae and Vibrionaceae) show that Enterobacteriaceae is a tightlier knit family with atpD gene (Proteus genus excepted) than with tuf gene. Both genes well delineate taxa belonging to the same species. There is one exception with atpD: *Klebsiella planticola* and *K. ornithinolithica* belong to the same genus but fit with taxa belonging to the same species (FIGS. 10*a* and *c*). These two species are also very close genotypically with tuf gene. This suggest that *Klebsiella planticola* and *K. ornithinolithica* could be two newborn species. tuf and atpD genes exhibit little distances between *Escherichia fergusonii* and *E. coli*-Shigella species. Unfortunately, comparison with 16S rDNA could not be achieved because the *E. fergusonii* 16S rDNA sequence is not yet accessible in GenEMBL database. Therefore, the majority of phenotypically close enterobacteria could be easily discriminated genotypically using tuf and atpD gene sequences.

In conclusion, tuf and atpD genes exhibit phylogenies consistent with 16S rDNA genes phylogeny. For example, they reveal that the family Enterobacteriaceae is monophyletic. Moreover, tuf and atpD distances provide a higher discriminating power than 16S rDNA distances. In fact, tuf and atpD genes discriminate well between different genospecies and are conserved between strains of the same genetic species in such a way that primers and molecular probes for diagnostic purposes could be designed. Preliminary studies support these observations and diagnostic tests based on tuf and atpD sequence data to identify enterobacteria are currently under development.

Example 44

Testing New Pairs of PCR Primers Selected from Two Species-Specific Genomic DNA Fragments which are Objects of Our Assigned U.S. Pat. No. 6,001,564

Objective.

The goal of these experiments is to demonstrate that it is relatively easy for a person skilled in the art to find other PCR primer pairs from the species-specific fragments used as targets for detection and identification of a variety of microorganisms. In fact, we wish to prove that the PCR primers previously tested by our group and which are objects of the present patent application are not the only possible good choices for diagnostic purposes. For this example, we used diagnostic targets described in our assigned U.S. Pat. No. 6,001,564.

Experimental strategy.

We have selected randomly two species-specific genomic DNA fragments for this experiment. The first one is the 705-bp fragment specific to *Staphylococcus epidermidis* (SEQ ID NO: 36 from U.S. Pat. No. 6,001,564) while the second one is the 466-bp fragment specific to *Moraxella catarrhalis* (SEQ ID NO: 29 from U.S. Pat. No. 6,001,564). Subsequently, we have selected from these two fragments a number of PCR primer pairs other than those previously tested. We have chosen 5 new primer pairs from each of these two sequences which are well dispersed along the DNA fragment (FIGS. 11 and 12). We have tested these primers for their specificity and compared them with the original primers previously tested. For the specificity tests, we have tested all bacterial species closely related to the target species based on phylogenetic analysis with three conserved genes (rRNA genes, tuf and atpD). The rational for selecting a restricted number of bacterial species to evaluate the specificity of the new primer pairs is based on the fact that the lack of specificity of a DNA-based assay is attributable to the detection of closely related species which are more similar at the nucleotide level. Based on the phylogenetic analysis, we have selected (i) species from the closely related genus *Staphylococcus, Enterococcus, Streptococcus* and *Listeria* to test the specificity of the *S. epidermidis*-specific PCR assays and (ii) species from the closely related genus *Moraxella, Kingella* and *Neisseria* to test the specificity of the *M. catarrhalis*-specific PCR assays.

Materials and Methods

Bacterial Strains.

All bacterial strains used for these experiments were obtained from the American Type Culture Collection (ATCC, Rockville, Md.).

Genomic DNA Isolation.

Genomic DNA was purified from the ATCC reference strains by using the G-nome DNA kit (Bio 101 Inc., Vista, Calif.).

Oligonucleotide Design and Synthesis.

PCR primers were designed with the help of the Oligo™ primer analysis software Version 4.0 (National Biosciences Inc., Plymouth, Minn.) and synthesized using a model 391 DNA synthesizer (Applied Biosystems, Foster City, Calif.).

PCR Assays.

All PCR assays were performed by using genomic DNA purified from reference strains obtained from the ATCC. One μl of purified DNA preparation (containing 0.01 to 1 ng of DNA per μl) was added directly into the PCR reaction mixture. The 20 μL PCR reactions contained final concentrations of 50 mM KCl, 10 mM Tris-HCl (pH 9.0), 0.1% Triton X-100, 2.5 mM $MgCl_2$, 0.4 μM of each primer, 200 μM of each of the four dNTPs and 0.5 unit of Taq DNA polymerase (Promega, Madison, Wis.) combined with the TaqStart™ antibody (Clontech Laboratories Inc., Palo Alto, Calif.). An internal control was integrated into all amplification reactions to verify the efficiency of the amplification reaction as well as to ensure that significant PCR inhibition was absent. Primers amplifying a region of 252 bp from a control plasmid added to each amplification reaction were used to provide the internal control. PCR reactions were then subjected to thermal cycling (3 min at 95° C. followed by 30 cycles of 1 second at 95° C. for the denaturation step and 30 seconds at 50 to 65° C. for the annealing-extension step) using a PTC-200 thermal cycler (MJ Research Inc., Watertown, Mass.). PCR amplification products were then analyzed by standard agarose gel (2%) electrophoresis. Amplification products were visualized in agarose gels containing 0.25 μg/mL of ethidium bromide under UV at 254 nm.

91

Results

Tables 21 and 22 show the results of specificity tests with the 5 new primer pairs selected from SEQ ID NO: 29 (specific to *M. catarrhalis* from U.S. Pat. No. 6,001,564) and SEQ ID NO: 36 (specific to *S. epidermidis* from U.S. Pat. No. 6,001,564), respectively. In order to evaluate the performance of these new primers pairs, we compared them in parallel with the original primer pairs previously tested.

For *M. catarrhalis*, all of the 5 selected PCR primer pairs were specific for the target species because none of the closely related species could be amplified (Table 21). In fact, the comparison with the original primer pair SEQ ID NO: 118+SEQ ID NO: 119 (from U.S. Pat. No. 6,001,564) revaled that all new pairs showed identical results in terms of specificity and sensitivity thereby suggesting their suitability for diagnostic purposes.

For *S. epidermidis*, 4 of the 5 selected PCR primer pairs were specific for the target species (Table 22). It should be noted that for 3 of these four primer pairs the annealing temperature had to be increased from 55° C. to 60 or 65° C. to attain specificity for *S. epidermidis*. Again the comparison with the original primer pair SEQ ID NO: 145+SEQ ID NO: 146 (from U.S. Pat. No. 6,001,564) revealed that these four primer pairs were as good as the original pair. Increasing the annealing temperature for the PCR amplification is well known by persons skilled in the art to be a very effective way to improve the specificity of a PCR assay (Persing et al., 1993, Diagnostic Molecular Microbiology: Principles and Applications, American Society for Microbiology, Washington, D.C.; Ehrlich and Greenberg, 1994, PCR-based Diagnostics in Infectious Disease, Blackwell Scientific Publications, Boston, Mass.). In fact, those skilled in the art are well aware of the fact that the annealing temperature is critical for the optimization of PCR assays. Only the primer pair VBsep3+VBsep4 amplified bacterial species other than *S. epidermidis* including the staphylococcal species *S. capitis*, *S. cohnii*, *S. aureus*, *S. haemolyticus* and *S. hominis* (Table 22). For this non-specific primer pair, increasing the annealing temperature from 55 to 65° C. was not sufficient to attain the desired specificity. One possible explanation for the fact that it appears sligthly easier to select species-specific primers for *M. catarrhalis* than for *S. epidermidis* is that *M. catarrhalis* is more isolated in phylogenetic trees than *S. epidermidis*. The large number of coagulase negative staphylococcal species such as *S. epidermidis* is largely responsible for this phylogenetic clustering.

Conclusion

These experiment clearly show that it is relatively easy for a person skilled in the art to select, from the species-specific DNA fragments selected as target for identification, PCR primer pairs suitable for diagnostic purposes other than those previously tested. The amplification conditions can be optimize by modifying critical variables such as the annealing temperature to attain the desired specificity and sensitivity. Consequently, we consider that it is legitimate to claim any possible primer sequences selected from the species-specific fragment and that it would be unfair to grant only the claims dealing with the primer pairs previously tested. By extrapolation, these results strongly suggest that it is also relatively easy for a person skilled in the art to select, from the species-specific DNA fragments, DNA probes suitable for diagnostic purposes other than those previously tested.

Example 45

Testing Modified Versions of PCR Primers Derived from the Sequence of Several Primers Which are Objects of U.S. Pat. No. 6,001,564

Objective.

The purpose of this project is to verify the efficiency of amplification by modified PCR primers derived from primers previously tested. The types of primer modifications to be tested include (i) variation of the sequence at one or more nucleotide positions and (ii) increasing or reducing the length of the primers. For this example, we used diagnostic targets described in U.S. Pat. No. 6,001,564.

Experimental Strategy:

Testing Primers with Nucleotide Changes

We have designed 13 new primers which are derived from the *S. epidermidis*-specific SEQ ID NO: 146 from U.S. Pat. No. 6,001,564 (Table 23). These primers have been modified at one or more nucleotide positions. As shown in Table 23, the nucleotide changes were introduced all along the primer sequence. Furthermore, instead of modifying the primer at any nucleotide position, the nucleotide changes were introduced at the third position of each codon to better reflect potential genetic variations in vivo. It should be noted that no nucleotide changes were introduced at the 3' end of the oligonucleotide primers because those skilled in the art are well aware of the fact that mimatches at the 3' end should be avoided (Persing et al., 1993, Diagnostic Molecular Microbiology: Principles and Applications, American Society for Microbiology, Washington, D.C.). All of these modified primers were tested in PCR assays in combination with SEQ ID NO: 145 from U.S. Pat. No. 6,001,564 and the efficiency of the amplification was compared with the original primer pair SEQ ID NO: 145+SEQ ID NO: 146 previously tested in U.S. Pat. No. 6,001,564.

Testing Shorter or Longer Versions of Primers

We have designed shorter and longer versions of the original *S. epidermidis*-specific PCR primer pair SEQ ID NO: 145+146 from U.S. Pat. No. 6,001,564 (Table 24) as well as shorter versions of the original *P. aeruginosa*-specific primer pair SEQ ID NO: 83+84 from U.S. Pat. No. 6,001,564 (Table 25). As shown in Tables 24 and 25, both primers of each pair were shortened or lengthen to the same length. Again, those skilled in the art know that the melting temperature of both primers from a pair should be similar to avoid preferential binding at one primer binding site which is detrimental in PCR (Persing et al., 1993, Diagnostic Molecular Microbiology: Principles and Applications, American Society for Microbiology, Washington, D.C.; Ehrlich and Greenberg, 1994, PCR-based Diagnostics in Infectious Disease, Blackwell Scientific Publications, Boston, Mass.). All of these shorter or longer primer versions were tested in PCR assays and the efficiency of the amplification was compared with the original primer pair SEQ ID NOs 145 and 146.

Materials and Methods

See the Materials and methods section of Example 44.

Results

Testing Primers with Nucleotide Changes

The results of the PCR assays with the 13 modified versions of SEQ ID NO: 146 from U.S. Pat. No. 6,001,564 are shown in Table 23. The 8 modified primers having a single nucleotide variation showed an efficiency of amplification identical to the original primer pair based on testing with 3 different dilutions of genomic DNA. The four primers having two nucleotide variations and primer VBmut12 having 3 nucleotide changes also showed PCR results identical to those obtained with the original pair. Finally, primer VBmut13 with four nucleotide changes showed a reduction in sensitivity by approximately one log as compared with the original primer pair. However, reducing the annealing temperature from 55 to 50° C. gave an efficiency of amplification very similar to that observed with the original primer pair (Table 23). In fact, reducing the annealing temperature of PCR cycles represents an effective way to reduce the stringency of hybridization for the primers and consequently allows the binding of probes with mismatches (Persing et al., 1993, Diagnostic Molecular Microbiology: Principles and Applications, American Society for Microbiology, Washington, D.C.). Subsequently, we have confirmed the specificity of the PCR assays with each of these 13 modified versions of SEQ ID NO: 146 from U.S. Pat. No. 6,001,564 by performing amplifications from all bacterial species closely related to *S. epidermidis* which are listed in Table 22.

Testing Shorter or Longer Versions of Primers

For these experiments, two primer pairs were selected: i) SEQ ID NO: 145+146 from U.S. Pat. No. 6,001,564 (specific to *S. epidermidis*) which are AT rich and ii) SEQ ID NO: 83+84 (specific to *P. aeruginosa*) which are GC rich. For the AT rich sequence, primers of 15 to 30 nucleotide in length were designed (Table 24) while for the GC rich sequences, primers of 13 to 19 nucleotide in length were designed (Table 25).

Table 24 shows that, for an annealing temperature of 55° C., the 30-25-, 20- and 17-nucleotide versions of SEQ ID NO: 145 and 146 from U.S. Pat. No. 6,001,564 all showed identical results as compared with the original primer pair except that the 17-nucleotide version amplified slightly less efficiently the *S. epidermidis* DNA. Reducing the annealing temperature from 55 to 45° C. for the 17-nucleotide version allowed to increase the amplification efficiency to a level very similar to that with the original primer pair (SEQ ID NO: 145+146 from U.S. Pat. No. 6,001,564). Regarding the 15-nucleotide version, there was amplification of *S. epidermidis* DNA only when the annealing temperature was reduced to 45° C. Under those PCR conditions the assay remained *S. epidermidis*-specific but the amplification signal with *S. epidermidis* DNA was sligthly lower as compared with the original primer pair. Subsequently, we have further confirmed the specificity of the shorter or longer versions by amplifying DNA from all bacterial species closely related to *S. epidermidis* which are listed in Table 22.

Table 25 shows that, for an annealing temperature of 55° C., all shorter versions of SEQ ID NO: 83 and 84 from U.S. Pat. No. 6,001,564 showed identical PCR results as compared with the original primer pair. As expected, these results show that it is simpler to reduce the length of GC rich as compared with AT rich. This is attributable to the fact that GC binding is more stable than AT binding.

Conclusion

Testing Primers with Nucleotide Changes

The above experiments clearly show that PCR primers may be modified at one or more nucleotide positions without affecting the specificity and the sensitivity of the PCR assay. These results strongly suggest that a given oligonucleotide can detect variant genomic sequences from the target species. In fact, the nucleotide changes in the selected primers were purposely introduced at the third position of each codon to mimic nucleotide variation in genomic DNA. Thus we conclude that it is justified to claim "a variant thereof" for i) the SEQ IDs of the fragments and oligonucleotides which are object of the present patent application and ii) genomic variants of the target species.

Testing Shorter or Longer Versions of Primers

The above experiments clearly show that PCR primers may be shorter or longer without affecting the specificity and the sensitivity of the PCR assay. We have showed that oligonucleotides ranging in sizes from 13 to 30 nucleotides may be as specific and sensitive as the original primer pair from which they were derived. Consequently, these results suggest that it is not exaggerated to claim sequences having at least 12 nucleotide in length.

This invention has been described herein above, and it is readily apparent that modifications can be made thereto without departing from the spirit of this invention. These modifications are under the scope of this invention, as defined in the appended claims.

TABLE 1

Distribution (%) of nosocomial pathogens for various human infections in USA (1990-1992)[1].

| Pathogen | UTI[2] | SSI[3] | BSI[4] | Pneumonia | CSF[5] |
|---|---|---|---|---|---|
| *Escherichia coli* | 27 | 9 | 5 | 4 | 2 |
| *Staphylococcus aureus* | 2 | 21 | 17 | 21 | 2 |
| *Staphylococcus epidermidis* | 2 | 6 | 20 | 0 | 1 |
| *Enterococcus faecalis* | 16 | 12 | 9 | 2 | 0 |
| *Enterococcus faecium* | 1 | 1 | 0 | 0 | 0 |
| *Pseudomonas aeruginosa* | 12 | 9 | 3 | 18 | 0 |
| *Klebsiella pneumoniae* | 7 | 3 | 4 | 9 | 0 |
| *Proteus mirabilis* | 5 | 3 | 1 | 2 | 0 |
| *Streptococcus pneumoniae* | 0 | 0 | 3 | 1 | 18 |
| Group B Streptococci | 1 | 1 | 2 | 1 | 6 |
| Other streptococci | 3 | 5 | 2 | 1 | 3 |
| *Haemophilus influenzae* | 0 | 0 | 0 | 6 | 45 |
| *Neisseria meningitidis* | 0 | 0 | 0 | 0 | 14 |
| *Listeria monocytogenes* | 0 | 0 | 0 | 0 | 3 |
| Other enterococci | 1 | 1 | 0 | 0 | 0 |
| Other staphylococci | 2 | 8 | 13 | 2 | 0 |
| *Candida albicans* | 9 | 3 | 5 | 5 | 0 |
| Other *Candida* | 2 | 1 | 3 | 1 | 0 |
| *Enterobacter* sp. | 5 | 7 | 4 | 12 | 2 |
| *Acinetobacter* sp. | 1 | 1 | 2 | 4 | 2 |
| *Citrobacter* sp. | 2 | 1 | 1 | 1 | 0 |
| *Serratia marcescens* | 1 | 1 | 1 | 3 | 1 |
| Other *Klebsiella* | 1 | 1 | 1 | 2 | 1 |
| Others | 0 | 6 | 4 | 5 | 0 |

[1]Data recorded by the National Nosocomial Infections Surveillance (NNIS) from 80 hospitals (Emori and Gaynes, 1993, *Clin. Microbiol. Rev.*, 6: 428-442).
[2]Urinary tract infection.
[3]Surgical site infection.
[4]Bloodstream infection.
[5]Cerebrospinal fluid.

TABLE 2

Distribution (%) of bloodstream infection pathogens in Quebec (1995), Canada (1992), UK (1969-1988) and USA (1990-1992).

| | | | UK[3] | | USA[4] |
|---|---|---|---|---|---|
| Organism | Quebec[1] | Canada[2] | Community-acquired | Hospital-acquired | Hospital-acquired |
| *E. coli* | 15.6 | 53.8 | 24.8 | 20.3 | 5.0 |
| *S. epidermidis* and other CoNS[5] | 25.8 | — | 0.5 | 7.2 | 31.0 |
| *S. aureus* | 9.6 | — | 9.7 | 19.4 | 16.0 |
| *S. pneumoniae* | 6.3 | — | 22.5 | 2.2 | — |
| *E. faecalis* | 3.0 | — | 1.0 | 4.2 | — |
| *E. faecium* | 2.6 | — | 0.2 | 0.5 | — |
| *Enterococcus* sp. | — | — | — | — | 9.0 |
| *H. influenzae* | 1.5 | — | 3.4 | 0.4 | — |
| *P. aeruginosa* | 1.5 | 8.2 | 1.0 | 8.2 | 3.0 |
| *K. pneumoniae* | 3.0 | 11.2 | 3.0 | 9.2 | 4.0 |
| *P. mirabilis* | — | 3.9 | 2.8 | 5.3 | 1.0 |
| *S. pyogenes* | — | — | 1.9 | 0.9 | — |

TABLE 2-continued

Distribution (%) of bloodstream infection pathogens in Quebec (1995), Canada (1992), UK (1969-1988) and USA (1990-1992).

| | | | UK[3] | | |
|---|---|---|---|---|---|
| Organism | Quebec[1] | Canada[2] | Community-acquired | Hospital-acquired | USA[4] Hospital-acquired |
| *Enterobacter* sp. | 4.1 | 5.5 | 0.5 | 2.3 | 4.0 |
| *Candida* sp. | 8.5 | — | — | 1.0 | 8.0 |
| Others | 18.5 | 17.4 | 28.7 | 18.9 | 19.0 |

[1]Data obtained for 270 isolates collected at the Centre Hospitalier de l'Université Laval (CHUL) during a 5 month period (May to October 1995).
[2]Data from 10 hospitals throughout Canada representing 941 gram-negative isolates. (Chamberland et al., 1992, *Clin. Infect. Dis*., 15: 615-628).
[3]Data from a 20-year study (1969-1988) for nearly 4000 isolates. (Eykyn et al., 1990, *J. Antimicrob. Chemother*., Suppl. C, 25: 41-58).
[4]Data recorded by the National Nosocomial Infections Surveillance (NNIS) from 80 hospitals (Emori and Gaynes, 1993, *Clin. Microbiol. Rev*., 6: 428-442).
[5]Coagulase-negative staphylococci.

TABLE 3

Distribution of positive and negative clinical specimens tested at the microbiology laboratory of the CHUL (February 1994-January 1995).

| Clinical specimens and/or sites | No. of samples tested (%) | % of positive specimens | % of negative specimens |
|---|---|---|---|
| Urine | 17,981 (54.5) | 19.4 | 80.6 |
| Blood culture/marrow | 10,010 (30.4) | 6.9 | 93.1 |
| Sputum | 1,266 (3.8) | 68.4 | 31.6 |
| Superficial pus | 1,136 (3.5) | 72.3 | 27.7 |
| Cerebrospinal fluid | 553 (1.7) | 1.0 | 99.0 |
| Synovial fluid | 523 (1.6) | 2.7 | 97.3 |
| Respiratory tract | 502 (1.5) | 56.6 | 43.4 |
| Deep pus | 473 (1.4) | 56.8 | 43.2 |
| Ears | 289 (0.9) | 47.1 | 52.9 |
| Pleural and pericardial fluid | 132 (0.4) | 1.0 | 99.0 |
| Peritoneal fluid | 101 (0.3) | 28.6 | 71.4 |
| Total: | 32,966 (100.0) | 20.0 | 80.0 |

TABLE 4

Example of microbial species for which tuf and/or atpD and/or recA nucleic acids and/or sequences are used in the present invention.

| Bacterial species |
|---|
| *Abiotrophia adiacens* |
| *Abiotrophia defectiva* |
| *Achromobacter xylosoxidans* subsp. *denitrificans* |
| *Acetobacterium woodi* |
| *Acetobacter aceti* |
| *Acetobacter altoacetigenes* |
| *Acetobacter polyoxogenes* |
| *Acholeplasma laidlawii* |
| *Acidothermus cellulolyticus* |
| *Acidiphilum facilis* |
| *Acinetobacter baumannii* |
| *Acinetobacter calcoaceticus* |
| *Acinetobacter lwoffii* |
| *Actinomyces meyeri* |
| *Aerococcus viridans* |
| *Aeromonas hydrophila* |
| *Aeromonas salmonicida* |
| *Agrobacterium radiobacter* |
| *Agrobacterium tumefaciens* |
| *Alcaligenes faecalis* subsp. *faecalis* |
| *Allochromatium vinosum* |
| *Anabaena variabilis* |
| *Anacystis nidulans* |
| *Anaerorhabdus furcosus* |

TABLE 4-continued

Example of microbial species for which tuf and/or atpD and/or recA nucleic acids and/or sequences are used in the present invention.

| |
|---|
| *Aquifex aeolicus* |
| *Aquifex pyrophilus* |
| *Arcanobacterium haemolyticum* |
| *Archaeoglobus fulgidus* |
| *Azotobacter vinelandii* |
| *Bacillus anthracis* |
| *Bacillus cereus* |
| *Bacillus firmus* |
| *Bacillus halodurans* |
| *Bacillus megaterium* |
| *Bacillus mycoides* |
| *Bacillus pseudomycoides* |
| *Bacillus stearothermophilus* |
| *Bacillus subtilis* |
| *Bacillus thuringiensis* |
| *Bacillus weihenstephanensis* |
| *Bacteroides distasonis* |
| *Bacteroides fragilis* |
| *Bacteroides forsythus* |
| *Bacteroides ovatus* |
| *Bacteroides vulgatus* |
| *Bartonella henselae* |
| *Bifidobacterium adolescentis* |
| *Bifidobacterium breve* |
| *Bifidobacterium dentium* |
| *Bifidobacterium longum* |
| *Blastochloris viridis* |
| *Borrelia burgdorferi* |
| *Bordetella pertussis* |
| *Bordetella bronchiseptica* |
| *Brucella abortus* |
| *Brevibacterium linens* |
| *Brevibacterium flavum* |
| *Brevundimonas diminuta* |
| *Buchnera aphidicola* |
| *Budvicia aquatica* |
| *Burkholderia cepacia* |
| *Burkholderia mallei* |
| *Burkholderia pseudomallei* |
| *Buttiauxella agrestis* |
| *Butyrivibrio fibrisolvens* |
| *Campylobacter coli* |
| *Campylobacter curvus* |
| *Campylobacter fetus* subsp. *fetus* |
| *Campylobacter fetus* subsp. *venerealis* |
| *Campylobacter gracilis* |
| *Campylobacter jejuni* |
| *Campylobacter jejuni* subsp. *doylei* |
| *Campylobacter jejuni* subsp. *jejuni* |
| *Campylobacter lari* |
| *Campylobacter rectus* |
| *Campylobacter sputorum* subsp. *sputorum* |
| *Campylobacter upsaliensis* |
| *Cedecea davisae* |
| *Cedecea lapagei* |
| *Cedecea neteri* |
| *Chlamydia pneumoniae* |
| *Chlamydia psittaci* |
| *Chlamydia trachomatis* |
| *Chlorobium vibrioforme* |
| *Chloroflexus aurantiacus* |
| *Chryseobacterium meningosepticum* |
| *Citrobacter amalonaticus* |
| *Citrobacter braakii* |
| *Citrobacter farmeri* |
| *Citrobacter freundii* |
| *Citrobacter koseri* |
| *Citrobacter sedlakii* |
| *Citrobacter werkmanii* |
| *Citrobacter youngae* |
| *Clostridium acetobutylicum* |
| *Clostridium beijerinckii* |
| *Clostridium bifermentans* |
| *Clostridium botulinum* |
| *Clostridium difficile* |
| *Clostridium innocuum* |
| *Clostridium histolyticum* |

TABLE 4-continued

| Example of microbial species for which tuf and/or atpD and/or recA nucleic acids and/or sequences are used in the present invention. |
|---|
| *Clostridium novyi* |
| *Clostridium septicum* |
| *Clostridium perfringens* |
| *Clostridium ramosum* |
| *Clostridium tertium* |
| *Clostridium tetani* |
| *Comamonas acidovorans* |
| *Corynebacterium accolens* |
| *Corynebacterium bovis* |
| *Corynebacterium cervicis* |
| *Corynebacterium diphtheriae* |
| *Corynebacterium flavescens* |
| *Corynebacterium genitalium* |
| *Corynebacterium glutamicum* |
| *Corynebacterium jeikeium* |
| *Corynebacterium kutscheri* |
| *Corynebacterium minutissimum* |
| *Corynebacterium mycetoides* |
| *Corynebacterium pseudodiphtheriticum* |
| *Corynebacterium pseudogenitalium* |
| *Corynebacterium pseudotuberculosis* |
| *Corynebacterium renale* |
| *Corynebacterium striatum* |
| *Corynebacterium ulcerans* |
| *Corynebacterium urealyticum* |
| *Corynebacterium xerosis* |
| *Coxiella burnetii* |
| *Cytophaga lytica* |
| *Deinococcus radiodurans* |
| *Deinonema* sp. |
| *Edwardsiella hoshinae* |
| *Edwardsiella tarda* |
| *Ehrlichia canis* |
| *Ehrlichia risticii* |
| *Eikenella corrodens* |
| *Enterobacter aerogenes* |
| *Enterobacter agglomerans* |
| *Enterobacter amnigenus* |
| *Enterobacter asburiae* |
| *Enterobacter cancerogenus* |
| *Enterobacter cloacae* |
| *Enterobacter gergoviae* |
| *Enterobacter hormaechei* |
| *Enterobacter sakazakii* |
| *Enterococcus avium* |
| *Enterococcus casseliflavus* |
| *Enterococcus cecorum* |
| *Enterococcus columbae* |
| *Enterococcus dispar* |
| *Enterococcus durans* |
| *Enterococcus faecalis* |
| *Enterococcus faecium* |
| *Enterococcus flavescens* |
| *Enterococcus gallinarum* |
| *Enterococcus hirae* |
| *Enterococcus malodoratus* |
| *Enterococcus mundtii* |
| *Enterococcus pseudoavium* |
| *Enterococcus raffinosus* |
| *Enterococcus saccharolyticus* |
| *Enterococcus solitarius* |
| *Enterococcus sulfureus* |
| *Clostridium sordellii* |
| *Erwinia amylovora* |
| *Erwinia carotovora* |
| *Escherichia coli* |
| *Escherichia fergusonii* |
| *Escherichia hermannii* |
| *Escherichia vulneris* |
| *Eubacterium lentum* |
| *Eubacterium nodatum* |
| *Ewingella americana* |
| *Francisella tularensis* |
| *Frankia alni* |
| *Fervidobacterium islandicum* |
| *Fibrobacter succinogenes* |
| *Flavobacterium ferrigeneum* |

TABLE 4-continued

| Example of microbial species for which tuf and/or atpD and/or recA nucleic acids and/or sequences are used in the present invention. |
|---|
| *Flexistipes sinusarabici* |
| *Fusobacterium gonidiaformans* |
| *Fusobacterium necrophorum* subsp. *necrophorum* |
| *Fusobacterium nucleatum* subsp. *polymorphum* |
| *Gardnerella vaginalis* |
| *Gemella haemolysans* |
| *Gemella morbillorum* |
| *Globicatella sanguis* |
| *Gloeobacter violaceus* |
| *Gloeothece* sp. |
| *Gluconobacter oxydans* |
| *Haemophilus actinomycetemcomitans* |
| *Haemophilus aphrophilus* |
| *Haemophilus ducreyi* |
| *Haemophilus haemolyticus* |
| *Haemophilus influenzae* |
| *Haemophilus parahaemolyticus* |
| *Haemophilus parainfluenzae* |
| *Haemophilus paraphrophilus* |
| *Haemophilus segnis* |
| *Hafnia alvei* |
| *Halobacterium marismortui* |
| *Halobacterium salinarum* |
| *Haloferax volcanii* |
| *Helicobacter pylori* |
| *Herpetoshiphon aurantiacus* |
| *Kingella kingae* |
| *Klebsiella ornithinolytica* |
| *Klebsiella oxytoca* |
| *Klebsiella planticola* |
| *Klebsiella pneumoniae* subsp. *ozaenae* |
| *Klebsiella pneumoniae* subsp. *pneumoniae* |
| *Klebsiella pneumoniae* subsp. *rhinoscleromatis* |
| *Klebsiella terrigena* |
| *Kluyvera ascorbata* |
| *Kluyvera cryocrescens* |
| *Kluyvera georgiana* |
| *Kocuria kristinae* |
| *Lactobacillus acidophilus* |
| *Lactobacillus garvieae* |
| *Lactobacillus paracasei* |
| *Lactobacillus casei* subsp. *casei* |
| *Lactococcus garvieae* |
| *Lactococcus lactis* |
| *Lactococcus lactis* subsp. *lactis* |
| *Legionella micdadei* |
| *Legionella pneumophila* subsp. *pneumophila* |
| *Leminorella grimontii* |
| *Leminorella richardii* |
| *Leptospira biflexa* |
| *Leptospira interrogans* |
| *Leuconostoc mesenteroides* subsp. *dextranicum* |
| *Listeria innocua* |
| *Listeria ivanovii* |
| *Listeria monocytogenes* |
| *Listeria seeligeri* |
| *Macrococcus caseolyticus* |
| *Magnetospirillum magnetotacticum* |
| *Megamonas hypermegale* |
| *Methanobacterium thermoautotrophicum* |
| *Methanococcus jannaschii* |
| *Methanococcus vannielii* |
| *Methanosarcina barkeri* |
| *Methanosarcina jannaschii* |
| *Methylobacillus flagellatum* |
| *Methylomonas clara* |
| *Micrococcus luteus* |
| *Micrococcus lylae* |
| *Mitsuokella multacidus* |
| *Mobiluncus curtisii* subsp. *holmesii* |
| *Moellerella thermoacetica* |
| *Moellerella wisconsensis* |
| *Moorella thermoacetica* |
| *Moraxella catarrhalis* |
| *Moraxella osloensis* |
| *Morganella morganii* subsp. *morganii* |
| *Mycobacterium avium* |

TABLE 4-continued

| Example of microbial species for which tuf and/or atpD and/or recA nucleic acids and/or sequences are used in the present invention. |
|---|
| *Mycobacterium bovis* |
| *Mycobacterium gordonae* |
| *Mycobacterium kansasii* |
| *Mycobacterium leprae* |
| *Mycobacterium terrae* |
| *Mycobacterium tuberculosis* |
| *Mycoplasma capricolum* |
| *Mycoplasma gallisepticum* |
| *Mycoplasma genitalium* |
| *Mycoplasma hominis* |
| *Mycoplasma pirum* |
| *Mycoplasma mycoides* |
| *Mycoplasma pneumoniae* |
| *Mycoplasma pulmonis* |
| *Mycoplasma salivarium* |
| *Myxococcus xanthus* |
| *Neisseria animalis* |
| *Neisseria canis* |
| *Neisseria cinerea* |
| *Neisseria cuniculi* |
| *Neisseria elongata* subsp. *elongata* |
| *Neisseria elongata* subsp. *intermedia* |
| *Neisseria flava* |
| *Neisseria flavescens* |
| *Neisseria gonorrhoeae* |
| *Neisseria lactamica* |
| *Leclercia adecarboxylata* |
| *Neisseria meningitidis* |
| *Neisseria mucosa* |
| *Neisseria perflava* |
| *Neisseria pharyngis* var. *flava* |
| *Neisseria polysaccharea* |
| *Neisseria sicca* |
| *Neisseria subflava* |
| *Neisseria weaveri* |
| *Obesumbacterium proteus* |
| *Ochrobactrum anthropi* |
| *Pantoea agglomerans* |
| *Pantoea dispersa* |
| *Paracoccus denitrificans* |
| *Pasteurella multocida* |
| *Pectinatus frisingensis* |
| *Peptococcus niger* |
| *Peptostreptococcus anaerobius* |
| *Peptostreptococcus asaccharolyticus* |
| *Peptostreptococcus prevotii* |
| *Phormidium ectocarpi* |
| *Pirellula marina* |
| *Planobispora rosea* |
| *Plesiomonas shigelloides* |
| *Plectonema boryanum* |
| *Porphyromonas asaccharolytica* |
| *Porphyromonas gingivalis* |
| *Pragia fontium* |
| *Prevotella buccalis* |
| *Prevotella melaninogenica* |
| *Prevotella oralis* |
| *Prevotella ruminocola* |
| *Prochlorothrix hollandica* |
| *Propionibacterium acnes* |
| *Propionigenium modestum* |
| *Proteus mirabilis* |
| *Proteus penneri* |
| *Proteus vulgaris* |
| *Providencia alcalifaciens* |
| *Providencia rettgeri* |
| *Providencia rustigianii* |
| *Providencia stuartii* |
| *Pseudomonas aeruginosa* |
| *Pseudomonas fluorescens* |
| *Pseudomonas putida* |
| *Pseudomonas stutzeri* |
| *Psychrobacter phenylpyruvicum* |
| *Pyrococcus abyssi* |
| *Rahnella aquatilis* |
| *Rickettsia prowazekii* |
| *Rhizobium leguminosarum* |

TABLE 4-continued

| Example of microbial species for which tuf and/or atpD and/or recA nucleic acids and/or sequences are used in the present invention. |
|---|
| *Rhizobium phaseoli* |
| *Rhodobacter capsulatus* |
| *Rhodobacter sphaeroides Rhodopseudomonas palustris* |
| *Rhodospirillum rubrum* |
| *Ruminococcus albus* |
| *Ruminococcus bromii* |
| *Salmonella bongori* |
| *Salmonella choleraesuis* subsp. *arizonae* |
| *Salmonella choleraesuis* subsp *choleraesuis* |
| *Salmonella choleraesuis* subsp. *diarizonae* |
| *Salmonella choleraesuis* subsp. *houtenae* |
| *Salmonella choleraesuis* subsp. *indica* |
| *Salmonella choleraesuis* subsp. *salamae* |
| *Serpulina hyodysenteriae* |
| *Serratia ficaria* |
| *Serratia fonticola* |
| *Serratia grimesii* |
| *Serratia liquefaciens* |
| *Serratia marcescens* |
| *Serratia odorifera* |
| *Serratia plymuthica* |
| *Serratia rubidaea* |
| *Shewanella putrefaciens* |
| *Shigella boydii* |
| *Shigella dysenteriae* |
| *Shigella flexneri* |
| *Shigella sonnei* |
| *Sinorhizobium meliloti* |
| *Spirochaeta aurantia* |
| *Staphylococcus aureus* |
| *Staphylococcus aureus* subsp. *aureus* |
| *Staphylococcus auricularis* |
| *Staphylococcus capitis* subsp. *capitis* |
| *Staphylococcus cohnii* subsp. *cohnii* |
| *Staphylococcus epidermidis* |
| *Staphylococcus haemolyticus* |
| *Staphylococcus hominis* |
| *Staphylococcus hominis* subsp. *hominis* |
| *Staphylococcus lugdunensis* |
| *Staphylococcus saprophyticus* |
| *Staphylococcus sciuri* subsp. *sciuri* |
| *Staphylococcus simulans* |
| *Staphylococcus warneri* |
| *Stigmatella aurantiaca* |
| *Stenotrophomonas maltophilia* |
| *Streptococcus acidominimus* |
| *Streptococcus agalactiae* |
| *Streptococcus anginosus* |
| *Streptococcus bovis* |
| *Streptococcus cricetus* |
| *Streptococcus cristatus* |
| *Streptococcus downei* |
| *Streptococcus dysgalactiae* |
| *Streptococcus equi* subsp. *equi* |
| *Streptococcus ferus* |
| *Streptococcus gordonii* |
| *Streptococcus macacae* |
| *Streptococcus mitis* |
| *Streptococcus mutans* |
| *Streptococcus oralis* |
| *Streptococcus parasanguinis* |
| *Streptococcus pneumoniae* |
| *Streptococcus pyogenes* |
| *Streptococcus ratti* |
| *Streptococcus salivarius* |
| *Streptococcus salivarius* subsp. *thermophilus* |
| *Streptococcus sanguinis* |
| *Streptococcus sobrinus* |
| *Streptococcus suis* |
| *Streptococcus uberis* |
| *Streptococcus vestibularis* |
| *Streptomyces anbofaciens* |
| *Streptomyces aureofaciens* |
| *Streptomyces cinnamoneus* |
| *Streptomyces coelicolor* |
| *Streptomyces collinus* |

TABLE 4-continued

| Example of microbial species for which tuf and/or atpD and/or recA nucleic acids and/or sequences are used in the present invention. |
|---|
| *Streptomyces lividans* |
| *Streptomyces netropsis* |
| *Streptomyces ramocissimus* |
| *Streptomyces rimosus* |
| *Streptomyces venezuelae* |
| *Succinivibrio dextrinosolvens* |
| *Synechococcus* sp. |
| *Synechocystis* sp. |
| *Tatumella ptyseos* |
| *Taxeobacter occealus* |
| *Tetragenococcus halophilus* |
| *Thermoplasma acidophilum* |
| *Thermotoga maritima* |
| *Thermus aquaticus* |
| *Thermus thermophilus* |
| *Thiobacillus ferrooxidans* |
| *Thiomonas cuprina* |
| *Trabulsiella guamensis* |
| *Treponema pallidum* |
| *Ureaplasma urealyticum* |
| *Veillonella parvula* |
| *Vibrio alginolyticus* |
| *Vibrio anguillarum* |
| *Vibrio cholerae* |
| *Vibrio mimicus* |
| *Wolinella succinogenes* |
| *Xanthomonas citri* |
| *Xanthomonas oryzae* |
| *Xenorhabdus bovieni* |
| *Xenorhabdus nematophilus* |
| *Yersinia bercovieri* |
| *Yersinia enterocolitica* |
| *Yersinia frederiksensii* |
| *Yersinia intermedia* |
| *Yersinia pestis* |
| *Yersinia pseudotuberculosis* |
| *Yersinia rohdei* |
| *Yokenella regensburgei* |
| *Zoogloea ramigera* |
| Fungal species |
| *Absidia corymbifera* |
| *Absidia glauca* |
| *Alternaria alternata* |
| *Arxula adeninivorans* |
| *Aspergillus flavus* |
| *Aspergillus fumigatus* |
| *Aspergillus nidulans* |
| *Aspergillus niger* |
| *Aspergillus oryzae* |
| *Aspergillus terreus* |
| *Aspergillus versicolor* |
| *Aureobasidium pullulans* |
| *Basidiobolus ranarum* |
| *Bipolaris hawaiiensis* |
| *Bilophila wadsworthia* |
| *Blastoschizomyces capitatus* |
| *Blastomyces dermatitidis* |
| *Candida albicans* |
| *Candida catenulata* |
| *Candida dubliniensis* |
| *Candida famata* |
| *Candida glabrata* |
| *Candida guilliermondii* |
| *Candida haemulonii* |
| *Candida inconspicua* |
| *Candida kefyr* |
| *Candida krusei* |
| *Candida lambica* |
| *Candida lusitaniae* |
| *Candida norvegica* |
| *Candida norvegensis* |
| *Candida parapsilosis* |
| *Candida rugosa* |
| *Candida sphaerica* |
| *Candida tropicalis* |
| *Candida utilis* |

TABLE 4-continued

| Example of microbial species for which tuf and/or atpD and/or recA nucleic acids and/or sequences are used in the present invention. |
|---|
| *Candida viswanathii* |
| *Candida zeylanoides* |
| *Cladophialophora carrionii* |
| *Coccidioides immitis* |
| *Coprinus cinereus* |
| *Cryptococcus albidus* |
| *Cryptococcus humicolus* |
| *Cryptococcus laurentii* |
| *Cryptococcus neoformans* |
| *Cunninghamella bertholletiae* |
| *Curvularia lunata* |
| *Emericella nidulans* |
| *Emmonsia parva* |
| *Eremothecium gossypii* |
| *Exophiala dermatitidis* |
| *Exophiala jeanselmei* |
| *Exophiala moniliae* |
| *Exserohilum rostratum* |
| *Eremothecium gossypii* |
| *Fonsecaea pedrosoi* |
| *Fusarium moniliforme* |
| *Fusarium oxysporum* |
| *Fusarium solani* |
| *Geotrichum* sp. |
| *Histoplasma capsulatum* |
| *Hortaea werneckii* |
| *Issatchenkia orientalis* Kudrjanzev |
| *Kluyveromyces lactis* |
| *Malassezia furfur* |
| *Malassezia pachydermatis* |
| *Malbranchea filamentosa* |
| *Metschnikowia pulcherrima* |
| *Microsporum audouinii* |
| *Microsporum canis* |
| *Mucor circinelloides* |
| *Neurospora crassa* |
| *Paecilomyces lilacinus* |
| *Paracoccidioides brasiliensis* |
| *Penicillium marneffei* |
| *Phialaphora verrucosa* |
| *Pichia anomala* |
| *Piedraia hortai* |
| *Podospora anserina* |
| *Podospora curvicolla* |
| *Puccinia graminis* |
| *Pseudallescheria boydii* |
| *Reclinomonas americana* |
| *Rhizomucor racemosus* |
| *Rhizopus oryzae* |
| *Rhodotorula minuta* |
| *Rhodotorula mucilaginosa* |
| *Saccharomyces cerevisiae* |
| *Saksenaea vasiformis* |
| *Schizosaccharomyces pombe* |
| *Scopulariopsis koningii* |
| *Sordaria macrospora* |
| *Sporobolomyces salmonicolor* |
| *Sporothrix schenckii* |
| *Stephanoascus ciferrii* |
| *Syncephalastrum racemosum* |
| *Trichoderma reesei* |
| *Trichophyton mentagrophytes* |
| *Trichophyton rubrum* |
| *Trichophyton tonsurans* |
| *Trichosporon cutaneum* |
| *Ustilago maydis* |
| *Wangiella dermatitidis* |
| *Yarrowia lipolytica* |
| Parasitical species |
| *Babesia bigemina* |
| *Babesia bovis* |
| *Babesia microti* |
| *Blastocystis hominis* |
| *Crithidia fasciculata* |
| *Cryptosporidium parvum* |
| *Entamoeba histolytica* |

TABLE 4-continued

| Example of microbial species for which tuf and/or atpD and/or recA nucleic acids and/or sequences are used in the present invention. |
|---|
| *Giardia lamblia* |
| *Kentrophoros* sp. |
| *Leishmania aethiopica* |
| *Leishmania amazonensis* |
| *Leishmania braziliensis* |
| *Leishmania donovani* |
| *Leishmania infantum* |
| *Leishmania enriettii* |
| *Leishmania gerbilli* |
| *Leishmania guyanensis* |
| *Leishmania hertigi* |
| *Leishmania major* |
| *Leishmania mexicana* |
| *Leishmania panamensis* |
| *Leishmania tarentolae* |
| *Leishmania tropica* |
| *Neospora caninum* |
| *Onchocerca volvulus* |
| *Plasmodium berghei* |
| *Plasmodium falciparum* |
| *Plasmodium knowlesi* |
| *Porphyra purpurea* |
| *Toxoplasma gondii* |
| *Treponema pallidum* |
| *Trichomonas tenax* |
| *Trichomonas vaginalis* |
| *Trypanosoma brucei* |
| *Trypanosoma brucei* subsp. *brucei* |
| *Trypanosoma congolense* |
| *Trypanosoma cruzi* |

TABLE 5

Antimicrobial agents resistance genes selected for diagnostic purposes

| Gene | Antimicrobial agent | Bacteria[1] | ACCESSION NO. | SEQ ID NO. |
|---|---|---|---|---|
| aac(3)-Ib[2] | Aminoglycosides | Enterobacteriaceae Pseudomonads | L06157 | |
| aac(3)-IIb[2] | Aminoglycosides | Enterobacteriaceae, Pseudomonads | M97172 | |
| aac(3)-IVa[2] | Aminoglycosides | Enterobacteriaceae | X01385 | |
| aac(3)-VIa[2] | Aminoglycosides | Enterobacteriaceae, Pseudomonads | M88012 | |
| aac(2')-1a[2] | Aminoglycosides | Enterobacteriaceae, Pseudomonads | X04555 | |
| aac(6')-aph(2")[2] | Aminoglycosides | *Enterococcus* sp., *Staphylococcus* sp. | | 83-86[3] |
| aac(6')-Ia,[2] | Aminoglycosides | Enterobacteriaceae, Pseudomonads | M18967 | |
| aac(6')-Ic[2] | Aminoglycosides | Enterobacteriaceae, Pseudomonads | M94066 | |
| aac(6')-IIa[2] | Aminoglycosides | Pseudomonads | | 112[4] |
| aadB [ant(2")-Ia[2]] | Aminoglycosides | Enterobacteriaceae | | 53-54[3] |
| aacC1 [aac(3)-Ia[2]] | Aminoglycosides | Pseudomonads | | 55-56[3] |
| aacC2 [aac(3)-IIa[2]] | Aminoglycosides | Pseudomonads | | 57-58[3] |
| aacC3 [aac(3)-III[2]] | Aminoglycosides | Pseudomonads | | 59-60[3] |
| aacA4 [aac(6')-Ib[2]] | Aminoglycosides | Pseudomonads | | 65-66[3] |
| ant(3")-Ia[2] | Aminoglycosides | Enterobacteriaceae, *Enterococcus* sp., *Staphylococcus* sp. | X02340 M10241 | |
| ant(4')-Ia[2] | Aminoglycosides | *Staphylococcus* sp. | V01282 | |
| aph(3')-Ia[2] | Aminoglycosides | Enterobacteriaceae, Pseudomonads | J01839 | |
| aph(3')-IIa[2] | Aminoglycosides | Enterobacteriaceae, Pseudomonads | V00618 | |
| aph(3')-IIIa[2] | Aminoglycosides | *Enterococcus* sp., *Staphylococcus* sp. | V01547 | |
| aph(3')-VIa[2] | Aminoglycosides | Enterobacteriaceae, Pseudomonads | X07753 | |
| rpsL[2] | Streptomycin | *M. tuberculosis*, *M. avium* complex | X80120 U14749 X70995 L08011 | |
| $bla_{OXA}$[5,6] | β-lactams | Enterobacteriaceae, Pseudomonads | Y10693 AJ238349 AJ009819 X06046 X03037 X07260 U13880 X75562 AF034958 J03427 Z22590 U59183 L38523 U63835 | 110[4] |

TABLE 5-continued

Antimicrobial agents resistance genes selected for diagnostic purposes

| Gene | Antimicrobial agent | Bacteria[1] | ACCESSION NO. | SEQ ID NO. |
|---|---|---|---|---|
| | | | AF043100 | |
| | | | AF060206 | |
| | | | U85514 | |
| | | | AF043381 | |
| | | | AF024602 | |
| | | | AF064820 | |
| $bla_{ROB}$[5] | β-lactams | *Haemophilus* sp. | | 45-48[3] |
| $bla_{SHV}$[5,6] | β-lactams | Enterobacteriacea, | AF124984 | 41-44[3] |
| | | *Pseudomonas aeruginosa* | AF148850 | |
| | | | M59181 | |
| | | | X98099 | |
| | | | M33655 | |
| | | | AF148851 | |
| | | | X53433 | |
| | | | L47119 | |
| | | | AF074954 | |
| | | | X53817 | |
| | | | AF096930 | |
| | | | X55640 | |
| | | | Y11069 | |
| | | | U20270 | |
| | | | U92041 | |
| | | | S82452 | |
| | | | X98101 | |
| | | | X98105 | |
| | | | AF164577 | |
| | | | AJ011428 | |
| | | | AF116855 | |
| | | | AB023477 | |
| | | | AF293345 | |
| | | | AF227204 | |
| | | | AF208796 | |
| | | | AF132290 | |
| $bla_{TEM}$[5,6] | β-lactams | Enterobacteriaceae, | AF012911 | 37-40[3] |
| | | *Neisseria* sp., | U48775 | |
| | | *Haemophilus* sp. | AF093512 | |
| | | | AF052748 | |
| | | | X64523 | |
| | | | Y13612 | |
| | | | X57972 | |
| | | | AF157413 | |
| | | | U31280 | |
| | | | U36911 | |
| | | | U48775 | |
| | | | V00613 | |
| | | | X97254 | |
| | | | AJ012256 | |
| | | | X04515 | |
| | | | AF126482 | |
| | | | U09188 | |
| | | | M88143 | |
| | | | Y14574 | |
| | | | AF188200 | |
| | | | AJ251946 | |
| | | | Y17581 | |
| | | | Y17582 | |
| | | | Y17583 | |
| | | | M88143 | |
| | | | U37195 | |
| | | | Y17584 | |
| | | | X64523 | |
| | | | U95363 | |
| | | | Y10279 | |
| | | | Y10280 | |
| | | | Y10281 | |
| | | | AF027199 | |
| | | | AF104441 | |
| | | | AF104442 | |
| | | | AF062386 | |
| | | | X57972 | |
| | | | AF047171 | |
| | | | AF188199 | |
| | | | AF157553 | |
| | | | AF190694 | |
| | | | AF190695 | |

TABLE 5-continued

| Antimicrobial agents resistance genes selected for diagnostic purposes | | | | |
|---|---|---|---|---|
| Gene | Antimicrobial agent | Bacteria[1] | ACCESSION NO. | SEQ ID NO. |
| | | | AF190693 | |
| | | | AF190692 | |
| $bla_{SHV}$[5,6] | β-lactams | Enterobacteriacea, | AF124984 | 41-44[3] |
| | | *Pseudomonas aeruginosa* | AF148850 | |
| | | | M59181 | |
| | | | X98099 | |
| | | | M33655 | |
| | | | AF148851 | |
| | | | X53433 | |
| | | | L47119 | |
| | | | AF074954 | |
| | | | X53817 | |
| | | | AF096930 | |
| | | | X55640 | |
| | | | Y11069 | |
| | | | U20270 | |
| | | | U92041 | |
| | | | S82452 | |
| | | | X98101 | |
| | | | X98105 | |
| | | | AF164577 | |
| | | | AJ011428 | |
| | | | AF116855 | |
| | | | AB023477 | |
| | | | AF293345 | |
| | | | AF227204 | |
| | | | AF208796 | |
| | | | AF132290 | |
| $bla_{TEM}$[5,6] | β-lactams | Enterobacteriaceae, | AF012911 | 37-40[3] |
| | | *Neisseria* sp., | U48775 | |
| | | *Haemophilus* sp. | AF093512 | |
| | | | AF052748 | |
| | | | X64523 | |
| | | | Y13612 | |
| | | | X57972 | |
| | | | AF157413 | |
| | | | U31280 | |
| | | | U36911 | |
| | | | U48775 | |
| | | | V00613 | |
| | | | X97254 | |
| | | | AJ012256 | |
| | | | X04515 | |
| | | | AF126482 | |
| | | | U09188 | |
| | | | M88143 | |
| | | | Y14574 | |
| | | | AF188200 | |
| | | | AJ251946 | |
| | | | Y17581 | |
| | | | Y17582 | |
| | | | Y17583 | |
| | | | M88143 | |
| | | | U37195 | |
| | | | Y17584 | |
| | | | X64523 | |
| | | | U95363 | |
| | | | Y10279 | |
| | | | Y10280 | |
| | | | Y10281 | |
| | | | AF027199 | |
| | | | AF104441 | |
| | | | AF104442 | |
| | | | AF062386 | |
| | | | X57972 | |
| | | | AF047171 | |
| | | | AF188199 | |
| | | | AF157553 | |
| | | | AF190694 | |
| | | | AF190695 | |
| | | | AF190693 | |
| | | | AF190692 | |

TABLE 5-continued

Antimicrobial agents resistance genes selected for diagnostic purposes

| Gene | Antimicrobial agent | Bacteria[1] | ACCESSION NO. | SEQ ID NO. |
|---|---|---|---|---|
| bla$_{CARB}$[5] | β-lactams | *Pseudomonas* sp., | J05162 | |
| | | Enterobacteriaceae | S46063 | |
| | | | M69058 | |
| | | | U14749 | |
| | | | D86225 | |
| | | | D13210 | |
| | | | Z18955 | |
| | | | AF071555 | |
| | | | AF153200 | |
| | | | AF030945 | |
| bla$_{CTX-M-1}$[5] | β-lactams | Enterobacteriaceae | X92506 | |
| bla$_{CTX-M-2}$[5] | β-lactams | Enterobacteriaceae | X92507 | |
| bla$_{CMY-2}$[7] | β-lactams | Enterobacteriaceae | X91840 | |
| | | | AJ007826 | |
| | | | AJ011293 | |
| | | | AJ011291 | |
| | | | Y17716 | |
| | | | Y16783 | |
| | | | Y16781 | |
| | | | Y15130 | |
| | | | U77414 | |
| | | | S83226 | |
| | | | Y15412 | |
| | | | X78117 | |
| bla$_{IMP}$[5] | β-lactams | Enterobacteriaceae, | AJ223604 | |
| | | *Pseudomonas aeruginosa* | S71932 | |
| | | | D50438 | |
| | | | D29636 | |
| | | | X98393 | |
| | | | AB010417 | |
| | | | D78375 | |
| bla$_{PER-1}$[5] | β-lactams | Enterobacteriaceae, | Z21957 | |
| | | Pseudomodanaceae | | |
| bla$_{PER-2}$[7] | β-lactams | Enterobacteriaceae | X93314 | |
| blaZ[12] | β-lactams | *Enterococcus* sp., | | 111[4] |
| | | *Staphylococcus* sp. | | |
| mecA[12] | β-lactams | *Staphylococcus* sp. | | 97-98[3] |
| pbp1a[13] | β-lactams | *Streptococcus pneumoniae* | M90527 | 1004-1018, |
| | | | X67872 | 1648, 2056-2064, |
| | | | AB006868 | 2273-2276 |
| | | | AB006874 | |
| | | | X67873 | |
| | | | AB006878 | |
| | | | AB006875 | |
| | | | AB006877 | |
| | | | AB006879 | |
| | | | AF046237 | |
| | | | AF046235 | |
| | | | AF026431 | |
| | | | AF046232 | |
| | | | AF046233 | |
| | | | AF046236 | |
| | | | X67871 | |
| | | | Z49095 | |
| | | | AF046234 | |
| | | | AB006873 | |
| | | | X67866 | |
| | | | X67868 | |
| | | | AB006870 | |
| | | | AB006869 | |
| | | | AB006872 | |
| | | | X67870 | |
| | | | AB006871 | |
| | | | X67867 | |
| | | | X67869 | |
| | | | AB006876 | |
| | | | AF046230 | |
| | | | AF046238 | |
| | | | Z49094 | |
| pbp2b[13] | β-lactams | *Streptococcus pneumoniae* | X16022 | 1019-1033 |
| | | | M25516 | |
| | | | M25518 | |
| | | | M25515 | |
| | | | U20071 | |
| | | | U20084 | |

TABLE 5-continued

Antimicrobial agents resistance genes selected for diagnostic purposes

| Gene | Antimicrobial agent | Bacteria[1] | ACCESSION NO. | SEQ ID NO. |
|---|---|---|---|---|
| | | | U20082 | |
| | | | U20067 | |
| | | | U20079 | |
| | | | Z22185 | |
| | | | U20072 | |
| pbp2b[13] | β-lactams | *Streptococcus pneumoniae* | U20083 | |
| | | | U20081 | |
| | | | M25522 | |
| | | | U20075 | |
| | | | U20070 | |
| | | | U20077 | |
| | | | U20068 | |
| | | | Z22184 | |
| | | | U20069 | |
| | | | U20078 | |
| | | | M25521 | |
| | | | M25525 | |
| | | | M25519 | |
| | | | Z21981 | |
| | | | M25523 | |
| | | | M25526 | |
| | | | U20076 | |
| | | | U20074 | |
| | | | M25520 | |
| | | | M25517 | |
| | | | M25524 | |
| | | | Z22230 | |
| | | | U20073 | |
| | | | U20080 | |
| pbp2x[13] | β-lactams | *Streptococcus pneumoniae* | X16367 | 1034-1048 |
| | | | X65135 | |
| | | | AB011204 | |
| | | | AB011209 | |
| | | | AB011199 | |
| | | | AB011200 | |
| | | | AB011201 | |
| | | | AB011202 | |
| | | | AB011198 | |
| | | | AB011208 | |
| | | | AB011205 | |
| | | | AB015852 | |
| | | | AB011210 | |
| | | | AB015849 | |
| | | | AB015850 | |
| | | | AB015851 | |
| | | | AB015847 | |
| | | | AB015846 | |
| | | | AB011207 | |
| | | | AB015848 | |
| | | | Z49096 | |
| int | β-lactams, trimethoprim | Enterobacteriaceae, | | 99-102[3] |
| sul | aminoglycosides, antiseptic, chloramphenicol | Pseudomonads | | 103-106[3] |
| ermA[14] | Macrolides, lincosamides, streptogramin B | *Staphylococcus* sp. | | 113[4] |
| ermB[14] | Macrolides, lincosamides, streptogramin B | Enterobacteriaceae, *Staphylococcus* sp. *Enterococcus* sp. *Streptococcus* sp. | | 114[4] |
| ermC[14] | Macrolides, lincosamides, streptogramin B | Enterobacteriaceae, *Staphylococcus* sp. | | 115[4] |
| ereA[12] | Macrolides | Enterobacteriaceae, *Staphylococcus* sp. | M11277<br>E01199<br>AF099140 | |
| ereB[12] | Macrolides | Enterobacteriaceae *Staphylococcus* sp. | A15097<br>X03988 | |
| msrA[12] | Macrolides | *Staphylococcus* sp. | | 77-80[3] |
| mefA, mefE[8] | Macrolides | *Streptococcus* sp. | U70055<br>U83667 | |

TABLE 5-continued

Antimicrobial agents resistance genes selected for diagnostic purposes

| Gene | Antimicrobial agent | Bacteria[1] | ACCESSION NO. | SEQ ID NO. |
|---|---|---|---|---|
| mphA[8] | Macrolides | Enterobacteriaceae, *Staphylococcus* sp. | D16251<br>U34344<br>U36578 | |
| linA/linA'[9] | Lincosamides | *Staphylococcus* sp. | J03947<br>M14039<br>A15070<br>E01245 | |
| linB[10] | Lincosamides | *Enterococcus faecium* | AF110130<br>AJ238249 | |
| vga[15] | Streptrogramin | *Staphylococcus* sp. | M90056<br>U82085 | 89-90[3] |
| vgb[15] | Streptrogramin | *Staphylococcus* sp. | M36022<br>M20219<br>AF015628 | |
| vat[15] | Streptrogramin | *Staphylococcus* sp. | L07778 | 87-88[3] |
| vatB[15] | Streptrogramin | *Staphylococcus* sp. | U19459<br>L38809 | |
| satA[15] | Streptrogramin | *Enterococcus faecium* | L12033 | 81-82[3] |
| mupA[12] | Mupirocin | *Staphylococcus aureus* | X75439<br>X59478<br>X59477 | |
| gyrA[16] | Quinolones | Gram-positive and gram-negative bacteria | X95718<br>X06744<br>X57174<br>X16817<br>X71437<br>AF065152<br>AF060881<br>D32252 | 1255, 1607-1608, 1764-1776, 2013-2014, 2277-2280 |
| parC/grlA[16] | Quinolones | Gram-positive and gram-negative bacteria | AB005036<br>AF056287<br>X95717<br>AF129764<br>AB017811<br>AF065152 | 1777-1785 |
| parE/grlB[16] | Quinolones | Gram-positive bacteria | X95717<br>AF065153<br>AF058920 | |
| norA[16] | Quinolones | *Staphylococcus* sp. | D90119<br>M80252<br>M97169 | |
| mexR (nalB)[16] | Quinolones | *Pseudomonas aeruginosa* | U23763 | |
| nfxB[16] | Quinolones | *Pseudomonas aeruginosa* | X65646 | |
| cat[12] | Chloramphenicol | Gram-positive and gram-negative bacteria | M55620<br>X15100<br>A24651<br>M28717<br>A00568<br>A00569<br>X74948<br>Y00723<br>A24362<br>A00569<br>M93113<br>M62822<br>M58516<br>V01277<br>X02166<br>M77169<br>X53796<br>J01841<br>X07848 | |
| ppflo-like | Chloramphenicol | | AF071555 | |
| embB[17] | Ethambutol | *Mycobacterium tuberculosis* | U68480 | |
| pncA[17] | Pyrazinamide | *Mycobacterium tuberculosis* | U59967 | |
| rpoB[17] | Rifampin | *Mycobacterium tuberculosis* | AF055891<br>AF055892<br>S71246<br>L27989<br>AF055893 | |
| inhA[17] | Isoniazid | *Mycobacterium tuberculosis* | AF106077<br>U02492 | |

TABLE 5-continued

Antimicrobial agents resistance genes selected for diagnostic purposes

| Gene | Antimicrobial agent | Bacteria[1] | ACCESSION NO. | SEQ ID NO. |
|---|---|---|---|---|
| vanA[12] | Vancomycin | *Enterococcus* sp. | | 67-70[3]<br>1049-1057 |
| vanB[12] | Vancomycin | *Enterococcus* sp. | | 116[4] |
| vanC1[12] | Vancomycin | *Enterococcus gallinarum* | | 117[4]<br>1058-1059 |
| vanC2[12] | Vancomycin | *Enterococcus casseliflavus* | U94521<br>U94522<br>U94523<br>U94524<br>U94525<br>L29638 | 1060-1063 |
| vanC3[12] | Vancomycin | *Enterococcus flavescens* | L29639<br>U72706 | 1064-1066 |
| vanD[18] | Vancomycin | *Enterococcus faecium* | AF130997 | |
| vanE[12] | Vancomycin | *Enterococcus faecium* | AF136925 | |
| tetB[19] | Tetracycline | Gram-negative bacteria | J01830<br>AF162223<br>AP000342<br>S83213<br>U81141<br>V00611 | |
| tetM[19] | Tetracycline | Gram-negative and Gram-positive bacteria | X52632<br>AF116348<br>U50983<br>X92947<br>M211136<br>U08812<br>X04388 | |
| sul II[20] | Sulfonamides | Gram-negative bacteria | M36657<br>AF017389<br>AF017391 | |
| dhfrIa[20] | Trimethoprim | Gram-negative bacteria | AJ238350<br>X17477<br>K00052<br>U09476<br>X00926 | |
| dhfrIb[20] | Trimethoprim | Gram-negative bacteria | Z50805<br>Z50804 | |
| dhfrV[20] | Trimethoprim | Gram-negative bacteria | X12868 | |
| dhfrVI[20] | Trimethoprim | Gram-negative bacteria | Z86002 | |
| dhfrVII[20] | Trimethoprim | Gram-negative bacteria | U31119<br>AF139109<br>X58425 | |
| dhfrVIII[20] | Trimethoprim | Gram-negative bacteria | U10186<br>U09273 | |
| dhfrIX[20] | Trimethoprim | Gram-negative bacteria | X57730 | |
| dhfrXII[20] | Trimethoprim | Gram-negative bacteria | Z21672<br>AF175203<br>AF180731<br>M84522 | |
| dhfrXIII[20] | Trimethoprim | Gram-negative bacteria | Z50802 | |
| dhfrXV[20] | Trimethoprim | Gram-negative bacteria | Z83331 | |
| dhfrXVII[20] | Trimethoprim | Gram-negative bacteria | AF170088<br>AF180469<br>AF169041 | |

TABLE 5-continued

Antimicrobial agents resistance genes selected for diagnostic purposes

| Gene | Antimicrobial agent | Bacteria[1] | ACCESSION NO. | SEQ ID NO. |
|---|---|---|---|---|
| dfrA[20] | Trimethoprim | *Staphylococcus* sp. | AF045472<br>U40259<br>AF051916<br>X13290<br>Y07536<br>Z16422<br>Z48233 | |

[1]Bacteria having high incidence for the specified antibiotic resistance gene. The presence of the antibiotic resistance genes in other bacteria is not excluded.
[2]Shaw, K. J., P. N. Rather, R. S. Hare, and G. H. Miller. 1993. Molecular genetics of aminoglycoside resistance genes and familial relationships of the aminoglycoside-modifying enzymes. Microbiol. Rev. 57: 138-163.
[3]Antibiotic resistance genes from our assigned U.S. Pat. No. 6,001,564 for which we have selected PCR primer pairs.
[4]These SEQ ID NOs. refer to a previous patent (publication WO98/20157).
[5]Bush, K., G. A. Jacoby and A. Medeiros. 1995. A functional classification scheme for β-lactamase and its correlation with molecular structure. Antimicrob. Agents. Chemother. 39: 1211-1233.
[6]Nucleotide mutations in $bla_{SHV}$, $bla_{TEM}$, and $bla_{OXA}$, are associated with extended-spectrum β-lactamase or inhibitor-resistant β-lactamase.
[7]Bauerfeind, A., Y. Chong, and K. Lee. 1998. Plasmid-encoded AmpC beta-lactamases: how far have we gone 10 ears after discovery? Yonsei Med. J. 39: 520-525.
[8]Sutcliffe, J., T. Grebe, A. Tait-Kamradt, and L. Wondrack. 1996. Detection of erythromycin-resistant determinants by PCR. Antimicrob. Agent Chemother. 40: 2562-2566.
[9]Leclerc, R., A., Brisson-Noël, J. Duval, and P. Courvalin. 1991. Phenotypic expression and genetic heterogeneity of lincosamide inactivation in *Staphylococcus* sp. Antimicrob. Agents. Chemother. 31: 1887-1891.
[10]Bozdogan, B., L. Berrezouga, M.-S. Kuo, D. A. Yurek, K. A. Farley, B. J. Stockman, and R. Leclercq. 1999. A new gene, linB, conferring resistance to lincosamides by nucleotidylation in *Enterococcus faecium* HM1025. Antimicrob. Agents. Chemother. 43: 925-929.
[11]Cockerill III, F. R. 1999. Genetic methods for assessing antimicrobial resistance. Antimicrob. Agents. Chemother. 43: 199-212.
[12]Tenover, F. C., T. Popovic, and O Olsvik. 1996. Genetic methods for detecting antibacterial resistance genes. pp. 1368-1378. In Murray, P. R., E. J. Baron, M. A. Pfaller, F. C. Tenover, R. H. Yolken (eds). Manual of clinical microbiology. 6th ed., ASM Press, Washington, D.C. USA
[13]Dowson, C. G., T. J. Tracey, and B. G. Spratt. 1994. Origin and molecular epidemiology of penicillin-binding-protein-mediated resistance to β-lactam antibiotics. Trends Molec. Microbiol.2: 361-366.
[14]Jensen, L. B., N. Frimodt-Moller, F. M. Aarestrup. 1999. Presence of erm gene classes in Gram-positive bacteria of animal and human origin in Denmark. FEMS Microbiol. 170: 151-158.
[15]Thal, L. A., and M. J. Zervos. 1999. Occurrence and epidemiology of resistance to virginimycin and streptrogramins. J. Antimicrob. Chemother. 43: 171-176.
[16]Martinez J. L., A. Alonso, J. M. Gomez-Gomez, and F. Baquero. 1998. Quinolone resistance by mutations in chromosomal gyrase genes. Just the tip of the iceberg? J. Antimicrob. Chemother. 42: 683-688
[17]Cockerill III, F. R. 1999. Genetic methods for assessing antimicrobial resistance. Antimicrob. Agents. Chemother. 43: 199-212.
[18]Casadewall, B. and P. Courvalin. 1999 Characterization of the vanD glycopeptide resistance gene cluster from *Enterococcus faecium* BM 4339. J. Bacteriol. 181: 3644-3648.
[19]Roberts, M. C. 1999. Genetic mobility and distribution of tetracycline resistance determinants. Ciba Found. Symp. 207: 206-222.
[20]Huovinen, P., L. Sundström, G. Swedberg, and O. Skold. 1995. Trimethoprim and sulfonamide resistance. Antimicrob. Agent Chemother. 39: 279-289.

TABLE 6

List of bacterial toxins selected for diagnostic purposes.

| Organism | Toxin | Accession number |
|---|---|---|
| *Actinobacillus actinomycetemcomitans* | Cytolethal distending toxin (cdtA, cdtB, cdtC) | AF006830 |
| | Leukotoxin (ltxA) | M27399 |
| *Actinomyces pyogenes* | Hemolysin (pyolysin) | U84782 |
| *Aeromonas hydrophila* | Aerolysin (aerA) | M16495 |
| | Haemolysin (hlyA) | U81555 |
| | Cytotonic enterotoxin (alt) | L77573 |
| *Bacillus anthracis* | Anthrax toxin (cya) | M23179 |
| *Bacillus cereus* | Enterotoxin (bceT) | D17312<br>AF192766, AF192767 |
| | Enterotoxic hemolysin BL | AJ237785 |
| | Non-haemolytic enterotoxins A, B and C (nhe) | Y19005 |
| *Bacillus mycoides* | Hemolytic enterotoxin HBL | AJ243150 to AJ243153 |
| *Bacillus pseudomycoides* | Hemolytic enterotoxin HBL | AJ243154 to AJ243156 |
| *Bacteroides fragilis* | Enterotoxin (bftP) | U67735 |
| | Matrix metalloprotease/enterotoxin (fragilysin) | S75941, AF038459 |
| | Metalloprotease toxin-2 | U90931<br>AF081785 |
| | Metalloprotease toxin-3 | AF056297 |
| *Bordetella bronchiseptica* | Adenylate cyclase hemolysin (cyaA) | Z37112, U22953 |
| | Dermonecrotic toxin (dnt) | U59687<br>AB020025 |
| *Bordetella pertussis* | Pertussis toxin (S1 subunit, tox) | AJ006151<br>AJ006153<br>AJ006155<br>AJ006157<br>AJ006159<br>AJ007363 |

TABLE 6-continued

| List of bacterial toxins selected for diagnostic purposes. | | |
|---|---|---|
| Organism | Toxin | Accession number |
| | | M14378, M16494 |
| | | AJ007364 |
| | | M13223 |
| | | X16347 |
| | Adenyl cyclase (cya) | 18323 |
| | Dermonecrotic toxin (dnt) | U10527 |
| *Campylobacter jejuni* | Cytolethal distending toxin (cdtA, cdtB, cdtC) | U51121 |
| *Citrobacter freundii* | Shiga-like toxin (slt-llcA) | X67514, S53206 |
| *Clostridium botulinum* | Botulism toxin (BoNT) (A, B, E and F serotypes are neurotoxic for humans; the other serotypes have not been considered) | X52066, X52088 |
| | | X73423 |
| | | M30196 |
| | | X70814 |
| | | X70819 |
| | | X71343 |
| | | Z11934 |
| | | X70817 |
| | | M81186 |
| | | X70818 |
| | | X70815 |
| | | X62089 |
| | | X62683 |
| | | S76749 |
| | | X81714 |
| | | X70816 |
| | | X70820 |
| | | X70281 |
| | | L35496 |
| | | M92906 |
| *Clostridium difficile* | A toxin (enterotoxin) (tcdA) (cdtA) | AB012304 |
| | | AF053400 |
| | | Y12616 |
| | | X51797 |
| | | X17194 |
| | | M30307 |
| | B toxin (cytotoxin) (toxB) (cdtB) | Z23277 |
| | | X53138 |
| *Clostridium perfringens* | Alpha (phospholipase C) (cpa) | L43545 |
| | | L43546 |
| | | L43547 |
| | | L43548 |
| | | X13608 |
| | | X17300 |
| | | D10248 |
| | Beta (dermonecrotic protein) (cpb) | L13198 |
| | | X83275 |
| | | L77965 |
| | Enterotoxin (cpe) | AJ000766 |
| | | M98037 |
| | | X81849 |
| | | X71844 |
| | | Y16009 |
| | Enterotoxin pseudogene (not expressed) | AF037328 |
| | | AF037329 |
| | | AF037330 |
| | Epsilon toxin (etxD) | M80837 |
| | | M95206 |
| | | X60694 |
| | Iota (Ia and Ib) | X73562 |
| | Lambda (metalloprotease) | D45904 |
| | Theta (perfringolysin O) | M36704 |
| *Clostridium sordellii* | Cytotoxin L | X82638 |
| *Clostridium tetani* | Tetanos toxin | X06214 |
| | | X04436 |
| *Corynebacterium diphtheriae* | Diphtheriae toxin | X00703 |
| *Corynebacterium pseudotuberculosis* | Phospholipase C | A21336 |
| *Eikenella corrodens* | lysine decarboxylase (cadA) | U89166 |
| *Enterobacter cloacae* | Shiga-like toxin II | Z50754, U33502 |
| *Enterococcus faecalis* | Cytolysin B (cylB) | M38052 |
| *Escherichia coli* (EHEC) | Hemolysin toxin (hlyA and ehxA) | AF043471 |
| | | X94129 |
| | | X79839 |
| | | X86087 |
| | | AB011549 |
| | | AF074613 |

TABLE 7

| Origin of the nucleic acids and/or sequences in the sequence listing. | | | |
|---|---|---|---|
| SEQ ID NO. | Archaeal, bacterial, fungal or parasitical species | Source | Gene* |
| 1 | *Acinetobacter baumannii* | This patent | tuf |
| 2 | *Actinomyces meyeri* | This patent | tuf |
| 3 | *Aerococcus viridans* | This patent | tuf |
| 4 | *Achromobacter xylosoxidans* subsp. *denitrificans* | This patent | tuf |
| 5 | *Anaerorhabdus furcosus* | This patent | tuf |
| 6 | *Bacillus anthracis* | This patent | tuf |
| 7 | *Bacillus cereus* | This patent | tuf |
| 8 | *Bacteroides distasonis* | This patent | tuf |
| 9 | *Enterococcus casseliflavus* | This patent | tuf |
| 10 | *Staphylococcus saprophyticus* | This patent | tuf |
| 11 | *Bacteroides ovatus* | This patent | tuf |
| 12 | *Bartonella henselae* | This patent | tuf |
| 13 | *Bifidobacterium adolescentis* | This patent | tuf |
| 14 | *Bifidobacterium dentium* | This patent | tuf |
| 15 | *Brucella abortus* | This patent | tuf |
| 16 | *Burkholderia cepacia* | This patent | tuf |
| 17 | *Cedecea davisae* | This patent | tuf |
| 18 | *Cedecea neteri* | This patent | tuf |
| 19 | *Cedecea lapagei* | This patent | tuf |
| 20 | *Chlamydia pneumoniae* | This patent | tuf |
| 21 | *Chlamydia psittaci* | This patent | tuf |
| 22 | *Chlamydia trachomatis* | This patent | tuf |
| 23 | *Chryseobacterium meningosepticum* | This patent | tuf |
| 24 | *Citrobacter amalonaticus* | This patent | tuf |
| 25 | *Citrobacter braakii* | This patent | tuf |
| 26 | *Citrobacter koseri* | This patent | tuf |
| 27 | *Citrobacter farmeri* | This patent | tuf |
| 28 | *Citrobacter freundii* | This patent | tuf |
| 29 | *Citrobacter sedlakii* | This patent | tuf |
| 30 | *Citrobacter werkmanii* | This patent | tuf |
| 31 | *Citrobacter youngae* | This patent | tuf |
| 32 | *Clostridium perfringens* | This patent | tuf |
| 33 | *Comamonas acidovorans* | This patent | tuf |
| 34 | *Corynebacterium bovis* | This patent | tuf |
| 35 | *Corynebacterium cervicis* | This patent | tuf |
| 36 | *Corynebacterium flavescens* | This patent | tuf |
| 37 | *Corynebacterium kutscheri* | This patent | tuf |
| 38 | *Corynebacterium minutissimum* | This patent | tuf |
| 39 | *Corynebacterium mycetoides* | This patent | tuf |
| 40 | *Corynebacterium pseudogenitalium* | This patent | tuf |
| 41 | *Corynebacterium renale* | This patent | tuf |
| 42 | *Corynebacterium ulcerans* | This patent | tuf |
| 43 | *Corynebacterium urealyticum* | This patent | tuf |
| 44 | *Corynebacterium xerosis* | This patent | tuf |
| 45 | *Coxiella burnetii* | This patent | tuf |
| 46 | *Edwardsiella hoshinae* | This patent | tuf |
| 47 | *Edwardsiella tarda* | This patent | tuf |
| 48 | *Eikenella corrodens* | This patent | tuf |
| 49 | *Enterobacter aerogenes* | This patent | tuf |
| 50 | *Enterobacter agglomerans* | This patent | tuf |
| 51 | *Enterobacter amnigenus* | This patent | tuf |
| 52 | *Enterobacter asburiae* | This patent | tuf |
| 53 | *Enterobacter cancerogenus* | This patent | tuf |
| 54 | *Enterobacter cloacae* | This patent | tuf |
| 55 | *Enterobacter gergoviae* | This patent | tuf |
| 56 | *Enterobacter hormaechei* | This patent | tuf |
| 57 | *Enterobacter sakazakii* | This patent | tuf |
| 58 | *Enterococcus casseliflavus* | This patent | tuf |
| 59 | *Enterococcus cecorum* | This patent | tuf |
| 60 | *Enterococcus dispar* | This patent | tuf |
| 61 | *Enterococcus durans* | This patent | tuf |
| 62 | *Enterococcus faecalis* | This patent | tuf |
| 63 | *Enterococcus faecalis* | This patent | tuf |
| 64 | *Enterococcus faecium* | This patent | tuf |
| 65 | *Enterococcus flavescens* | This patent | tuf |
| 66 | *Enterococcus gallinarum* | This patent | tuf |
| 67 | *Enterococcus hirae* | This patent | tuf |
| 68 | *Enterococcus mundtii* | This patent | tuf |
| 69 | *Enterococcus pseudoavium* | This patent | tuf |
| 70 | *Enterococcus raffinosus* | This patent | tuf |
| 71 | *Enterococcus saccharolyticus* | This patent | tuf |
| 72 | *Enterococcus solitarius* | This patent | tuf |
| 73 | *Enterococcus casseliflavus* | This patent | tuf (C) |
| 74 | *Staphylococcus saprophyticus* | This patent | unknown |
| 75 | *Enterococcus flavescens* | This patent | tuf (C) |
| 76 | *Enterococcus gallinarum* | This patent | tuf (C) |

TABLE 7-continued

Origin of the nucleic acids and/or sequences in the sequence listing.

| SEQ ID NO. | Archaeal, bacterial, fungal or parasitical species | Source | Gene* |
|---|---|---|---|
| 77 | *Ehrlichia canis* | This patent | tuf |
| 78 | *Escherichia coli* | This patent | tuf |
| 79 | *Escherichia fergusonii* | This patent | tuf |
| 80 | *Escherichia hermannii* | This patent | tuf |
| 81 | *Escherichia vulneris* | This patent | tuf |
| 82 | *Eubacterium lentum* | This patent | tuf |
| 83 | *Eubacterium nodatum* | This patent | tuf |
| 84 | *Ewingella americana* | This patent | tuf |
| 85 | *Francisella tularensis* | This patent | tuf |
| 86 | *Fusobacterium nucleatum* subsp. *polymorphum* | This patent | tuf |
| 87 | *Gemella haemolysans* | This patent | tuf |
| 88 | *Gemella morbillorum* | This patent | tuf |
| 89 | *Haemophilus actinomycetemcomitans* | This patent | tuf |
| 90 | *Haemophilus aphrophilus* | This patent | tuf |
| 91 | *Haemophilus ducreyi* | This patent | tuf |
| 92 | *Haemophilus haemolyticus* | This patent | tuf |
| 93 | *Haemophilus parahaemolyticus* | This patent | tuf |
| 94 | *Haemophilus parainfluenzae* | This patent | tuf |
| 95 | *Haemophilus paraphrophilus* | This patent | tuf |
| 96 | *Haemophilus segnis* | This patent | tuf |
| 97 | *Hafnia alvei* | This patent | tuf |
| 98 | *Kingella kingae* | This patent | tuf |
| 99 | *Klebsiella omithinolytica* | This patent | tuf |
| 100 | *Klebsiella oxytoca* | This patent | tuf |
| 101 | *Klebsiella planticola* | This patent | tuf |
| 102 | *Klebsiella pneumoniae* subsp. *ozaenae* | This patent | tuf |
| 103 | *Klebsiella pneumoniae pneumoniae* | This patent | tuf |
| 104 | *Klebsiella pneumoniae* subsp. *rhinoscleromatis* | This patent | tuf |
| 105 | *Kluyvera ascorbata* | This patent | tuf |
| 106 | *Kluyvera cryocrescens* | This patent | tuf |
| 107 | *Kluyvera georgiana* | This patent | tuf |
| 108 | *Lactobacillus casei* subsp. *casei* | This patent | tuf |
| 109 | *Lactococcus lactis* subsp. *lactis* | This patent | tuf |
| 110 | *Leclercia adecarboxylata* | This patent | tuf |
| 111 | *Legionella micdadei* | This patent | tuf |
| 112 | *Legionella pneumophila* subsp. *pneumophila* | This patent | tuf |
| 113 | *Leminorella grimontii* | This patent | tuf |
| 114 | *Leminorella richardii* | This patent | tuf |
| 115 | *Leptospira interrogans* | This patent | tuf |
| 116 | *Megamonas hypermegale* | This patent | tuf |
| 117 | *Mitsuokella multacidus* | This patent | tuf |
| 118 | *Mobiluncus curtisii* subsp. *holmesii* | This patent | tuf |
| 119 | *Moellerella wisconsensis* | This patent | tuf |
| 120 | *Moraxella catarrhalis* | This patent | tuf |
| 121 | *Morganella morganii* subsp. *morganii* | This patent | tuf |
| 122 | *Mycobacterium tuberculosis* | This patent | tuf |
| 123 | *Neisseria cinerea* | This patent | tuf |
| 124 | *Neisseria elongata* subsp. *elongata* | This patent | tuf |
| 125 | *Neisseria flavescens* | This patent | tuf |
| 126 | *Neisseria gonorrhoeae* | This patent | tuf |
| 127 | *Neisseria lactamica* | This patent | tuf |
| 128 | *Neisseria meningitidis* | This patent | tuf |
| 129 | *Neisseria mucosa* | This patent | tuf |
| 130 | *Neisseria sicca* | This patent | tuf |
| 131 | *Neisseria subflava* | This patent | tuf |
| 132 | *Neisseria weaveri* | This patent | tuf |
| 133 | *Ochrobactrum anthropi* | This patent | tuf |
| 134 | *Pantoea agglomerans* | This patent | tuf |
| 135 | *Pantoea dispersa* | This patent | tuf |
| 136 | *Pasteurella multocida* | This patent | tuf |
| 137 | *Peptostreptococcus anaerobius* | This patent | tuf |
| 138 | *Peptostreptococcus asaccharolyticus* | This patent | tuf |
| 139 | *Peptostreptococcus prevotii* | This patent | tuf |
| 140 | *Porphyromonas asaccharolytica* | This patent | tuf |
| 141 | *Porphyromonas gingivalis* | This patent | tuf |
| 142 | *Pragia fontium* | This patent | tuf |
| 143 | *Prevotella melaninogenica* | This patent | tuf |
| 144 | *Prevotella oralis* | This patent | tuf |
| 145 | *Propionibacterium acnes* | This patent | tuf |
| 146 | *Proteus mirabilis* | This patent | tuf |
| 147 | *Proteus penneri* | This patent | tuf |
| 148 | *Proteus vulgaris* | This patent | tuf |
| 149 | *Providencia alcalifaciens* | This patent | tuf |
| 150 | *Providencia rettgeri* | This patent | tuf |
| 151 | *Providencia rustigianii* | This patent | tuf |
| 152 | *Providencia stuartii* | This patent | tuf |

TABLE 7-continued

Origin of the nucleic acids and/or sequences in the sequence listing.

| SEQ ID NO. | Archaeal, bacterial, fungal or parasitical species | Source | Gene* |
|---|---|---|---|
| 153 | *Pseudomonas aeruginosa* | This patent | tuf |
| 154 | *Pseudomonas fluorescens* | This patent | tuf |
| 155 | *Pseudomonas stutzeri* | This patent | tuf |
| 156 | *Psychrobacter phenylpyruvicum* | This patent | tuf |
| 157 | *Rahnella aquatilis* | This patent | tuf |
| 158 | *Salmonella choleraesuis* subsp. *arizonae* | This patent | tuf |
| 159 | *Salmonella choleraesuis* subsp. *choleraesuis* serotype *Choleraesuis* | This patent | tuf |
| 160 | *Salmonella choleraesuis* subsp. *diarizonae* | This patent | tuf |
| 161 | *Salmonella choleraesuis* subsp. *choleraesuis* serotype Heidelberg | This patent | tuf |
| 162 | *Salmonella choleraesuis* subsp. *houtenae* | This patent | tuf |
| 163 | *Salmonella choleraesuis* subsp. *indica* | This patent | tuf |
| 164 | *Salmonella choleraesuis* subsp. *salamae* | This patent | tuf |
| 165 | *Salmonella choleraesuis* subsp. *choleraesuis* serotype *Typhi* | This patent | tuf |
| 166 | *Serratia fonticola* | This patent | tuf |
| 167 | *Serratia liquefaciens* | This patent | tuf |
| 168 | *Serratia marcescens* | This patent | tuf |
| 169 | *Serratia odorifera* | This patent | tuf |
| 170 | *Serratia plymuthica* | This patent | tuf |
| 171 | *Serratia rubidaea* | This patent | tuf |
| 172 | *Shigella boydii* | This patent | tuf |
| 173 | *Shigella dysenteriae* | This patent | tuf |
| 174 | *Shigella flexneri* | This patent | tuf |
| 175 | *Shigella sonnei* | This patent | tuf |
| 176 | *Staphylococcus aureus* | This patent | tuf |
| 177 | *Staphylococcus aureus* | This patent | tuf |
| 178 | *Staphylococcus aureus* | This patent | tuf |
| 179 | *Staphylococcus aureus* | This patent | tuf |
| 180 | *Staphylococcus aureus* subsp. *aureus* | This patent | tuf |
| 181 | *Staphylococcus auricularis* | This patent | tuf |
| 182 | *Staphylococcus capitis* subsp. *capitis* | This patent | tuf |
| 183 | *Macrococcus caseolyticus* | This patent | tuf |
| 184 | *Staphylococcus cohnii* subsp. *cohnii* | This patent | tuf |
| 185 | *Staphylococcus epidermidis* | This patent | tuf |
| 186 | *Staphylococcus haemolyticus* | This patent | tuf |
| 187 | *Staphylococcus warneri* | This patent | tuf |
| 188 | *Staphylococcus haemolyticus* | This patent | tuf |
| 189 | *Staphylococcus haemolyticus* | This patent | tuf |
| 190 | *Staphylococcus haemolyticus* | This patent | tuf |
| 191 | *Staphylococcus hominis* subsp. *hominis* | This patent | tuf |
| 192 | *Staphylococcus warneri* | This patent | tuf |
| 193 | *Staphylococcus hominis* | This patent | tuf |
| 194 | *Staphylococcus hominis* | This patent | tuf |
| 195 | *Staphylococcus hominis* | This patent | tuf |
| 196 | *Staphylococcus hominis* | This patent | tuf |
| 197 | *Staphylococcus lugdunensis* | This patent | tuf |
| 198 | *Staphylococcus saprophyticus* | This patent | tuf |
| 199 | *Staphylococcus saprophyticus* | This patent | tuf |
| 200 | *Staphylococcus saprophyticus* | This patent | tuf |
| 201 | *Staphylococcus sciuri* subsp. *sciuri* | This patent | tuf |
| 202 | *Staphylococcus warneri* | This patent | tuf |
| 203 | *Staphylococcus warneri* | This patent | tuf |
| 204 | *Bifidobacterium longum* | This patent | tuf |
| 205 | *Stenotrophomonas maltophilia* | This patent | tuf |
| 206 | *Streptococcus acidominimus* | This patent | tuf |
| 207 | *Streptococcus agalactiae* | This patent | tuf |
| 208 | *Streptococcus agalactiae* | This patent | tuf |
| 209 | *Streptococcus agalactiae* | This patent | tuf |
| 210 | *Streptococcus agalactiae* | This patent | tuf |
| 211 | *Streptococcus anginosus* | This patent | tuf |
| 212 | *Streptococcus bovis* | This patent | tuf |
| 213 | *Streptococcus anginosus* | This patent | tuf |
| 214 | *Streptococcus cricetus* | This patent | tuf |
| 215 | *Streptococcus cristatus* | This patent | tuf |
| 216 | *Streptococcus downei* | This patent | tuf |
| 217 | *Streptococcus dysgalactiae* | This patent | tuf |
| 218 | *Streptococcus equi* subsp. *equi* | This patent | tuf |
| 219 | *Streptococcus ferus* | This patent | tuf |
| 220 | *Streptococcus gordonii* | This patent | tuf |
| 221 | *Streptococcus anginosus* | This patent | tuf |
| 222 | *Streptococcus macacae* | This patent | tuf |
| 223 | *Streptococcus gordonii* | This patent | tuf |
| 224 | *Streptococcus mutans* | This patent | tuf |
| 225 | *Streptococcus parasanguinis* | This patent | tuf |
| 226 | *Streptococcus ratti* | This patent | tuf |

TABLE 7-continued

Origin of the nucleic acids and/or sequences in the sequence listing.

| SEQ ID NO. | Archaeal, bacterial, fungal or parasitical species | Source | Gene* |
|---|---|---|---|
| 227 | *Streptococcus sanguinis* | This patent | tuf |
| 228 | *Streptococcus sobrinus* | This patent | tuf |
| 229 | *Streptococcus suis* | This patent | tuf |
| 230 | *Streptococcus uberis* | This patent | tuf |
| 231 | *Streptococcus vestibularis* | This patent | tuf |
| 232 | *Tatumella ptyseos* | This patent | tuf |
| 233 | *Trabulsiella guamensis* | This patent | tuf |
| 234 | *Veillonella parvula* | This patent | tuf |
| 235 | *Yersinia enterocolitica* | This patent | tuf |
| 236 | *Yersinia frederiksenii* | This patent | tuf |
| 237 | *Yersinia intermedia* | This patent | tuf |
| 238 | *Yersinia pestis* | This patent | tuf |
| 239 | *Yersinia pseudotuberculosis* | This patent | tuf |
| 240 | *Yersinia rohdei* | This patent | tuf |
| 241 | *Yokenella regensburgei* | This patent | tuf |
| 242 | *Achromobacter xylosoxidans* subsp. *denitrificans* | This patent | atpD |
| 243 | *Acinetobacter baumannii* | This patent | atpD |
| 244 | *Acinetobacter lwoffii* | This patent | atpD |
| 245 | *Staphylococcus saprophyticus* | This patent | atpD |
| 246 | *Alcaligenes faecalis* subsp. *faecalis* | This patent | atpD |
| 247 | *Bacillus anthracis* | This patent | atpD |
| 248 | *Bacillus cereus* | This patent | atpD |
| 249 | *Bacteroides distasonis* | This patent | atpD |
| 250 | *Bacteroides ovatus* | This patent | atpD |
| 251 | *Leclercia adecarboxylata* | This patent | atpD |
| 252 | *Stenotrophomonas maltophilia* | This patent | atpD |
| 253 | *Bartonella henselae* | This patent | atpD |
| 254 | *Bifidobacterium adolescentis* | This patent | atpD |
| 255 | *Brucella abortus* | This patent | atpD |
| 256 | *Cedecea davisae* | This patent | atpD |
| 257 | *Cedecea lapagei* | This patent | atpD |
| 258 | *Cedecea neteri* | This patent | atpD |
| 259 | *Chryseobacterium meningosepticum* | This patent | atpD |
| 260 | *Citrobacter amalonaticus* | This patent | atpD |
| 261 | *Citrobacter braakii* | This patent | atpD |
| 262 | *Citrobacter koseri* | This patent | atpD |
| 263 | *Citrobacter farmeri* | This patent | atpD |
| 264 | *Citrobacter freundii* | This patent | atpD |
| 265 | *Citrobacter koseri* | This patent | atpD |
| 266 | *Citrobacter sedlakii* | This patent | atpD |
| 267 | *Citrobacter werkmanii* | This patent | atpD |
| 268 | *Citrobacter youngae* | This patent | atpD |
| 269 | *Clostridium innocuum* | This patent | atpD |
| 270 | *Clostridium perfringens* | This patent | atpD |
| 272 | *Corynebacterium diphtheriae* | This patent | atpD |
| 273 | *Corynebacterium pseudodiphtheriticum* | This patent | atpD |
| 274 | *Corynebacterium ulcerans* | This patent | atpD |
| 275 | *Corynebacterium urealyticum* | This patent | atpD |
| 276 | *Coxiella burnetii* | This patent | atpD |
| 277 | *Edwardsiella hoshinae* | This patent | atpD |
| 278 | *Edwardsiella tarda* | This patent | atpD |
| 279 | *Eikenella corrodens* | This patent | atpD |
| 280 | *Enterobacter agglomerans* | This patent | atpD |
| 281 | *Enterobacter amnigenus* | This patent | atpD |
| 282 | *Enterobacter asburiae* | This patent | atpD |
| 283 | *Enterobacter cancerogenus* | This patent | atpD |
| 284 | *Enterobacter cloacae* | This patent | atpD |
| 285 | *Enterobacter gergoviae* | This patent | atpD |
| 286 | *Enterobacter hormaechei* | This patent | atpD |
| 287 | *Enterobacter sakazakii* | This patent | atpD |
| 288 | *Enterococcus avium* | This patent | atpD |
| 289 | *Enterococcus casseliflavus* | This patent | atpD |
| 290 | *Enterococcus durans* | This patent | atpD |
| 291 | *Enterococcus faecalis* | This patent | atpD |
| 292 | *Enterococcus faecium* | This patent | atpD |
| 293 | *Enterococcus gallinarum* | This patent | atpD |
| 294 | *Enterococcus saccharolyticus* | This patent | atpD |
| 295 | *Escherichia fergusonii* | This patent | atpD |
| 296 | *Escherichia hermannii* | This patent | atpD |
| 297 | *Escherichia vulneris* | This patent | atpD |
| 298 | *Eubacterium lentum* | This patent | atpD |
| 299 | *Ewingella americana* | This patent | atpD |
| 300 | *Francisella tularensis* | This patent | atpD |
| 301 | *Fusobacterium gonidiaformans* | This patent | atpD |
| 302 | *Fusobacterium necrophorum* subsp. *necrophorum* | This patent | atpD |
| 303 | *Fusobacterium nucleatum* subsp. *polymorphum* | This patent | atpD |

TABLE 7-continued

| Origin of the nucleic acids and/or sequences in the sequence listing. | | | |
|---|---|---|---|
| SEQ ID NO. | Archaeal, bacterial, fungal or parasitical species | Source | Gene* |
| 304 | *Gardnerella vaginalis* | This patent | atpD |
| 305 | *Gemella haemolysans* | This patent | atpD |
| 306 | *Gemella morbillorum* | This patent | atpD |
| 307 | *Haemophilus ducreyi* | This patent | atpD |
| 308 | *Haemophilus haemolyticus* | This patent | atpD |
| 309 | *Haemophilus parahaemolyticus* | This patent | atpD |
| 310 | *Haemophilus parainfluenzae* | This patent | atpD |
| 311 | *Hafnia alvei* | This patent | atpD |
| 312 | *Kingella kingae* | This patent | atpD |
| 313 | *Klebsiella pneumoniae* subsp. *ozaenae* | This patent | atpD |
| 314 | *Klebsiella ornithinolytica* | This patent | atpD |
| 315 | *Klebsiella oxytoca* | This patent | atpD |
| 316 | *Klebsiella planticola* | This patent | atpD |
| 317 | *Klebsiella pneumoniae* subsp. *pneumoniae* | This patent | atpD |
| 318 | *Kluyvera ascorbata* | This patent | atpD |
| 319 | *Kluyvera cryocrescens* | This patent | atpD |
| 320 | *Kluyvera georgiana* | This patent | atpD |
| 321 | *Lactobacillus acidophilus* | This patent | atpD |
| 322 | *Legionella pneumophila* subsp. *pneumophila* | This patent | atpD |
| 323 | *Leminorella grimontii* | This patent | atpD |
| 324 | *Listeria monocytogenes* | This patent | atpD |
| 325 | *Micrococcus lylae* | This patent | atpD |
| 326 | *Moellerella wisconsensis* | This patent | atpD |
| 327 | *Moraxella catarrhalis* | This patent | atpD |
| 328 | *Moraxella osloensis* | This patent | atpD |
| 329 | *Morganella morganii* subsp. *morganii* | This patent | atpD |
| 330 | *Pantoea agglomerans* | This patent | atpD |
| 331 | *Pantoea dispersa* | This patent | atpD |
| 332 | *Pasteurella multocida* | This patent | atpD |
| 333 | *Pragia fontium* | This patent | atpD |
| 334 | *Proteus mirabilis* | This patent | atpD |
| 335 | *Proteus vulgaris* | This patent | atpD |
| 336 | *Providencia alcalifaciens* | This patent | atpD |
| 337 | *Providencia rettgeri* | This patent | atpD |
| 338 | *Providencia rustigianii* | This patent | atpD |
| 339 | *Providencia stuartii* | This patent | atpD |
| 340 | *Psychrobacter phenylpyruvicum* | This patent | atpD |
| 341 | *Rahnella aquatilis* | This patent | atpD |
| 342 | *Salmonella choleraesuis* subsp. *arizonae* | This patent | atpD |
| 343 | *Salmonella choleraesuis* subsp. *choleraesuis* serotype *Choleraesuis* | This patent | atpD |
| 344 | *Salmonella choleraesuis* subsp. *diarizonae* | This patent | atpD |
| 345 | *Salmonella choleraesuis* subsp. *houtenae* | This patent | atpD |
| 346 | *Salmonella choleraesuis* subsp. *indica* | This patent | atpD |
| 347 | *Salmonella choleraesuis* subsp. *choleraesuis* serotype Paratyphi A | This patent | atpD |
| 348 | *Salmonella choleraesuis* subsp. *choleraesuis* serotype Paratyphi B | This patent | atpD |
| 349 | *Salmonella choleraesuis* subsp. *salamae* | This patent | atpD |
| 350 | *Salmonella choleraesuis* subsp. *choleraesuis* serotype *Typhi* | This patent | atpD |
| 351 | *Salmonella choleraesuis* subsp. *choleraesuis* serotype *Typhimurium* | This patent | atpD |
| 352 | *Salmonella choleraesuis* subsp. *choleraesuis* serotype Virchow | This patent | atpD |
| 353 | *Serratia ficaria* | This patent | atpD |
| 354 | *Serratia fonticola* | This patent | atpD |
| 355 | *Serratia grimesii* | This patent | atpD |
| 356 | *Serratia liquefaciens* | This patent | atpD |
| 357 | *Serratia marcescens* | This patent | atpD |
| 358 | *Serratia odorifera* | This patent | atpD |
| 359 | *Serratia plymuthica* | This patent | atpD |
| 360 | *Serratia rubidaea* | This patent | atpD |
| 361 | *Pseudomonas putida* | This patent | atpD |
| 362 | *Shigella boydii* | This patent | atpD |
| 363 | *Shigella dysenteriae* | This patent | atpD |
| 364 | *Shigella flexneri* | This patent | atpD |
| 365 | *Shigella sonnei* | This patent | atpD |
| 366 | *Staphylococcus aureus* | This patent | atpD |
| 367 | *Staphylococcus auricularis* | This patent | atpD |
| 368 | *Staphylococcus capitis* subsp. *capitis* | This patent | atpD |
| 369 | *Staphylococcus cohnii* subsp. *cohnii* | This patent | atpD |
| 370 | *Staphylococcus epidermidis* | This patent | atpD |
| 371 | *Staphylococcus haemolyticus* | This patent | atpD |
| 372 | *Staphylococcus hominis* subsp. *hominis* | This patent | atpD |
| 373 | *Staphylococcus hominis* | This patent | atpD |
| 374 | *Staphylococcus lugdunensis* | This patent | atpD |

TABLE 7-continued

Origin of the nucleic acids and/or sequences in the sequence listing.

| SEQ ID NO. | Archaeal, bacterial, fungal or parasitical species | Source | Gene* |
|---|---|---|---|
| 375 | *Staphylococcus saprophyticus* | This patent | atpD |
| 376 | *Staphylococcus simulans* | This patent | atpD |
| 377 | *Staphylococcus warneri* | This patent | atpD |
| 378 | *Streptococcus acidominimus* | This patent | atpD |
| 379 | *Streptococcus agalactiae* | This patent | atpD |
| 380 | *Streptococcus agalactiae* | This patent | atpD |
| 381 | *Streptococcus agalactiae* | This patent | atpD |
| 382 | *Streptococcus agalactiae* | This patent | atpD |
| 383 | *Streptococcus agalactiae* | This patent | atpD |
| 384 | *Streptococcus dysgalactiae* | This patent | atpD |
| 385 | *Streptococcus equi* subsp. *equi* | This patent | atpD |
| 386 | *Streptococcus anginosus* | This patent | atpD |
| 387 | *Streptococcus salivarius* | This patent | atpD |
| 388 | *Streptococcus suis* | This patent | atpD |
| 389 | *Streptococcus uberis* | This patent | atpD |
| 390 | *Tatumella ptyseos* | This patent | atpD |
| 391 | *Trabulsiella guamensis* | This patent | atpD |
| 392 | *Yersinia bercovieri* | This patent | atpD |
| 393 | *Yersinia enterocolitica* | This patent | atpD |
| 394 | *Yersinia frederiksenii* | This patent | atpD |
| 395 | *Yersinia intermedia* | This patent | atpD |
| 396 | *Yersinia pseudotuberculosis* | This patent | atpD |
| 397 | *Yersinia rohdei* | This patent | atpD |
| 398 | *Yokenella regensburgei* | This patent | atpD |
| 399 | *Yarrowia lipolytica* | This patent | tuf (EF-1) |
| 400 | *Absidia corymbifera* | This patent | tuf (EF-1) |
| 401 | *Alternaria alternata* | This patent | tuf (EF-1) |
| 402 | *Aspergillus flavus* | This patent | tuf (EF-1) |
| 403 | *Aspergillus fumigatus* | This patent | tuf (EF-1) |
| 404 | *Aspergillus fumigatus* | This patent | tuf (EF-1) |
| 405 | *Aspergillus niger* | This patent | tuf (EF-1) |
| 406 | *Blastoschizomyces capitatus* | This patent | tuf (EF-1) |
| 407 | *Candida albicans* | This patent | tuf (EF-1) |
| 408 | *Candida albicans* | This patent | tuf (EF-1) |
| 409 | *Candida albicans* | This patent | tuf (EF-1) |
| 410 | *Candida albicans* | This patent | tuf (EF-1) |
| 411 | *Candida albicans* | This patent | tuf (EF-1) |
| 412 | *Candida dubliniensis* | This patent | tuf (EF-1) |
| 413 | *Candida catenulata* | This patent | tuf (EF-1) |
| 414 | *Candida dubliniensis* | This patent | tuf (EF-1) |
| 415 | *Candida dubliniensis* | This patent | tuf (EF-1) |
| 416 | *Candida famata* | This patent | tuf (EF-1) |
| 417 | *Candida glabrata* | WO98/20157 | tuf (EF-1) |
| 418 | *Candida guilliermondii* | This patent | tuf (EF-1) |
| 419 | *Candida haemulonii* | This patent | tuf (EF-1) |
| 420 | *Candida inconspicua* | This patent | tuf (EF-1) |
| 421 | *Candida kefyr* | This patent | tuf (EF-1) |
| 422 | *Candida krusei* | WO98/20157 | tuf (EF-1) |
| 423 | *Candida lambica* | This patent | tuf (EF-1) |
| 424 | *Candida lusitaniae* | This patent | tuf (EF-1) |
| 425 | *Candida norvegensis* | This patent | tuf (EF-1) |
| 426 | *Candida parapsilosis* | WO98/20157 | tuf (EF-1) |
| 427 | *Candida rugosa* | This patent | tuf (EF-1) |
| 428 | *Candida sphaerica* | This patent | tuf (EF-1) |
| 429 | *Candida tropicalis* | WO98/20157 | tuf (EF-1) |
| 430 | *Candida utilis* | This patent | tuf (EF-1) |
| 431 | *Candida viswanathii* | This patent | tuf (EF-1) |
| 432 | *Candida zeylanoides* | This patent | tuf (EF-1) |
| 433 | *Coccidioides immitis* | This patent | tuf (EF-1) |
| 434 | *Cryptococcus albidus* | This patent | tuf (EF-1) |
| 435 | *Exophiala jeanselmei* | This patent | tuf (EF-1) |
| 436 | *Fusarium oxysporum* | This patent | tuf (EF-1) |
| 437 | *Geotrichum* sp. | This patent | tuf (EF-1) |
| 438 | *Histoplasma capsulatum* | This patent | tuf (EF-1) |
| 439 | *Issatchenkia orientalis* Kudrjanzev | This patent | tuf (EF-1) |
| 440 | *Malassezia furfur* | This patent | tuf (EF-1) |
| 441 | *Malassezia pachydermatis* | This patent | tuf (EF-1) |
| 442 | *Malbranchea filamentosa* | This patent | tuf (EF-1) |
| 443 | *Metschnikowia pulcherrima* | This patent | tuf (EF-1) |
| 444 | *Paecilomyces lilacinus* | This patent | tuf (EF-1) |
| 445 | *Paracoccidioides brasiliensis* | This patent | tuf (EF-1) |
| 446 | *Penicillium marneffei* | This patent | tuf (EF-1) |
| 447 | *Pichia anomala* | This patent | tuf (EF-1) |
| 448 | *Pichia anomala* | This patent | tuf (EF-1) |
| 449 | *Pseudallescheria boydii* | This patent | tuf (EF-1) |
| 450 | *Rhizopus oryzae* | This patent | tuf (EF-1) |

TABLE 7-continued

Origin of the nucleic acids and/or sequences in the sequence listing.

| SEQ ID NO. | Archaeal, bacterial, fungal or parasitical species | Source | Gene* |
|---|---|---|---|
| 451 | *Rhodotorula minuta* | This patent | tuf (EF-1) |
| 452 | *Sporobolomyces salmonicolor* | This patent | tuf (EF-1) |
| 453 | *Sporothrix schenckii* | This patent | tuf (EF-1) |
| 454 | *Stephanoascus ciferrii* | This patent | tuf (EF-1) |
| 455 | *Trichophyton mentagrophytes* | This patent | tuf (EF-1) |
| 456 | *Trichosporon cutaneum* | This patent | tuf (EF-1) |
| 457 | *Wangiella dermatitidis* | This patent | tuf (EF-1) |
| 458 | *Aspergillus fumigatus* | This patent | atpD |
| 459 | *Blastoschizomyces capitatus* | This patent | atpD |
| 460 | *Candida albicans* | This patent | atpD |
| 461 | *Candida dubliniensis* | This patent | atpD |
| 462 | *Candida famata* | This patent | atpD |
| 463 | *Candida glabrata* | This patent | atpD |
| 464 | *Candida guilliermondii* | This patent | atpD |
| 465 | *Candida haemulonii* | This patent | atpD |
| 466 | *Candida inconspicua* | This patent | atpD |
| 467 | *Candida kefyr* | This patent | atpD |
| 468 | *Candida krusei* | This patent | atpD |
| 469 | *Candida lambica* | This patent | atpD |
| 470 | *Candida lusitaniae* | This patent | atpD |
| 471 | *Candida norvegensis* | This patent | atpD |
| 472 | *Candida parapsilosis* | This patent | atpD |
| 473 | *Candida rugosa* | This patent | atpD |
| 474 | *Candida sphaerica* | This patent | atpD |
| 475 | *Candida tropicalis* | This patent | atpD |
| 476 | *Candida utilis* | This patent | atpD |
| 477 | *Candida viswanathii* | This patent | atpD |
| 478 | *Candida zeylanoides* | This patent | atpD |
| 479 | *Coccidioides immitis* | This patent | atpD |
| 480 | *Cryptococcus albidus* | This patent | atpD |
| 481 | *Fusarium oxysporum* | This patent | atpD |
| 482 | *Geotrichum* sp. | This patent | atpD |
| 483 | *Histoplasma capsulatum* | This patent | atpD |
| 484 | *Malassezia furfur* | This patent | atpD |
| 485 | *Malassezia pachydermatis* | This patent | atpD |
| 486 | *Metschnikowia pulcherrima* | This patent | atpD |
| 487 | *Penicillium marneffei* | This patent | atpD |
| 488 | *Pichia anomala* | This patent | atpD |
| 489 | *Pichia anomala* | This patent | atpD |
| 490 | *Rhodotorula minuta* | This patent | atpD |
| 491 | *Rhodotorula mucilaginosa* | This patent | atpD |
| 492 | *Sporobolomyces salmonicolor* | This patent | atpD |
| 493 | *Sporothrix schenckii* | This patent | atpD |
| 494 | *Stephanoascus ciferrii* | This patent | atpD |
| 495 | *Trichophyton mentagrophytes* | This patent | atpD |
| 496 | *Wangiella dermatitidis* | This patent | atpD |
| 497 | *Yarrowia lipolytica* | This patent | atpD |
| 498 | *Aspergillus fumigatus* | This patent | tuf (M) |
| 499 | *Blastoschizomyces capitatus* | This patent | tuf (M) |
| 500 | *Candida rugosa* | This patent | tuf (M) |
| 501 | *Coccidioides immitis* | This patent | tuf (M) |
| 502 | *Fusarium oxysporum* | This patent | tuf (M) |
| 503 | *Histoplasma capsulatum* | This patent | tuf (M) |
| 504 | *Paracoccidioides brasiliensis* | This patent | tuf (M) |
| 505 | *Penicillium marneffei* | This patent | tuf (M) |
| 506 | *Pichia anomala* | This patent | tuf (M) |
| 507 | *Trichophyton mentagrophytes* | This patent | tuf (M) |
| 508 | *Yarrowia lipolytica* | This patent | tuf (M) |
| 509 | *Babesia bigemina* | This patent | tuf (EF-1) |
| 510 | *Babesia bovis* | This patent | tuf (EF-1) |
| 511 | *Crithidia fasciculata* | This patent | tuf (EF-1) |
| 512 | *Entamoeba histolytica* | This patent | tuf (EF-1) |
| 513 | *Giardia lamblia* | This patent | tuf (EF-1) |
| 514 | *Leishmania tropica* | This patent | tuf (EF-1) |
| 515 | *Leishmania aethiopica* | This patent | tuf (EF-1) |
| 516 | *Leishmania tropica* | This patent | tuf (EF-1) |
| 517 | *Leishmania donovani* | This patent | tuf (EF-1) |
| 518 | *Leishmania infantum* | This patent | tuf (EF-1) |
| 519 | *Leishmania enriettii* | This patent | tuf (EF-1) |
| 520 | *Leishmania gerbilli* | This patent | tuf (EF-1) |
| 521 | *Leishmania hertigi* | This patent | tuf (EF-1) |
| 522 | *Leishmania major* | This patent | tuf (EF-1) |
| 523 | *Leishmania amazonensis* | This patent | tuf (EF-1) |
| 524 | *Leishmania mexicana* | This patent | tuf (EF-1) |
| 525 | *Leishmania tarentolae* | This patent | tuf (EF-1) |
| 526 | *Leishmania tropica* | This patent | tuf (EF-1) |

TABLE 7-continued

Origin of the nucleic acids and/or sequences in the sequence listing.

| SEQ ID NO. | Archaeal, bacterial, fungal or parasitical species | Source | Gene* |
|---|---|---|---|
| 527 | *Neospora caninum* | This patent | tuf (EF-1) |
| 528 | *Trichomonas vaginalis* | This patent | tuf (EF-1) |
| 529 | *Trypanosoma brucei* subsp. *brucei* | This patent | tuf (EF-1) |
| 530 | *Crithidia fasciculata* | This patent | atpD |
| 531 | *Leishmania tropica* | This patent | atpD |
| 532 | *Leishmania aethiopica* | This patent | atpD |
| 533 | *Leishmania donovani* | This patent | atpD |
| 534 | *Leishmania infantum* | This patent | atpD |
| 535 | *Leishmania gerbilli* | This patent | atpD |
| 536 | *Leishmania hertigi* | This patent | atpD |
| 537 | *Leishmania major* | This patent | atpD |
| 538 | *Leishmania amazonensis* | This patent | atpD |
| 607 | *Enterococcus faecalis* | WO98/20157 | tuf |
| 608 | *Enterococcus faecium* | WO98/20157 | tuf |
| 609 | *Enterococcus gallinarum* | WO98/20157 | tuf |
| 610 | *Haemophilus influenzae* | WO98/20157 | tuf |
| 611 | *Staphylococcus epidermidis* | WO98/20157 | tuf |
| 612 | *Salmonella choleraesuis* subsp. *choleraesuis* serotype Paratyphi A | This patent | tuf |
| 613 | *Serratia ficaria* | This patent | tuf |
| 614 | *Enterococcus malodoratus* | This patent | tuf (C) |
| 615 | *Enterococcus durans* | This patent | tuf (C) |
| 616 | *Enterococcus pseudoavium* | This patent | tuf (C) |
| 617 | *Enterococcus dispar* | This patent | tuf (C) |
| 618 | *Enterococcus avium* | This patent | tuf (C) |
| 619 | *Saccharomyces cerevisiae* | Database | tuf (M) |
| 621 | *Enterococcus faecium* | This patent | tuf (C) |
| 622 | *Saccharomyces cerevisiae* | This patent | tuf (EF-1) |
| 623 | *Cryptococcus neoformans* | This patent | tuf (EF-1) |
| 624 | *Candida albicans* | WO98/20157 | tuf (EF-1) |
| 662 | *Corynebacterium diphtheriae* | WO98/20157 | tuf |
| 663 | *Candida catenulata* | This patent | atpD |
| 665 | *Saccharomyces cerevisiae* | Database | tuf (EF-1) |
| 666 | *Saccharomyces cerevisiae* | Database | atpD |
| 667 | *Trypanosoma cruzi* | This patent | atpD |
| 668 | *Corynebacterium glutamicum* | Database | tuf |
| 669 | *Escherichia coli* | Database | atpD |
| 670 | *Helicobacter pylori* | Database | atpD |
| 671 | *Clostridium acetobutylicum* | Database | atpD |
| 672 | *Cytophaga lytica* | Database | atpD |
| 673 | *Ehrlichia risticii* | This patent | atpD |
| 674 | *Vibrio cholerae* | This patent | atpD |
| 675 | *Vibrio cholerae* | This patent | tuf |
| 676 | *Leishmania enriettii* | This patent | atpD |
| 677 | *Babesia microti* | This patent | tuf (EF-1) |
| 678 | *Cryptococcus neoformans* | This patent | atpD |
| 679 | *Cryptococcus neoformans* | This patent | atpD |
| 680 | *Cunninghamella bertholletiae* | This patent | atpD |
| 684 | *Candida tropicalis* | Database | atpD (V) |
| 685 | *Enterococcus hirae* | Database | atpD (V) |
| 686 | *Chlamydia pneumoniae* | Database | atpD (V) |
| 687 | *Halobacterium salinarum* | Database | atpD (V) |
| 688 | *Homo sapiens* | Database | atpD (V) |
| 689 | *Plasmodium falciparum* | Database | atpD (V) |
| 690 | *Saccharomyces cerevisiae* | Database | atpD (V) |
| 691 | *Schizosaccharomyces pombe* | Database | atpD (V) |
| 692 | *Trypanosoma congolense* | Database | atpD (V) |
| 693 | *Thermus thermophilus* | Database | atpD (V) |
| 698 | *Escherichia coli* | WO98/20157 | tuf |
| 709 | *Borrelia burgdorferi* | Database | atpD (V) |
| 710 | *Treponema pallidum* | Database | atpD (V) |
| 711 | *Chlamydia trachomatis* | Genome project | atpD (V) |
| 712 | *Enterococcus faecalis* | Genome project | atpD (V) |
| 713 | *Methanosarcina barkeri* | Database | atpD (V) |
| 714 | *Methanococcus jannaschii* | Database | atpD (V) |
| 715 | *Porphyromonas gingivalis* | Genome project | atpD (V) |
| 716 | *Streptococcus pneumoniae* | Genome project | atpD (V) |
| 717 | *Burkholderia mallei* | This patent | tuf |
| 718 | *Burkholderia pseudomallei* | This patent | tuf |
| 719 | *Clostridium beijerinckii* | This patent | tuf |
| 720 | *Clostridium innocuum* | This patent | tuf |
| 721 | *Clostridium novyi* | This patent | tuf |
| 722 | *Clostridium septicum* | This patent | tuf |
| 723 | *Clostridium tertium* | This patent | tuf |
| 724 | *Clostridium tetani* | This patent | tuf |
| 725 | *Enterococcus malodoratus* | This patent | tuf |

TABLE 7-continued

Origin of the nucleic acids and/or sequences in the sequence listing.

| SEQ ID NO. | Archaeal, bacterial, fungal or parasitical species | Source | Gene* |
|---|---|---|---|
| 726 | *Enterococcus sulfureus* | This patent | tuf |
| 727 | *Lactococcus garvieae* | This patent | tuf |
| 728 | *Mycoplasma pirum* | This patent | tuf |
| 729 | *Mycoplasma salivarium* | This patent | tuf |
| 730 | *Neisseria polysaccharea* | This patent | tuf |
| 731 | *Salmonella choleraesuis* subsp. *choleraesuis* serotype *Enteritidis* | This patent | tuf |
| 732 | *Salmonella choleraesuis* subsp. *choleraesuis* serotype *Gallinarum* | This patent | tuf |
| 733 | *Salmonella choleraesuis* subsp. *choleraesuis* serotype Paratyphi B | This patent | tuf |
| 734 | *Salmonella choleraesuis* subsp. *choleraesuis* serotype Virchow | This patent | tuf |
| 735 | *Serratia grimesii* | This patent | tuf |
| 736 | *Clostridium difficile* | This patent | tuf |
| 737 | *Burkholderia pseudomallei* | This patent | atpD |
| 738 | *Clostridium bifermentans* | This patent | atpD |
| 739 | *Clostridium beijerinckii* | This patent | atpD |
| 740 | *Clostridium difficile* | This patent | atpD |
| 741 | *Clostridium ramosum* | This patent | atpD |
| 742 | *Clostridium septicum* | This patent | atpD |
| 743 | *Clostridium tertium* | This patent | atpD |
| 744 | *Comamonas acidovorans* | This patent | atpD |
| 745 | *Klebsiella pneumoniae* subsp. *rhinoscleromatis* | This patent | atpD |
| 746 | *Neisseria canis* | This patent | atpD |
| 747 | *Neisseria cinerea* | This patent | atpD |
| 748 | *Neisseria cuniculi* | This patent | atpD |
| 749 | *Neisseria elongata* subsp. *elongata* | This patent | atpD |
| 750 | *Neisseria flavescens* | This patent | atpD |
| 751 | *Neisseria gonorrhoeae* | This patent | atpD |
| 752 | *Neisseria gonorrhoeae* | This patent | atpD |
| 753 | *Neisseria lactamica* | This patent | atpD |
| 754 | *Neisseria meningitidis* | This patent | atpD |
| 755 | *Neisseria mucosa* | This patent | atpD |
| 756 | *Neisseria subflava* | This patent | atpD |
| 757 | *Neisseria weaveri* | This patent | atpD |
| 758 | *Neisseria animalis* | This patent | atpD |
| 759 | *Proteus penneri* | This patent | atpD |
| 760 | *Salmonella choleraesuis* subsp. *choleraesuis* serotype *Enteritidis* | This patent | atpD |
| 761 | *Yersinia pestis* | This patent | atpD |
| 762 | *Burkholderia mallei* | This patent | atpD |
| 763 | *Clostridium sordellii* | This patent | atpD |
| 764 | *Clostridium novyi* | This patent | atpD |
| 765 | *Clostridium botulinum* | This patent | atpD |
| 766 | *Clostridium histolyticum* | This patent | atpD |
| 767 | *Peptostreptococcus prevotii* | This patent | atpD |
| 768 | *Absidia corymbifera* | This patent | atpD |
| 769 | *Alternaria alternata* | This patent | atpD |
| 770 | *Aspergillus flavus* | This patent | atpD |
| 771 | *Mucor circinelloides* | This patent | atpD |
| 772 | *Piedraia hortai* | This patent | atpD |
| 773 | *Pseudallescheria boydii* | This patent | atpD |
| 774 | *Rhizopus oryzae* | This patent | atpD |
| 775 | *Scopulariopsis koningii* | This patent | atpD |
| 776 | *Trichophyton mentagrophytes* | This patent | atpD |
| 777 | *Trichophyton tonsurans* | This patent | atpD |
| 778 | *Trichosporon cutaneum* | This patent | atpD |
| 779 | *Cladophialophora carrionii* | This patent | tuf (EF-1) |
| 780 | *Cunninghamella bertholletiae* | This patent | tuf (EF-1) |
| 781 | *Curvularia lunata* | This patent | tuf (EF-1) |
| 782 | *Fonsecaea pedrosoi* | This patent | tuf (EF-1) |
| 783 | *Microsporum audouinii* | This patent | tuf (EF-1) |
| 784 | *Mucor circinelloides* | This patent | tuf (EF-1) |
| 785 | *Phialophora verrucosa* | This patent | tuf (EF-1) |
| 786 | *Saksenaea vasiformis* | This patent | tuf (EF-1) |
| 787 | *Syncephalastrum racemosum* | This patent | tuf (EF-1) |
| 788 | *Trichophyton tonsurans* | This patent | tuf (EF-1) |
| 789 | *Trichophyton mentagrophytes* | This patent | tuf (EF-1) |
| 790 | *Bipolaris hawaiiensis* | This patent | tuf (EF-1) |
| 791 | *Aspergillus fumigatus* | This patent | tuf (M) |
| 792 | *Trichophyton mentagrophytes* | This patent | tuf (M) |
| 827 | *Clostridium novyi* | This patent | atpD (V) |
| 828 | *Clostridium difficile* | This patent | atpD (V) |
| 829 | *Clostridium septicum* | This patent | atpD (V) |
| 830 | *Clostridium botulinum* | This patent | atpD (V) |

TABLE 7-continued

Origin of the nucleic acids and/or sequences in the sequence listing.

| SEQ ID NO. | Archaeal, bacterial, fungal or parasitical species | Source | Gene* |
|---|---|---|---|
| 831 | *Clostridium perfringens* | This patent | atpD (V) |
| 832 | *Clostridium tetani* | This patent | atpD (V) |
| 833 | *Streptococcus pyogenes* | Database | atpD (V) |
| 834 | *Babesia bovis* | This patent | atpD (V) |
| 835 | *Cryptosporidium parvum* | This patent | atpD (V) |
| 836 | *Leishmania infantum* | This patent | atpD (V) |
| 837 | *Leishmania major* | This patent | atpD (V) |
| 838 | *Leishmania tarentolae* | This patent | atpD (V) |
| 839 | *Trypanosoma brucei* | This patent | atpD (V) |
| 840 | *Trypanosoma cruzi* | This patent | tuf (EF-1) |
| 841 | *Trypanosoma cruzi* | This patent | tuf (EF-1) |
| 842 | *Trypanosoma cruzi* | This patent | tuf (EF-1) |
| 843 | *Babesia bovis* | This patent | tuf (M) |
| 844 | *Leishmania aethiopica* | This patent | tuf (M) |
| 845 | *Leishmania amazonensis* | This patent | tuf (M) |
| 846 | *Leishmania donovani* | This patent | tuf (M) |
| 847 | *Leishmania infantum* | This patent | tuf (M) |
| 848 | *Leishmania enriettii* | This patent | tuf (M) |
| 849 | *Leishmania gerbilli* | This patent | tuf (M) |
| 850 | *Leishmania major* | This patent | tuf (M) |
| 851 | *Leishmania mexicana* | This patent | tuf (M) |
| 852 | *Leishmania tarentolae* | This patent | tuf (M) |
| 853 | *Trypanosoma cruzi* | This patent | tuf (M) |
| 854 | *Trypanosoma cruzi* | This patent | tuf (M) |
| 855 | *Trypanosoma cruzi* | This patent | tuf (M) |
| 856 | *Babesia bigemina* | This patent | atpD |
| 857 | *Babesia bovis* | This patent | atpD |
| 858 | *Babesia microti* | This patent | atpD |
| 859 | *Leishmania guyanensis* | This patent | atpD |
| 860 | *Leishmania mexicana* | This patent | atpD |
| 861 | *Leishmania tropica* | This patent | atpD |
| 862 | *Leishmania tropica* | This patent | atpD |
| 863 | *Bordetella pertussis* | Database | tuf |
| 864 | *Trypanosoma brucei brucei* | Database | tuf (EF-1) |
| 865 | *Cryptosporidium parvum* | This patent | tuf (EF-1) |
| 866 | *Staphylococcus saprophyticus* | This patent | atpD |
| 867 | *Zoogloea ramigera* | This patent | atpD |
| 868 | *Staphylococcus saprophyticus* | This patent | tuf |
| 869 | *Enterococcus casseliflavus* | This patent | tuf |
| 870 | *Enterococcus casseliflavus* | This patent | tuf |
| 871 | *Enterococcus flavescens* | This patent | tuf |
| 872 | *Enterococcus gallinarum* | This patent | tuf |
| 873 | *Enterococcus gallinarum* | This patent | tuf |
| 874 | *Staphylococcus haemolyticus* | This patent | tuf |
| 875 | *Staphylococcus epidermidis* | This patent | tuf |
| 876 | *Staphylococcus epidermidis* | This patent | tuf |
| 877 | *Staphylococcus epidermidis* | This patent | tuf |
| 878 | *Staphylococcus epidermidis* | This patent | tuf |
| 879 | *Enterococcus gallinarum* | This patent | tuf |
| 880 | *Pseudomonas aeruginosa* | This patent | tuf |
| 881 | *Enterococcus casseliflavus* | This patent | tuf |
| 882 | *Enterococcus casseliflavus* | This patent | tuf |
| 883 | *Enterococcus faecalis* | This patent | tuf |
| 884 | *Enterococcus faecalis* | This patent | tuf |
| 885 | *Enterococcus faecium* | This patent | tuf |
| 886 | *Enterococcus faecium* | This patent | tuf |
| 887 | *Zoogloea ramigera* | This patent | tuf |
| 888 | *Enterococcus faecalis* | This patent | tuf |
| 889 | *Aspergillus fumigatus* | This patent | atpD |
| 890 | *Penicillium marneffei* | This patent | atpD |
| 891 | *Paecilomyces lilacinus* | This patent | atpD |
| 892 | *Penicillium marneffei* | This patent | atpD |
| 893 | *Sporothrix schenckii* | This patent | atpD |
| 894 | *Malbranchea filamentosa* | This patent | atpD |
| 895 | *Paecilomyces lilacinus* | This patent | atpD |
| 896 | *Aspergillus niger* | This patent | atpD |
| 897 | *Aspergillus fumigatus* | This patent | tuf (EF-1) |
| 898 | *Penicillium marneffei* | This patent | tuf (EF-1) |
| 899 | *Piedraia hortai* | This patent | tuf (EF-1) |
| 900 | *Paecilomyces lilacinus* | This patent | tuf (EF-1) |
| 901 | *Paracoccidioides brasiliensis* | This patent | tuf (EF-1) |
| 902 | *Sporothrix schenckii* | This patent | tuf (EF-1) |
| 903 | *Penicillium marneffei* | This patent | tuf (EF-1) |
| 904 | *Curvularia lunata* | This patent | tuf (M) |
| 905 | *Aspergillus niger* | This patent | tuf (M) |
| 906 | *Bipolaris hawaiiensis* | This patent | tuf (M) |

TABLE 7-continued

Origin of the nucleic acids and/or sequences in the sequence listing.

| SEQ ID NO. | Archaeal, bacterial, fungal or parasitical species | Source | Gene* |
|---|---|---|---|
| 907 | *Aspergillus flavus* | This patent | tuf (M) |
| 908 | *Alternaria alternata* | This patent | tuf (M) |
| 909 | *Penicillium marneffei* | This patent | tuf (M) |
| 910 | *Penicillium marneffei* | This patent | tuf (M) |
| 918 | *Escherichia coli* | Database | recA |
| 929 | *Bacteroides fragilis* | This patent | atpD (V) |
| 930 | *Bacteroides distasonis* | This patent | atpD (V) |
| 931 | *Porphyromonas asaccharolytica* | This patent | atpD (V) |
| 932 | *Listeria monocytogenes* | This patent | tuf |
| 939 | *Saccharomyces cerevisiae* | Database | recA (Rad51) |
| 940 | *Saccharomyces cerevisiae* | Database | recA (Dmc1) |
| 941 | *Cryptococcus humicolus* | This patent | atpD |
| 942 | *Escherichia coli* | This patent | atpD |
| 943 | *Escherichia coli* | This patent | atpD |
| 944 | *Escherichia coli* | This patent | atpD |
| 945 | *Escherichia coli* | This patent | atpD |
| 946 | *Neisseria polysaccharea* | This patent | atpD |
| 947 | *Neisseria sicca* | This patent | atpD |
| 948 | *Streptococcus mitis* | This patent | atpD |
| 949 | *Streptococcus mitis* | This patent | atpD |
| 950 | *Streptococcus mitis* | This patent | atpD |
| 951 | *Streptococcus oralis* | This patent | atpD |
| 952 | *Streptococcus pneumoniae* | This patent | atpD |
| 953 | *Streptococcus pneumoniae* | This patent | atpD |
| 954 | *Streptococcus pneumoniae* | This patent | atpD |
| 955 | *Streptococcus pneumoniae* | This patent | atpD |
| 956 | *Babesia microti* | This patent | atpD (V) |
| 957 | *Entamoeba histolytica* | This patent | atpD (V) |
| 958 | *Fusobacterium nucleatum* subsp. *polymorphum* | This patent | atpD (V) |
| 959 | *Leishmania aethiopica* | This patent | atpD (V) |
| 960 | *Leishmania tropica* | This patent | atpD (V) |
| 961 | *Leishmania guyanensis* | This patent | atpD (V) |
| 962 | *Leishmania donovani* | This patent | atpD (V) |
| 963 | *Leishmania hertigi* | This patent | atpD (V) |
| 964 | *Leishmania mexicana* | This patent | atpD (V) |
| 965 | *Leishmania tropica* | This patent | atpD (V) |
| 966 | *Peptostreptococcus anaerobius* | This patent | atpD (V) |
| 967 | *Bordetella pertussis* | This patent | tuf |
| 968 | *Bordetella pertussis* | This patent | tuf |
| 969 | *Enterococcus columbae* | This patent | tuf |
| 970 | *Enterococcus flavescens* | This patent | tuf |
| 971 | *Streptococcus pneumoniae* | This patent | tuf |
| 972 | *Escherichia coli* | This patent | tuf |
| 973 | *Escherichia coli* | This patent | tuf |
| 974 | *Escherichia coli* | This patent | tuf |
| 975 | *Escherichia coli* | This patent | tuf |
| 976 | *Mycobacterium avium* | This patent | tuf |
| 977 | *Streptococcus pneumoniae* | This patent | tuf |
| 978 | *Mycobacterium gordonae* | This patent | tuf |
| 979 | *Streptococcus pneumoniae* | This patent | tuf |
| 980 | *Mycobacterium tuberculosis* | This patent | tuf |
| 981 | *Staphylococcus warneri* | This patent | tuf |
| 982 | *Streptococcus mitis* | This patent | tuf |
| 983 | *Streptococcus mitis* | This patent | tuf |
| 984 | *Streptococcus mitis* | This patent | tuf |
| 985 | *Streptococcus oralis* | This patent | tuf |
| 986 | *Streptococcus pneumoniae* | This patent | tuf |
| 987 | *Enterococcus hirae* | This patent | tuf (C) |
| 988 | *Enterococcus mundtii* | This patent | tuf (C) |
| 989 | *Enterococcus raffinosus* | This patent | tuf (C) |
| 990 | *Bacillus anthracis* | This patent | recA |
| 991 | *Prevotella melaninogenica* | This patent | recA |
| 992 | *Enterococcus casseliflavus* | This patent | tuf |
| 993 | *Streptococcus pyogenes* | Database | speA |
| 1002 | *Streptococcus pyogenes* | WO98/20157 | tuf |
| 1003 | *Bacillus cereus* | This patent | recA |
| 1004 | *Streptococcus pneumoniae* | This patent | pbp1a |
| 1005 | *Streptococcus pneumoniae* | This patent | pbp1a |
| 1006 | *Streptococcus pneumoniae* | This patent | pbp1a |
| 1007 | *Streptococcus pneumoniae* | This patent | pbp1a |
| 1008 | *Streptococcus pneumoniae* | This patent | pbp1a |
| 1009 | *Streptococcus pneumoniae* | This patent | pbp1a |
| 1010 | *Streptococcus pneumoniae* | This patent | pbp1a |
| 1011 | *Streptococcus pneumoniae* | This patent | pbp1a |
| 1012 | *Streptococcus pneumoniae* | This patent | pbp1a |
| 1013 | *Streptococcus pneumoniae* | This patent | pbp1a |

TABLE 7-continued

Origin of the nucleic acids and/or sequences in the sequence listing.

| SEQ ID NO. | Archaeal, bacterial, fungal or parasitical species | Source | Gene* |
|---|---|---|---|
| 1014 | *Streptococcus pneumoniae* | This patent | pbp1a |
| 1015 | *Streptococcus pneumoniae* | This patent | pbp1a |
| 1016 | *Streptococcus pneumoniae* | This patent | pbp1a |
| 1017 | *Streptococcus pneumoniae* | This patent | pbp1a |
| 1018 | *Streptococcus pneumoniae* | This patent | pbp1a |
| 1019 | *Streptococcus pneumoniae* | This patent | pbp2b |
| 1020 | *Streptococcus pneumoniae* | This patent | pbp2b |
| 1021 | *Streptococcus pneumoniae* | This patent | pbp2b |
| 1022 | *Streptococcus pneumoniae* | This patent | pbp2b |
| 1023 | *Streptococcus pneumoniae* | This patent | pbp2b |
| 1024 | *Streptococcus pneumoniae* | This patent | pbp2b |
| 1025 | *Streptococcus pneumoniae* | This patent | pbp2b |
| 1026 | *Streptococcus pneumoniae* | This patent | pbp2b |
| 1027 | *Streptococcus pneumoniae* | This patent | pbp2b |
| 1028 | *Streptococcus pneumoniae* | This patent | pbp2b |
| 1029 | *Streptococcus pneumoniae* | This patent | pbp2b |
| 1030 | *Streptococcus pneumoniae* | This patent | pbp2b |
| 1031 | *Streptococcus pneumoniae* | This patent | pbp2b |
| 1032 | *Streptococcus pneumoniae* | This patent | pbp2b |
| 1033 | *Streptococcus pneumoniae* | This patent | pbp2b |
| 1034 | *Streptococcus pneumoniae* | This patent | pbp2x |
| 1035 | *Streptococcus pneumoniae* | This patent | pbp2x |
| 1036 | *Streptococcus pneumoniae* | This patent | pbp2x |
| 1037 | *Streptococcus pneumoniae* | This patent | pbp2x |
| 1038 | *Streptococcus pneumoniae* | This patent | pbp2x |
| 1039 | *Streptococcus pneumoniae* | This patent | pbp2x |
| 1040 | *Streptococcus pneumoniae* | This patent | pbp2x |
| 1041 | *Streptococcus pneumoniae* | This patent | pbp2x |
| 1042 | *Streptococcus pneumoniae* | This patent | pbp2x |
| 1043 | *Streptococcus pneumoniae* | This patent | pbp2x |
| 1044 | *Streptococcus pneumoniae* | This patent | pbp2x |
| 1045 | *Streptococcus pneumoniae* | This patent | pbp2x |
| 1046 | *Streptococcus pneumoniae* | This patent | pbp2x |
| 1047 | *Streptococcus pneumoniae* | This patent | pbp2x |
| 1048 | *Streptococcus pneumoniae* | This patent | pbp2x |
| 1049 | *Enterococcus faecium* | This patent | vanA |
| 1050 | *Enterococcus gallinarum* | This patent | vanA |
| 1051 | *Enterococcus faecium* | This patent | vanA |
| 1052 | *Enterococcus faecium* | This patent | vanA |
| 1053 | *Enterococcus faecium* | This patent | vanA |
| 1054 | *Enterococcus faecalis* | This patent | vanA |
| 1055 | *Enterococcus gallinarum* | This patent | vanA |
| 1056 | *Enterococcus faecium* | This patent | vanA |
| 1057 | *Enterococcus flavescens* | This patent | vanA |
| 1058 | *Enterococcus gallinarum* | This patent | vanC1 |
| 1059 | *Enterococcus gallinarum* | This patent | vanC1 |
| 1060 | *Enterococcus casseliflavus* | This patent | vanC2 |
| 1061 | *Enterococcus casseliflavus* | This patent | vanC2 |
| 1062 | *Enterococcus casseliflavus* | This patent | vanC2 |
| 1063 | *Enterococcus casseliflavus* | This patent | vanC2 |
| 1064 | *Enterococcus flavescens* | This patent | vanC3 |
| 1065 | *Enterococcus flavescens* | This patent | vanC3 |
| 1066 | *Enterococcus flavescens* | This patent | vanC3 |
| 1067 | *Enterococcus faecium* | This patent | vanXY |
| 1068 | *Enterococcus faecium* | This patent | vanXY |
| 1069 | *Enterococcus faecium* | This patent | vanXY |
| 1070 | *Enterococcus faecalis* | This patent | vanXY |
| 1071 | *Enterococcus gallinarum* | This patent | vanXY |
| 1072 | *Enterococcus faecium* | This patent | vanXY |
| 1073 | *Enterococcus flavescens* | This patent | vanXY |
| 1074 | *Enterococcus faecium* | This patent | vanXY |
| 1075 | *Enterococcus gallinarum* | This patent | vanXY |
| 1076 | *Escherichia coli* | Database | $stx_1$ |
| 1077 | *Escherichia coli* | Database | $stx_2$ |
| 1093 | *Staphylococcus saprophyticus* | This patent | unknown |
| 1117 | *Enterococcus faecium* | Database | vanB |
| 1138 | *Enterococcus gallinarum* | Database | vanC1 |
| 1139 | *Enterococcus faecium* | Database | vanA |
| 1140 | *Enterococcus casseliflavus* | Database | vanC2 |
| 1141 | *Enterococcus faecium* | Database | vanHAXY |
| 1169 | *Streptococcus pneumoniae* | Database | pbp1a |
| 1172 | *Streptococcus pneumoniae* | Database | pbp2b |
| 1173 | *Streptococcus pneumoniae* | Database | pbp2x |
| 1178 | *Staphylococcus aureus* | Database | mecA |
| 1183 | *Streptococcus pneumoniae* | Database | hexA |
| 1184 | *Streptococcus pneumoniae* | This patent | hexA |

TABLE 7-continued

| Origin of the nucleic acids and/or sequences in the sequence listing. | | | |
|---|---|---|---|
| SEQ ID NO. | Archaeal, bacterial, fungal or parasitical species | Source | Gene* |
| 1185 | *Streptococcus pneumoniae* | This patent | hexA |
| 1186 | *Streptococcus pneumoniae* | This patent | hexA |
| 1187 | *Streptococcus pneumoniae* | This patent | hexA |
| 1188 | *Streptococcus oralis* | This patent | hexA |
| 1189 | *Streptococcus mitis* | This patent | hexA |
| 1190 | *Streptococcus mitis* | This patent | hexA |
| 1191 | *Streptococcus mitis* | This patent | hexA |
| 1198 | *Staphylococcus saprophyticus* | This patent | unknown |
| 1215 | *Streptococcus pyogenes* | Database | pcp |
| 1230 | *Escherichia coli* | Database | tuf (EF-G) |
| 1242 | *Enterococcus faecium* | Database | ddl |
| 1243 | *Enterococcus faecalis* | Database | mtlF, mtlD |
| 1244 | *Staphylococcus aureus* subsp. *aureus* | This patent | unknown |
| 1245 | *Bacillus anthracis* | This patent | atpD |
| 1246 | *Bacillus mycoides* | This patent | atpD |
| 1247 | *Bacillus thuringiensis* | This patent | atpD |
| 1248 | *Bacillus thuringiensis* | This patent | atpD |
| 1249 | *Bacillus thuringiensis* | This patent | atpD |
| 1250 | *Bacillus weihenstephanensis* | This patent | atpD |
| 1251 | *Bacillus thuringiensis* | This patent | atpD |
| 1252 | *Bacillus thuringiensis* | This patent | atpD |
| 1253 | *Bacillus cereus* | This patent | atpD |
| 1254 | *Bacillus cereus* | This patent | atpD |
| 1255 | *Staphylococcus aureus* | This patent | gyrA |
| 1256 | *Bacillus weihenstephanensis* | This patent | atpD |
| 1257 | *Bacillus anthracis* | This patent | atpD |
| 1258 | *Bacillus thuringiensis* | This patent | atpD |
| 1259 | *Bacillus cereus* | This patent | atpD |
| 1260 | *Bacillus cereus* | This patent | atpD |
| 1261 | *Bacillus thuringiensis* | This patent | atpD |
| 1262 | *Bacillus thuringiensis* | This patent | atpD |
| 1263 | *Bacillus thuringiensis* | This patent | atpD |
| 1264 | *Bacillus thuringiensis* | This patent | atpD |
| 1265 | *Bacillus anthracis* | This patent | atpD |
| 1266 | *Paracoccidioides brasiliensis* | This patent | tuf (EF-1) |
| 1267 | *Blastomyces dermatitidis* | This patent | tuf (EF-1) |
| 1268 | *Histoplasma capsulatum* | This patent | tuf (EF-1) |
| 1269 | *Trichophyton rubrum* | This patent | tuf (EF-1) |
| 1270 | *Microsporum canis* | This patent | tuf (EF-1) |
| 1271 | *Aspergillus versicolor* | This patent | tuf (EF-1) |
| 1272 | *Exophiala moniliae* | This patent | tuf (EF-1) |
| 1273 | *Hortaea werneckii* | This patent | tuf (EF-1) |
| 1274 | *Fusarium solani* | This patent | tuf (EF-1) |
| 1275 | *Aureobasidium pullulans* | This patent | tuf (EF-1) |
| 1276 | *Blastomyces dermatitidis* | This patent | tuf (EF-1) |
| 1277 | *Exophiala dermatitidis* | This patent | tuf (EF-1) |
| 1278 | *Fusarium moniliforme* | This patent | tuf (EF-1) |
| 1279 | *Aspergillus terreus* | This patent | tuf (EF-1) |
| 1280 | *Aspergillus fumigatus* | This patent | tuf (EF-1) |
| 1281 | *Cryptococcus laurentii* | This patent | tuf (EF-1) |
| 1282 | *Emmonsia parva* | This patent | tuf (EF-1) |
| 1283 | *Fusarium solani* | This patent | tuf (EF-1) |
| 1284 | *Sporothrix schenckii* | This patent | tuf (EF-1) |
| 1285 | *Aspergillus nidulans* | This patent | tuf (EF-1) |
| 1286 | *Cladophialophora carrionii* | This patent | tuf (EF-1) |
| 1287 | *Exserohilum rostratum* | This patent | tuf (EF-1) |
| 1288 | *Bacillus thuringiensis* | This patent | recA |
| 1289 | *Bacillus thuringiensis* | This patent | recA |
| 1299 | *Staphylococcus aureus* | Database | gyrA |
| 1300 | *Escherichia coli* | Database | gyrA |
| 1307 | *Staphylococcus aureus* | Database | gyrB |
| 1320 | *Escherichia coli* | Database | parC (grlA) |
| 1321 | *Staphylococcus aureus* | Database | parC (grlA) |
| 1328 | *Staphylococcus aureus* | Database | parE (grlB) |
| 1348 | *unidentified bacterium* | Database | aac2Ia |
| 1351 | *Pseudomonas aeruginosa* | Database | aac3Ib |
| 1356 | *Serratia marcescens* | Database | aac3IIb |
| 1361 | *Escherichia coli* | Database | aac3IVa |
| 1366 | *Enterobacter cloacae* | Database | aac3VIa |
| 1371 | *Citrobacter koseri* | Database | aac6Ia |
| 1376 | *Serratia marcescens* | Database | aac6Ic |
| 1381 | *Escherichia coli* | Database | ant3Ia |
| 1386 | *Staphylococcus aureus* | Database | ant4Ia |
| 1391 | *Escherichia coli* | Database | aph3Ia |
| 1396 | *Escherichia coli* | Database | aph3IIa |
| 1401 | *Enterococcus faecalis* | Database | aph3IIIa |

TABLE 7-continued

Origin of the nucleic acids and/or sequences in the sequence listing.

| SEQ ID NO. | Archaeal, bacterial, fungal or parasitical species | Source | Gene* |
|---|---|---|---|
| 1406 | *Acinetobacter baumannii* | Database | aph3VIa |
| 1411 | *Pseudomonas aeruginosa* | Database | blaCARB |
| 1416 | *Klebsiella pneumoniae* | Database | blaCMY-2 |
| 1423 | *Escherichia coli* | Database | blaCTX-M-1 |
| 1428 | *Salmonella choleraesuis* subsp. *choleraesuis* serotype *Typhimurium* | Database | blaCTX-M-2 |
| 1433 | *Pseudomonas aeruginosa* | Database | blaIMP |
| 1438 | *Escherichia coli* | Database | blaOXA2 |
| 1439 | *Pseudomonas aeruginosa* | Database | blaOXA10 |
| 1442 | *Pseudomonas aeruginosa* | Database | blaPER1 |
| 1445 | *Salmonella choleraesuis* subsp. *choleraesuis* serotype *Typhimurium* | Database | blaPER2 |
| 1452 | *Staphylococcus epidermidis* | Database | dfrA |
| 1461 | *Escherichia coli* | Database | dhfrIa |
| 1470 | *Escherichia coli* | Database | dhfrIb |
| 1475 | *Escherichia coli* | Database | dhfrV |
| 1480 | *Proteus mirabilis* | Database | dhfrVI |
| 1489 | *Escherichia coli* | Database | dhfrVII |
| 1494 | *Escherichia coli* | Database | dhfrVIII |
| 1499 | *Escherichia coli* | Database | dhfrIX |
| 1504 | *Escherichia coli* | Database | dhfrXII |
| 1507 | *Escherichia coli* | Database | dhfrXIII |
| 1512 | *Escherichia coli* | Database | dhfrXV |
| 1517 | *Escherichia coli* | Database | dhfrXVII |
| 1518 | *Acinetobacter lwoffii* | This patent | fusA |
| 1519 | *Acinetobacter lwoffii* | This patent | fusA-tuf spacer |
| 1520 | *Acinetobacter lwoffii* | This patent | tuf |
| 1521 | *Haemophilus influenzae* | This patent | fusA |
| 1522 | *Haemophilus influenzae* | This patent | fusA-tuf spacer |
| 1523 | *Haemophilus influenzae* | This patent | tuf |
| 1524 | *Proteus mirabilis* | This patent | fusA |
| 1525 | *Proteus mirabilis* | This patent | fusA-tuf spacer |
| 1526 | *Proteus mirabilis* | This patent | tuf |
| 1527 | *Campylobacter curvus* | This patent | atpD |
| 1530 | *Escherichia coli* | Database | ereA |
| 1535 | *Escherichia coli* | Database | ereB |
| 1540 | *Staphylococcus haemolyticus* | Database | linA |
| 1545 | *Enterococcus faecium* | Database | linB |
| 1548 | *Streptococcus pyogenes* | Database | mefA |
| 1551 | *Streptococcus pneumoniae* | Database | mefE |
| 1560 | *Escherichia coli* | Database | mphA |
| 1561 | *Candida albicans* | This patent | tuf (EF-1) |
| 1562 | *Candida dubliniensis* | This patent | tuf (EF-1) |
| 1563 | *Candida famata* | This patent | tuf (EF-1) |
| 1564 | *Candida glabrata* | This patent | tuf (EF-1) |
| 1565 | *Candida guilliermondii* | This patent | tuf (EF-1) |
| 1566 | *Candida haemulonii* | This patent | tuf (EF-1) |
| 1567 | *Candida kefyr* | This patent | tuf (EF-1) |
| 1568 | *Candida lusitaniae* | This patent | tuf (EF-1) |
| 1569 | *Candida sphaerica* | This patent | tuf (EF-1) |
| 1570 | *Candida tropicalis* | This patent | tuf (EF-1) |
| 1571 | *Candida viswanathii* | This patent | tuf (EF-1) |
| 1572 | *Alcaligenes faecalis* subsp. *faecalis* | This patent | tuf |
| 1573 | *Prevotella buccalis* | This patent | tuf |
| 1574 | *Succinivibrio dextrinosolvens* | This patent | tuf |
| 1575 | *Tetragenococcus halophilus* | This patent | tuf |
| 1576 | *Campylobacter jejuni* subsp. *jejuni* | This patent | atpD |
| 1577 | *Campylobacter rectus* | This patent | atpD |
| 1578 | *Enterococcus casseliflavus* | This patent | fusA |
| 1579 | *Enterococcus gallinarum* | This patent | fusA |
| 1580 | *Streptococcus mitis* | This patent | fusA |
| 1585 | *Enterococcus faecium* | Database | satG |
| 1590 | Cloning vector pFW16 | Database | tetM |
| 1594 | *Enterococcus faecium* | Database | vanD |
| 1599 | *Enterococcus faecalis* | Database | vanE |
| 1600 | *Campylobacter jejuni* subsp. *doylei* | This patent | atpD |
| 1601 | *Enterococcus sulfureus* | This patent | atpD |
| 1602 | *Enterococcus solitarius* | This patent | atpD |
| 1603 | *Campylobacter sputorum* subsp. *sputorum* | This patent | atpD |
| 1604 | *Enterococcus pseudoavium* | This patent | atpD |
| 1607 | *Klebsiella ornithinolytica* | This patent | gyrA |
| 1608 | *Klebsiella oxytoca* | This patent | gyrA |
| 1613 | *Staphylococcus aureus* | Database | vatB |
| 1618 | *Staphylococcus cohnii* | Database | vatC |
| 1623 | *Staphylococcus aureus* | Database | vga |
| 1628 | *Staphylococcus aureus* | Database | vgaB |

TABLE 7-continued

Origin of the nucleic acids and/or sequences in the sequence listing.

| SEQ ID NO. | Archaeal, bacterial, fungal or parasitical species | Source | Gene* |
|---|---|---|---|
| 1633 | *Staphylococcus aureus* | Database | vgb |
| 1638 | *Aspergillus fumigatus* | This patent | atpD |
| 1639 | *Aspergillus fumigatus* | This patent | atpD |
| 1640 | *Bacillus mycoides* | This patent | atpD |
| 1641 | *Bacillus mycoides* | This patent | atpD |
| 1642 | *Bacillus mycoides* | This patent | atpD |
| 1643 | *Bacillus pseudomycoides* | This patent | atpD |
| 1644 | *Bacillus pseudomycoides* | This patent | atpD |
| 1645 | *Budvicia aquatica* | This patent | atpD |
| 1646 | *Buttiauxella agrestis* | This patent | atpD |
| 1647 | *Candida norvegica* | This patent | atpD |
| 1648 | *Streptococcus pneumoniae* | This patent | pbp1a |
| 1649 | *Campylobacter lari* | This patent | atpD |
| 1650 | *Coccidioides immitis* | This patent | atpD |
| 1651 | *Emmonsia parva* | This patent | atpD |
| 1652 | *Erwinia amylovora* | This patent | atpD |
| 1653 | *Fonsecaea pedrosoi* | This patent | atpD |
| 1654 | *Fusarium moniliforme* | This patent | atpD |
| 1655 | *Klebsiella oxytoca* | This patent | atpD |
| 1656 | *Microsporum audouinii* | This patent | atpD |
| 1657 | *Obesumbacterium proteus* | This patent | atpD |
| 1658 | *Paracoccidioides brasiliensis* | This patent | atpD |
| 1659 | *Plesiomonas shigelloides* | This patent | atpD |
| 1660 | *Shewanella putrefaciens* | This patent | atpD |
| 1662 | *Campylobacter curvus* | This patent | tuf |
| 1663 | *Campylobacter rectus* | This patent | tuf |
| 1664 | *Fonsecaea pedrosoi* | This patent | tuf |
| 1666 | *Microsporum audouinii* | This patent | tuf |
| 1667 | *Piedraia hortai* | This patent | tuf |
| 1668 | *Escherichia coli* | Database | tuf |
| 1669 | *Saksenaea vasiformis* | This patent | tuf |
| 1670 | *Trichophyton tonsurans* | This patent | tuf |
| 1671 | *Enterobacter aerogenes* | This patent | atpD |
| 1672 | *Bordetella pertussis* | Database | atpD |
| 1673 | *Arcanobacterium haemolyticum* | This patent | tuf |
| 1674 | *Butyrivibrio fibrisolvens* | This patent | tuf |
| 1675 | *Campylobacter jejuni* subsp. *doylei* | This patent | tuf |
| 1676 | *Campylobacter lari* | This patent | tuf |
| 1677 | *Campylobacter sputorum* subsp. *sputorum* | This patent | tuf |
| 1678 | *Campylobacter upsaliensis* | This patent | tuf |
| 1679 | *Globicatella sanguis* | This patent | tuf |
| 1680 | *Lactobacillus acidophilus* | This patent | tuf |
| 1681 | *Leuconostoc mesenteroides* subsp. *dextranicum* | This patent | tuf |
| 1682 | *Prevotella buccalis* | This patent | tuf |
| 1683 | *Ruminococcus bromii* | This patent | tuf |
| 1684 | *Paracoccidioides brasiliensis* | This patent | atpD |
| 1685 | *Candida norvegica* | This patent | tuf (EF-1) |
| 1686 | *Aspergillus nidulans* | This patent | tuf |
| 1687 | *Aspergillus terreus* | This patent | tuf |
| 1688 | *Candida norvegica* | This patent | tuf |
| 1689 | *Candida parapsilosis* | This patent | tuf |
| 1702 | *Streptococcus gordonii* | WO98/20157 | recA |
| 1703 | *Streptococcus mutans* | WO98/20157 | recA |
| 1704 | *Streptococcus pneumoniae* | WO98/20157 | recA |
| 1705 | *Streptococcus pyogenes* | WO98/20157 | recA |
| 1706 | *Streptococcus salivarius* subsp. *thermophilus* | WO98/20157 | recA |
| 1707 | *Escherichia coli* | WO98/20157 | oxa |
| 1708 | *Enterococcus faecalis* | WO98/20157 | blaZ |
| 1709 | *Pseudomonas aeruginosa* | WO98/20157 | aac6'-IIa |
| 1710 | *Staphylococcus aureus* | WO98/20157 | ermA |
| 1711 | *Escherichia coli* | WO98/20157 | ermB |
| 1712 | *Staphylococcus aureus* | WO98/20157 | ermC |
| 1713 | *Enterococcus faecalis* | WO98/20157 | vanB |
| 1714 | *Campylobacter jejuni* subsp. *jejuni* | This patent | recA |
| 1715 | *Abiotrophia adiacens* | WO98/20157 | tuf |
| 1716 | *Abiotrophia defectiva* | WO98/20157 | tuf |
| 1717 | *Corynebacterium accolens* | WO98/20157 | tuf |
| 1718 | *Corynebacterium genitalium* | WO98/20157 | tuf |
| 1719 | *Corynebacterium jeikeium* | WO98/20157 | tuf |
| 1720 | *Corynebacterium pseudodiphtheriticum* | WO98/20157 | tuf |
| 1721 | *Corynebacterium striatum* | WO98/20157 | tuf |
| 1722 | *Enterococcus avium* | WO98/20157 | tuf |
| 1723 | *Gardnerella vaginalis* | WO98/20157 | tuf |
| 1724 | *Listeria innocua* | WO98/20157 | tuf |
| 1725 | *Listeria ivanovii* | WO98/20157 | tuf |
| 1726 | *Listeria monocytogenes* | WO98/20157 | tuf |

TABLE 7-continued

Origin of the nucleic acids and/or sequences in the sequence listing.

| SEQ ID NO. | Archaeal, bacterial, fungal or parasitical species | Source | Gene* |
|---|---|---|---|
| 1727 | *Listeria seeligeri* | WO98/20157 | tuf |
| 1728 | *Staphylococcus aureus* | WO98/20157 | tuf |
| 1729 | *Staphylococcus saprophyticus* | WO98/20157 | tuf |
| 1730 | *Staphylococcus simulans* | WO98/20157 | tuf |
| 1731 | *Streptococcus agalactiae* | WO98/20157 | tuf |
| 1732 | *Streptococcus pneumoniae* | WO98/20157 | tuf |
| 1733 | *Streptococcus salivarius* | WO98/20157 | tuf |
| 1734 | *Agrobacterium radiobacter* | WO98/20157 | tuf |
| 1735 | *Bacillus subtilis* | WO98/20157 | tuf |
| 1736 | *Bacteroides fragilis* | WO98/20157 | tuf |
| 1737 | *Borrelia burgdorferi* | WO98/20157 | tuf |
| 1738 | *Brevibacterium linens* | WO98/20157 | tuf |
| 1739 | *Chlamydia trachomatis* | WO98/20157 | tuf |
| 1740 | *Fibrobacter succinogenes* | WO98/20157 | tuf |
| 1741 | *Flavobacterium ferrugineum* | WO98/20157 | tuf |
| 1742 | *Helicobacter pylori* | WO98/20157 | tuf |
| 1743 | *Micrococcus luteus* | WO98/20157 | tuf |
| 1744 | *Mycobacterium tuberculosis* | WO98/20157 | tuf |
| 1745 | *Mycoplasma genitalium* | WO98/20157 | tuf |
| 1746 | *Neisseria gonorrhoeae* | WO98/20157 | tuf |
| 1747 | *Rickettsia prowazekii* | WO98/20157 | tuf |
| 1748 | *Salmonella choleraesuis* subsp. *choleraesuis* serotype *Typhimurium* | WO98/20157 | tuf |
| 1749 | *Shewanella putrefaciens* | WO98/20157 | tuf |
| 1750 | *Stigmatella aurantiaca* | WO98/20157 | tuf |
| 1751 | *Thiomonas cuprina* | WO98/20157 | tuf |
| 1752 | *Treponema pallidum* | WO98/20157 | tuf |
| 1753 | *Ureaplasma urealyticum* | WO98/20157 | tuf |
| 1754 | *Wolinella succinogenes* | WO98/20157 | tuf |
| 1755 | *Burkholderia cepacia* | WO98/20157 | tuf |
| 1756 | *Bacillus anthracis* | This patent | recA |
| 1757 | *Bacillus anthracis* | This patent | recA |
| 1758 | *Bacillus cereus* | This patent | recA |
| 1759 | *Bacillus cereus* | This patent | recA |
| 1760 | *Bacillus mycoides* | This patent | recA |
| 1761 | *Bacillus pseudomycoides* | This patent | recA |
| 1762 | *Bacillus thuringiensis* | This patent | recA |
| 1763 | *Bacillus thuringiensis* | This patent | recA |
| 1764 | *Klebsiella oxytoca* | This patent | gyrA |
| 1765 | *Klebsiella pneumoniae* subsp. *ozaenae* | This patent | gyrA |
| 1766 | *Klebsiella planticola* | This patent | gyrA |
| 1767 | *Klebsiella pneumoniae* | This patent | gyrA |
| 1768 | *Klebsiella pneumoniae* subsp. *pneumoniae* | This patent | gyrA |
| 1769 | *Klebsiella pneumoniae* subsp. *pneumoniae* | This patent | gyrA |
| 1770 | *Klebsiella pneumoniae* subsp. *rhinoscleromatis* | This patent | gyrA |
| 1771 | *Klebsiella terrigena* | This patent | gyrA |
| 1772 | *Legionella pneumophila* subsp. *pneumophila* | This patent | gyrA |
| 1773 | *Proteus mirabilis* | This patent | gyrA |
| 1774 | *Providencia rettgeri* | This patent | gyrA |
| 1775 | *Proteus vulgaris* | This patent | gyrA |
| 1776 | *Yersinia enterocolitica* | This patent | gyrA |
| 1777 | *Klebsiella oxytoca* | This patent | parC (grlA) |
| 1778 | *Klebsiella oxytoca* | This patent | parC (grlA) |
| 1779 | *Klebsiella pneumoniae* subsp. *ozaenae* | This patent | parC (grlA) |
| 1780 | *Klebsiella planticola* | This patent | parC (grlA) |
| 1781 | *Klebsiella pneumoniae* | This patent | parC (grlA) |
| 1782 | *Klebsiella pneumoniae* subsp. *pneumoniae* | This patent | parC (grlA) |
| 1783 | *Klebsiella pneumoniae* subsp. *pneumoniae* | This patent | parC (grlA) |
| 1784 | *Klebsiella pneumoniae* subsp. *rhinoscleromatis* | This patent | parC (grlA) |
| 1785 | *Klebsiella terrigena* | This patent | parC (grlA) |
| 1786 | *Bacillus cereus* | This patent | fusA |
| 1787 | *Bacillus cereus* | This patent | fusA |
| 1788 | *Bacillus anthracis* | This patent | fusA |
| 1789 | *Bacillus cereus* | This patent | fusA |
| 1790 | *Bacillus anthracis* | This patent | fusA |
| 1791 | *Bacillus pseudomycoides* | This patent | fusA |
| 1792 | *Bacillus cereus* | This patent | fusA |
| 1793 | *Bacillus anthracis* | This patent | fusA |
| 1794 | *Bacillus cereus* | This patent | fusA |
| 1795 | *Bacillus weihenstephanensis* | This patent | fusA |
| 1796 | *Bacillus mycoides* | This patent | fusA |
| 1797 | *Bacillus thuringiensis* | This patent | fusA |
| 1798 | *Bacillus weihenstephanensis* | This patent | fusA-tuf spacer |
| 1799 | *Bacillus thuringiensis* | This patent | fusA-tuf spacer |
| 1800 | *Bacillus anthracis* | This patent | fusA-tuf spacer |
| 1801 | *Bacillus pseudomycoides* | This patent | fusA-tuf spacer |

TABLE 7-continued

| Origin of the nucleic acids and/or sequences in the sequence listing. | | | |
|---|---|---|---|
| SEQ ID NO. | Archaeal, bacterial, fungal or parasitical species | Source | Gene* |
| 1802 | *Bacillus anthracis* | This patent | fusA-tuf spacer |
| 1803 | *Bacillus cereus* | This patent | fusA-tuf spacer |
| 1804 | *Bacillus cereus* | This patent | fusA-tuf spacer |
| 1805 | *Bacillus mycoides* | This patent | fusA-tuf spacer |
| 1806 | *Bacillus cereus* | This patent | fusA-tuf spacer |
| 1807 | *Bacillus cereus* | This patent | fusA-tuf spacer |
| 1808 | *Bacillus cereus* | This patent | fusA-tuf spacer |
| 1809 | *Bacillus anthracis* | This patent | fusA-tuf spacer |
| 1810 | *Bacillus mycoides* | This patent | tuf |
| 1811 | *Bacillus thuringiensis* | This patent | tuf |
| 1812 | *Bacillus cereus* | This patent | tuf |
| 1813 | *Bacillus weihenstephanensis* | This patent | tuf |
| 1814 | *Bacillus anthracis* | This patent | tuf |
| 1815 | *Bacillus cereus* | This patent | tuf |
| 1816 | *Bacillus cereus* | This patent | tuf |
| 1817 | *Bacillus anthracis* | This patent | tuf |
| 1818 | *Bacillus cereus* | This patent | tuf |
| 1819 | *Bacillus anthracis* | This patent | tuf |
| 1820 | *Bacillus pseudomycoides* | This patent | tuf |
| 1821 | *Bacillus cereus* | This patent | tuf |
| 1822 | *Streptococcus oralis* | This patent | fusA |
| 1823 | *Budvicia aquatica* | This patent | fusA |
| 1824 | *Buttiauxella agrestis* | This patent | fusA |
| 1825 | *Klebsiella oxytoca* | This patent | fusA |
| 1826 | *Plesiomonas shigelloides* | This patent | fusA |
| 1827 | *Shewanella putrefaciens* | This patent | fusA |
| 1828 | *Obesumbacterium proteus* | This patent | fusA |
| 1829 | *Klebsiella oxytoca* | This patent | fusA-tuf spacer |
| 1830 | *Budvicia aquatica* | This patent | fusA-tuf spacer |
| 1831 | *Plesiomonas shigelloides* | This patent | fusA-tuf spacer |
| 1832 | *Obesumbacterium proteus* | This patent | fusA-tuf spacer |
| 1833 | *Shewanella putrefaciens* | This patent | fusA-tuf spacer |
| 1834 | *Buttiauxella agrestis* | This patent | fusA-tuf spacer |
| 1835 | *Campylobacter coli* | This patent | tuf |
| 1836 | *Campylobacter fetus* subsp. *fetus* | This patent | tuf |
| 1837 | *Campylobacter fetus* subsp. *venerealis* | This patent | tuf |
| 1838 | *Buttiauxella agrestis* | This patent | tuf |
| 1839 | *Klebsiella oxytoca* | This patent | tuf |
| 1840 | *Plesiomonas shigelloides* | This patent | tuf |
| 1841 | *Shewanella putrefaciens* | This patent | tuf |
| 1842 | *Obesumbacterium proteus* | This patent | tuf |
| 1843 | *Budvicia aquatica* | This patent | tuf |
| 1844 | *Abiotrophia adiacens* | This patent | atpD |
| 1845 | *Arcanobacterium haemolyticum* | This patent | atpD |
| 1846 | *Basidiobolus ranarum* | This patent | atpD |
| 1847 | *Blastomyces dermatitidis* | This patent | atpD |
| 1848 | *Blastomyces dermatitidis* | This patent | atpD |
| 1849 | *Campylobacter coli* | This patent | atpD |
| 1850 | *Campylobacter fetus* subsp. *fetus* | This patent | atpD |
| 1851 | *Campylobacter fetus* subsp. *venerealis* | This patent | atpD |
| 1852 | *Campylobacter gracilis* | This patent | atpD |
| 1853 | *Campylobacter jejuni* subsp. *jejuni* | This patent | atpD |
| 1854 | *Enterococcus cecorum* | This patent | atpD |
| 1855 | *Enterococcus columbae* | This patent | atpD |
| 1856 | *Enterococcus dispar* | This patent | atpD |
| 1857 | *Enterococcus malodoratus* | This patent | atpD |
| 1858 | *Enterococcus mundtii* | This patent | atpD |
| 1859 | *Enterococcus raffinosus* | This patent | atpD |
| 1860 | *Globicatella sanguis* | This patent | atpD |
| 1861 | *Lactococcus garvieae* | This patent | atpD |
| 1862 | *Lactococcus lactis* | This patent | atpD |
| 1863 | *Listeria ivanovii* | This patent | atpD |
| 1864 | *Succinivibrio dextrinosolvens* | This patent | atpD |
| 1865 | *Tetragenococcus halophilus* | This patent | atpD |
| 1866 | *Campylobacter fetus* subsp. *fetus* | This patent | recA |
| 1867 | *Campylobacter fetus* subsp. *venerealis* | This patent | recA |
| 1868 | *Campylobacter jejuni* subsp. *jejuni* | This patent | recA |
| 1869 | *Enterococcus avium* | This patent | recA |
| 1870 | *Enterococcus faecium* | This patent | recA |
| 1871 | *Listeria monocytogenes* | This patent | recA |
| 1872 | *Streptococcus mitis* | This patent | recA |
| 1873 | *Streptococcus oralis* | This patent | recA |
| 1874 | *Aspergillus fumigatus* | This patent | tuf (M) |
| 1875 | *Aspergillus versicolor* | This patent | tuf (M) |
| 1876 | *Basidiobolus ranarum* | This patent | tuf (M) |
| 1877 | *Campylobacter gracilis* | This patent | tuf |

TABLE 7-continued

Origin of the nucleic acids and/or sequences in the sequence listing.

| SEQ ID NO. | Archaeal, bacterial, fungal or parasitical species | Source | Gene* |
|---|---|---|---|
| 1878 | *Campylobacter jejuni* subsp. *jejuni* | This patent | tuf |
| 1879 | *Coccidioides immitis* | This patent | tuf (M) |
| 1880 | *Erwinia amylovora* | This patent | tuf |
| 1881 | *Salmonella choleraesuis* subsp. *choleraesuis* serotype *Typhimurium* | This patent | tuf |
| 1899 | *Klebsiella pneumoniae* | Database | blaSHV |
| 1900 | *Klebsiella pneumoniae* | Database | blaSHV |
| 1901 | *Escherichia coli* | Database | blaSHV |
| 1902 | *Klebsiella pneumoniae* | Database | blaSHV |
| 1903 | *Klebsiella pneumoniae* | Database | blaSHV |
| 1904 | *Escherichia coli* | Database | blaSHV |
| 1905 | *Pseudomonas aeruginosa* | Database | blaSHV |
| 1927 | *Neisseria meningitidis* | Database | blaTEM |
| 1928 | *Escherichia coli* | Database | blaTEM |
| 1929 | *Klebsiella oxytoca* | Database | blaTEM |
| 1930 | *Escherichia coli* | Database | blaTEM |
| 1931 | *Escherichia coli* | Database | blaTEM |
| 1932 | *Escherichia coli* | Database | blaTEM |
| 1933 | *Escherichia coli* | Database | blaTEM |
| 1954 | *Klebsiella pneumoniae* subsp. *pneumoniae* | Database | gyrA |
| 1956 | *Candida inconspicua* | This patent | tuf (M) |
| 1957 | *Candida utilis* | This patent | tuf (M) |
| 1958 | *Candida zeylanoides* | This patent | tuf (M) |
| 1959 | *Candida catenulata* | This patent | tuf (M) |
| 1960 | *Candida krusei* | This patent | tuf (M) |
| 1965 | Plasmid pGS05 | Database | sulII |
| 1970 | Transposon Tn10 | Database | tetB |
| 1985 | *Cryptococcus neoformans* | Database | tuf (EF-1) |
| 1986 | *Cryptococcus neoformans* | Database | tuf (EF-1) |
| 1987 | *Saccharomyces cerevisiae* | Database | tuf (EF-1) |
| 1988 | *Saccharomyces cerevisiae* | Database | tuf (EF-1) |
| 1989 | *Eremothecium gossypii* | Database | tuf (EF-1) |
| 1990 | *Eremothecium gossypii* | Database | tuf (EF-1) |
| 1991 | *Aspergillus oryzae* | Database | tuf (EF-1) |
| 1992 | *Aureobasidium pullulans* | Database | tuf (EF-1) |
| 1993 | *Histoplasma capsulatum* | Database | tuf (EF-1) |
| 1994 | *Neurospora crassa* | Database | tuf (EF-1) |
| 1995 | *Podospora anserina* | Database | tuf (EF-1) |
| 1996 | *Podospora curvicolla* | Database | tuf (EF-1) |
| 1997 | *Sordaria macrospora* | Database | tuf (EF-1) |
| 1998 | *Trichoderma reesei* | Database | tuf (EF-1) |
| 2004 | *Candida albicans* | Database | tuf (M) |
| 2005 | *Schizosaccharomyces pombe* | Database | tuf (M) |
| 2010 | *Klebsiella pneumoniae* | Database | blaTEM |
| 2011 | *Klebsiella pneumoniae* | Database | blaTEM |
| 2013 | *Kluyvera ascorbata* | This patent | gyrA |
| 2014 | *Kluyvera georgiana* | This patent | gyrA |
| 2047 | *Streptococcus pneumoniae* | Database | pbp1A |
| 2048 | *Streptococcus pneumoniae* | Database | pbp1A |
| 2049 | *Streptococcus pneumoniae* | Database | pbp1A |
| 2050 | *Streptococcus pneumoniae* | Database | pbp1A |
| 2051 | *Streptococcus pneumoniae* | Database | pbp1A |
| 2052 | *Streptococcus pneumoniae* | Database | pbp1A |
| 2053 | *Streptococcus pneumoniae* | Database | pbp1A |
| 2054 | *Streptococcus pneumoniae* | Database | gyrA |
| 2055 | *Streptococcus pneumoniae* | Database | parC |
| 2056 | *Streptococcus pneumoniae* | This patent | pbp1A |
| 2057 | *Streptococcus pneumoniae* | This patent | pbp1A |
| 2058 | *Streptococcus pneumoniae* | This patent | pbp1A |
| 2059 | *Streptococcus pneumoniae* | This patent | pbp1A |
| 2060 | *Streptococcus pneumoniae* | This patent | pbp1A |
| 2061 | *Streptococcus pneumoniae* | This patent | pbp1A |
| 2062 | *Streptococcus pneumoniae* | This patent | pbp1A |
| 2063 | *Streptococcus pneumoniae* | This patent | pbp1A |
| 2064 | *Streptococcus pneumoniae* | This patent | pbp1A |
| 2072 | *Mycobacterium tuberculosis* | Database | rpoB |
| 2097 | *Mycoplasma pneumoniae* | Database | tuf |
| 2101 | *Mycobacterium tuberculosis* | Database | inhA |
| 2105 | *Mycobacterium tuberculosis* | Database | embB |
| 2129 | *Clostridium difficile* | Database | cdtA |
| 2130 | *Clostridium difficile* | Database | cdtB |
| 2137 | *Pseudomonas putida* | Genome project | tuf |
| 2138 | *Pseudomonas aeruginosa* | Genome project | tuf |
| 2139 | *Campylobacter jejuni* | Database | atpD |
| 2140 | *Streptococcus pneumoniae* | Database | pbp1a |
| 2144 | *Staphylococcus aureus* | Database | mupA |

TABLE 7-continued

Origin of the nucleic acids and/or sequences in the sequence listing.

| SEQ ID NO. | Archaeal, bacterial, fungal or parasitical species | Source | Gene* |
|---|---|---|---|
| 2147 | *Escherichia coli* | Database | catI |
| 2150 | *Escherichia coli* | Database | catII |
| 2153 | *Shigella flexneri* | Database | catIII |
| 2156 | *Clostridium perfringens* | Database | catP |
| 2159 | *Staphylococcus aureus* | Database | cat |
| 2162 | *Staphylococcus aureus* | Database | cat |
| 2165 | *Salmonella typhimurium* | Database | ppflo-like |
| 2183 | *Alcaligenes faecalis* subsp. *faecalis* | This patent | tuf |
| 2184 | *Campylobacter coli* | This patent | fusA |
| 2185 | *Succinivibrio dextrinosolvens* | This patent | tuf |
| 2186 | *Tetragenococcus halophilus* | This patent | tuf |
| 2187 | *Campylobacter jejuni* subsp. *jejuni* | This patent | fusA |
| 2188 | *Campylobacter jejuni* subsp. *jejuni* | This patent | fusA |
| 2189 | *Leishmania guyanensis* | This patent | atpD |
| 2190 | *Trypanosoma brucei brucei* | This patent | atpD |
| 2191 | *Aspergillus nidulans* | This patent | atpD |
| 2192 | *Leishmania panamensis* | This patent | atpD |
| 2193 | *Aspergillus nidulans* | This patent | tuf (M) |
| 2194 | *Aureobasidium pullulans* | This patent | tuf (M) |
| 2195 | *Emmonsia parva* | This patent | tuf (M) |
| 2196 | *Exserohilum rostratum* | This patent | tuf (M) |
| 2197 | *Fusarium moniliforme* | This patent | tuf (M) |
| 2198 | *Fusarium solani* | This patent | tuf (M) |
| 2199 | *Histoplasma capsulatum* | This patent | tuf (M) |
| 2200 | *Kocuria kristinae* | This patent | tuf |
| 2201 | *Vibrio mimicus* | This patent | tuf |
| 2202 | *Citrobacter freundii* | This patent | recA |
| 2203 | *Clostridium botulinum* | This patent | recA |
| 2204 | *Francisella tularensis* | This patent | recA |
| 2205 | *Peptostreptococcus anaerobius* | This patent | recA |
| 2206 | *Peptostreptococcus asaccharolyticus* | This patent | recA |
| 2207 | *Providencia stuartii* | This patent | recA |
| 2208 | *Salmonella choleraesuis* subsp. *choleraesuis* serotype Paratyphi A | This patent | recA |
| 2209 | *Salmonella choleraesuis* subsp. *choleraesuis* serotype *Typhimurium* | This patent | recA |
| 2210 | *Staphylococcus saprophyticus* | This patent | recA |
| 2211 | *Yersinia pseudotuberculosis* | This patent | recA |
| 2212 | *Zoogloea ramigera* | This patent | recA |
| 2214 | *Abiotrophia adiacens* | This patent | fusA |
| 2215 | *Acinetobacter baumannii* | This patent | fusA |
| 2216 | *Actinomyces meyeri* | This patent | fusA |
| 2217 | *Clostridium difficile* | This patent | fusA |
| 2218 | *Corynebacterium diphtheriae* | This patent | fusA |
| 2219 | *Enterobacter cloacae* | This patent | fusA |
| 2220 | *Klebsiella pneumoniae* subsp. *pneumoniae* | This patent | fusA |
| 2221 | *Listeria monocytogenes* | This patent | fusA |
| 2222 | *Mycobacterium avium* | This patent | fusA |
| 2223 | *Mycobacterium gordonae* | This patent | fusA |
| 2224 | *Mycobacterium kansasii* | This patent | fusA |
| 2225 | *Mycobacterium terrae* | This patent | fusA |
| 2226 | *Neisseria polysaccharea* | This patent | fusA |
| 2227 | *Staphylococcus epidermidis* | This patent | fusA |
| 2228 | *Staphylococcus haemolyticus* | This patent | fusA |
| 2229 | *Succinivibrio dextrinosolvens* | This patent | fusA |
| 2230 | *Tetragenococcus halophilus* | This patent | fusA |
| 2231 | *Veillonella parvula* | This patent | fusA |
| 2232 | *Yersinia pseudotuberculosis* | This patent | fusA |
| 2233 | *Zoogloea ramigera* | This patent | fusA |
| 2234 | *Aeromonas hydrophila* | This patent | fusA |
| 2235 | *Abiotrophia adiacens* | This patent | fusA-tuf spacer |
| 2236 | *Acinetobacter baumannii* | This patent | fusA-tuf spacer |
| 2237 | *Actinomyces meyeri* | This patent | fusA-tuf spacer |
| 2238 | *Clostridium difficile* | This patent | fusA-tuf spacer |
| 2239 | *Corynebacterium diphtheriae* | This patent | fusA-tuf spacer |
| 2240 | *Enterobacter cloacae* | This patent | fusA-tuf spacer |
| 2241 | *Klebsiella pneumoniae* subsp. *pneumoniae* | This patent | fusA-tuf spacer |
| 2242 | *Listeria monocytogenes* | This patent | fusA-tuf spacer |
| 2243 | *Mycobacterium avium* | This patent | fusA-tuf spacer |
| 2244 | *Mycobacterium gordonae* | This patent | fusA-tuf spacer |
| 2245 | *Mycobacterium kansasii* | This patent | fusA-tuf spacer |
| 2246 | *Mycobacterium terrae* | This patent | fusA-tuf spacer |
| 2247 | *Neisseria polysaccharea* | This patent | fusA-tuf spacer |
| 2248 | *Staphylococcus epidermidis* | This patent | fusA-tuf spacer |
| 2249 | *Staphylococcus haemolyticus* | This patent | fusA-tuf spacer |
| 2255 | *Abiotrophia adiacens* | This patent | tuf |

TABLE 7-continued

Origin of the nucleic acids and/or sequences in the sequence listing.

| SEQ ID NO. | Archaeal, bacterial, fungal or parasitical species | Source | Gene* |
|---|---|---|---|
| 2256 | *Acinetobacter baumannii* | This patent | tuf |
| 2257 | *Actinomyces meyeri* | This patent | tuf |
| 2258 | *Clostridium difficile* | This patent | tuf |
| 2259 | *Corynebacterium diphtheriae* | This patent | tuf |
| 2260 | *Enterobacter cloacae* | This patent | tuf |
| 2261 | *Klebsiella pneumoniae* subsp. *pneumoniae* | This patent | tuf |
| 2262 | *Listeria monocytogenes* | This patent | tuf |
| 2263 | *Mycobacterium avium* | This patent | tuf |
| 2264 | *Mycobacterium gordonae* | This patent | tuf |
| 2265 | *Mycobacterium kansasii* | This patent | tuf |
| 2266 | *Mycobacterium terrae* | This patent | tuf |
| 2267 | *Neisseria polysaccharea* | This patent | tuf |
| 2268 | *Staphylococcus epidermidis* | This patent | tuf |
| 2269 | *Staphylococcus haemolyticus* | This patent | tuf |
| 2270 | *Aeromonas hydrophila* | This patent | tuf |
| 2271 | *Bilophila wadsworthia* | This patent | tuf |
| 2272 | *Brevundimonas diminuta* | This patent | tuf |
| 2273 | *Streptococcus mitis* | This patent | pbp1a |
| 2274 | *Streptococcus mitis* | This patent | pbp1a |
| 2275 | *Streptococcus mitis* | This patent | pbp1a |
| 2276 | *Streptococcus oralis* | This patent | pbp1a |
| 2277 | *Escherichia coli* | This patent | gyrA |
| 2278 | *Escherichia coli* | This patent | gyrA |
| 2279 | *Escherichia coli* | This patent | gyrA |
| 2280 | *Escherichia coli* | This patent | gyrA |
| 2288 | *Enterococcus faecium* | Database | ddl |
| 2293 | *Enterococcus faecium* | Database | vanA |
| 2296 | *Enterococcus faecalis* | Database | vanB |

*tuf indicates tuf sequences, tuf (C) indicates tuf sequences divergent from main (usually A and B) copies of the elongation factor-Tu, tuf (EF-1) indicates tuf sequences of the eukaryotic type (elongation factor 1α), tuf (M) indicates tuf sequences from organellar (mostly mitochondrial) origin. fusA indicates fusA sequences; fusA-tuf spacer indicates the intergenic region between fusA and tuf. atpD indicates atpD sequences of the F-type, atpD (V) indicates atpD sequences of the V-type. recA indicates recA sequences, recA(Rad51) indicates rad51 sequences or homologs and recA(Dmc1) indicates dmc1 sequences or homologs.

TABLE 8

Bacterial species used to test the specificity of the *Streptococcus agalactiae*-specific amplification primers derived from tuf sequences.

| Strain | Reference number | Strain | Reference number |
|---|---|---|---|
| *Streptococcus acidominimus* | ATCC 51726 | *Bacteroides caccae* | ATCC 43185 |
| *Streptococcus agalactiae* | ATCC 12403 | *Bacteroides vulgatus* | ATCC 8482 |
| *Streptococcus agalactiae* | ATCC 12973 | *Bacteroides fragilis* | ATCC 25285 |
| *Streptococcus agalactiae* | ATCC 13813 | *Candida albicans* | ATCC 11006 |
| *Streptococcus agalactiae* | ATCC 27591 | *Clostridium innoculum* | ATCC 14501 |
| *Streptococcus agalactiae* | CDCs 1073 | *Clostridium ramosum* | ATCC 25582 |
| *Streptococcus anginosus* | ATCC 27335 | *Lactobacillus casei* subsp. *casei* | ATCC 393 |
| *Streptococcus anginosus* | ATCC 33397 | *Clostridium septicum* | ATCC 12464 |
| *Streptococcus bovis* | ATCC 33317 | *Corynebacterium cervicis* | NCTC 10604 |
| *Streptococcus anginosus* | ATCC 27823 | *Corynebacterium genitalium* | ATCC 33031 |
| *Streptococcus cricetus* | ATCC 19642 | *Corynebacterium urealyticum* | ATCC 43042 |
| *Streptococcus cristatus* | ATCC 51100 | *Enterococcus faecalis* | ATCC 29212 |
| *Streptococcus downei* | ATCC 33748 | *Enterococcus faecium* | ATCC 19434 |
| *Streptococcus dysgalactiae* | ATCC 43078 | *Eubacterium lentum* | ATCC 43055 |
| *Streptococcus equi* subsp. *equi* | ATCC 9528 | *Eubacterium nodutum* | ATCC 33099 |
| *Streptococcus ferus* | ATCC 33477 | *Gardnerella vaginalis* | ATCC 14018 |
| *Streptococcus gordonii* | ATCC 10558 | *Lactobacillus acidophilus* | ATCC 4356 |
| *Streptococcus macacae* | ATCC 35911 | *Lactobacillus crispatus* | ATCC 33820 |
| *Streptococcus mitis* | ATCC 49456 | *Lactobacillus gasseri* | ATCC 33323 |
| *Streptococcus mutans* | ATCC 25175 | *Lactobacillus johnsonii* | ATCC 33200 |
| *Streptococcus oralis* | ATCC 35037 | *Lactococcus lactis* subsp. *lactis* | ATCC 19435 |
| *Streptococcus parasanguinis* | ATCC 15912 | *Lactococcus lactis* subsp. *lactis* | ATCC 11454 |
| *Streptococcus parauberis* | DSM 6631 | *Listeria innocua* | ATCC 33090 |
| *Streptococcus pneumoniae* | ATCC 27336 | *Micrococcus luteus* | ATCC 9341 |
| *Streptococcus pyogenes* | ATCC 19615 | *Escherichia coli* | ATCC 25922 |
| *Streptococcus ratti* | ATCC 19645 | *Micrococcus lylae* | ATCC 27566 |
| *Streptococcus salivarius* | ATCC 7073 | *Porphyromonas asaccharolytica* | ATCC 25260 |
| *Streptococcus sanguinis* | ATCC 10556 | *Prevotella corporis* | ATCC 33547 |
| *Streptococcus sobrinus* | ATCC 27352 | *Prevotella melanogenica* | ATCC 25845 |
| *Streptococcus suis* | ATCC 43765 | *Staphylococcus aureus* | ATCC 13301 |
| *Streptococcus uberis* | ATCC 19436 | *Staphylococcus epidermidis* | ATCC 14990 |
| *Streptococcus vestubularis* | ATCC 49124 | *Staphylococcus saprophyticus* | ATCC 15305 |

TABLE 9

Bacterial species used to test the specificity of the *Streptococcus agalactiae*-specific amplification primers derived from atpD sequences.

| Strain | Reference number |
|---|---|
| *Streptococcus acidominimus* | ATCC 51726 |
| *Streptococcus agalactiae* | ATCC 12400 |
| *Streptococcus agalactiae* | ATCC 12403 |
| *Streptococcus agalactiae* | ATCC 12973 |
| *Streptococcus agalactiae* | ATCC 13813 |
| *Streptococcus agalactiae* | ATCC 27591 |
| *Streptococcus agalactiae* | CDCs-1073 |
| *Streptococcus anginosus* | ATCC 27335 |
| *Streptococcus anginosus* | ATCC 27823 |
| *Streptococcus bovis* | ATCC 33317 |
| *Streptococcus cricetus* | ATCC 19642 |
| *Streptococcus cristatus* | ATCC 51100 |
| *Streptococcus downei* | ATCC 33748 |
| *Streptococcus dysgalactiae* | ATCC 43078 |
| *Streptococcus equi* subsp. *equi* | ATCC 9528 |
| *Streptococcus ferus* | ATCC 33477 |
| *Streptococcus gordonii* | ATCC 10558 |
| *Streptococcus macacae* | ATCC 35911 |
| *Streptococcus mitis* | ATCC 49456 |
| *Streptococcus mutans* | ATCC 25175 |
| *Streptococcus oralis* | ATCC 35037 |
| *Streptococcus parasanguinis* | ATCC 15912 |
| *Streptococcus parauberis* | DSM 6631 |
| *Streptococcus pneumoniae* | ATCC 27336 |
| *Streptococcus pyogenes* | ATCC 19615 |
| *Streptococcus ratti* | ATCC 19645 |
| *Streptococcus salivarius* | ATCC 7073 |
| *Streptococcus sanguinis* | ATCC 10556 |
| *Streptococcus sobrinus* | ATCC 27352 |
| *Streptococcus suis* | ATCC 43765 |
| *Streptococcus uberis* | ATCC 19436 |
| *Streptococcus vestibularis* | ATCC 49124 |

TABLE 10

Bacterial species used to test the specificity of the *Enterococcus*-specific amplification primers derived from tuf sequences.

| Strain | Reference number |
|---|---|
| Gram-positive species (n = 74) | |
| *Abiotrophia adiacens* | ATCC 49176 |
| *Abiotrophia defectiva* | ATCC 49175 |
| *Bacillus cereus* | ATCC 14579 |
| *Bacillus subtilis* | ATCC 27370 |
| *Bifidobacterium adolescentis* | ATCC 27534 |
| *Bifidobacterium breve* | ATCC 15700 |
| *Bifidobacterium dentium* | ATCC 27534 |
| *Bifidobacterium longum* | ATCC 15707 |
| *Clostridium perfringens* | ATCC 3124 |
| *Clostridium septicum* | ATCC 12464 |
| *Corynebacterium aquaticus* | ATCC 14665 |
| *Corynebacterium pseudodiphtheriticum* | ATCC 10700 |
| *Enterococcus avium* | ATCC 14025 |
| *Enterococcus casseliflavus* | ATCC 25788 |
| *Enterococcus cecorum* | ATCC 43199 |
| *Enterococcus columbae* | ATCC 51263 |
| *Enterococcus dispar* | ATCC 51266 |
| *Enterococcus durans* | ATCC 19432 |
| *Enterococcus faecalis* | ATCC 29212 |
| *Enterococcus faecium* | ATCC 19434 |
| *Enterococcus flavescens* | ATCC 49996 |
| *Enterococcus gallinarum* | ATCC 49573 |
| *Enterococcus hirae* | ATCC 8044 |
| *Enterococcus malodoratus* | ATCC 43197 |
| *Enterococcus mundtii* | ATCC 43186 |
| *Enterococcus pseudoavium* | ATCC 49372 |
| *Enterococcus raffinosus* | ATCC 49427 |
| *Enterococcus saccharolyticus* | ATCC 43076 |
| *Enterococcus solitarius* | ATCC 49428 |

TABLE 10-continued

Bacterial species used to test the specificity of the *Enterococcus*-specific amplification primers derived from tuf sequences.

| Strain | Reference number |
|---|---|
| *Enterococcus sulfureus* | ATCC 49903 |
| *Eubacterium lentum* | ATCC 49903 |
| *Gemella haemolysans* | ATCC 10379 |
| *Gemella morbillorum* | ATCC 27842 |
| *Lactobacillus acidophilus* | ATCC 4356 |
| *Leuconostoc mesenteroides* | ATCC 19225 |
| *Listeria grayi* | ATCC 19120 |
| *Listeria grayi* | ATCC 19123 |
| *Listeria innocua* | ATCC 33090 |
| *Listeria ivanovii* | ATCC 19119 |
| *Listeria monocytogenes* | ATCC 15313 |
| *Listeria seeligeri* | ATCC 35967 |
| *Micrococcus luteus* | ATCC 9341 |
| *Pediococcus acidilacti* | ATCC 33314 |
| *Pediococcus pentosaceus* | ATCC 33316 |
| *Peptococcus niger* | ATCC 27731 |
| *Peptostreptococcus anaerobius* | ATCC 27337 |
| *Peptostreptococcus indolicus* | ATCC 29247 |
| *Peptostreptococcus micros* | ATCC 33270 |
| *Propionibacterium acnes* | ATCC 6919 |
| *Staphylococcus aureus* | ATCC 43300 |
| *Staphylococcus capitis* | ATCC 27840 |
| *Staphylococcus epidermidis* | ATCC 14990 |
| *Staphylococcus haemolyticus* | ATCC 29970 |
| *Staphylococcus hominis* | ATCC 27844 |
| *Staphylococcus lugdunensis* | ATCC 43809 |
| *Staphylococcus saprophyticus* | ATCC 15305 |
| *Staphylococcus simulans* | ATCC 27848 |
| *Staphylococcus warneri* | ATCC 27836 |
| *Streptococcus agalactiae* | ATCC 13813 |
| *Streptococcus anginosus* | ATCC 33397 |
| *Streptococcus bovis* | ATCC 33317 |
| *Streptococcus constellatus* | ATCC 27823 |
| *Streptococcus cristatus* | ATCC 51100 |
| *Streptococcus intermedius* | ATCC 27335 |
| *Streptococcus mitis* | ATCC 49456 |
| *Streptococcus mitis* | ATCC 3639 |
| *Streptococcus mutans* | ATCC 27175 |
| *Streptococcus parasanguinis* | ATCC 15912 |
| *Streptococcus pneumoniae* | ATCC 27736 |
| *Streptococcus pneumoniae* | ATCC 6303 |
| *Streptococcus pyogenes* | ATCC 19615 |
| *Streptococcus salivarius* | ATCC 7073 |
| *Streptococcus sanguinis* | ATCC 10556 |
| *Streptococcus suis* | ATCC 43765 |
| Gram-negative species (n = 39) | |
| *Acidominococcus fermentans* | ATCC 2508 |
| *Acinetobacter baumannii* | ATCC 19606 |
| *Alcaligenes faecalis* | ATCC 8750 |
| *Anaerobiospirillum succiniproducens* | ATCC 29305 |
| *Anaerorhabdus furcosus* | ATCC 25662 |
| *Bacteroides distasonis* | ATCC 8503 |
| *Bacteroides thetaiotaomicron* | ATCC 29741 |
| *Bacteroides vulgatus* | ATCC 8482 |
| *Bordetella pertussis* | LSPQ 3702 |
| *Bulkholderia cepacia* | LSPQ 2217 |
| *Butyvibrio fibrinosolvens* | ATCC 19171 |
| *Cardiobacterium hominis* | ATCC 15826 |
| *Citrobacter freundii* | ATCC 8090 |
| *Desulfovibrio vulgaris* | ATCC 29579 |
| *Edwardsiellae tarda* | ATCC 15947 |
| *Enterobacter cloacae* | ATCC 13047 |
| *Escherichia coli* | ATCC 25922 |
| *Fusobacterium russii* | ATCC 25533 |
| *Haemophilus influenzae* | ATCC 9007 |
| *Hafnia alvei* | ATCC 13337 |
| *Klebsiella oxytoca* | ATCC 13182 |
| *Meganomonas hypermegas* | ATCC 25560 |
| *Mitsukoella multiacidus* | ATCC 27723 |
| *Moraxella catarrhalis* | ATCC 43628 |
| *Morganella morganii* | ATCC 25830 |
| *Neisseria meningitidis* | ATCC 13077 |
| *Pasteurella aerogenes* | ATCC 27883 |

TABLE 10-continued

Bacterial species used to test the specificity of the *Enterococcus*-specific amplification primers derived from tuf sequences.

| Strain | Reference number |
|---|---|
| *Proteus vulgaris* | ATCC 13315 |
| *Providencia alcalifaciens* | ATCC 9886 |
| *Providencia rettgeri* | ATCC 9250 |
| *Pseudomonas aeruginosa* | ATCC 27853 |
| *Salmonella typhimurium* | ATCC 14028 |
| *Serratia marcescens* | ATCC 13880 |
| *Shigella flexneri* | ATCC 12022 |

TABLE 10-continued

Bacterial species used to test the specificity of the *Enterococcus*-specific amplification primers derived from tuf sequences.

| Strain | Reference number |
|---|---|
| *Shigella sonnei* | ATCC 29930 |
| *Succinivibrio dextrinosolvens* | ATCC 19716 |
| *Tissierella praeacuta* | ATCC 25539 |
| *Veillonella parvula* | ATCC 10790 |
| *Yersinia enterocolitica* | ATCC 9610 |

TABLE 11

Microbial species for which tuf and/or atpD and/or recA sequences are available in public databases.

| Species | Strain | Accession number | Coding gene* |
|---|---|---|---|
| | | tuf sequences | |
| Bacteria | | | |
| *Actinobacillus actinomycetemcomitans* | HK1651 | Genome project[2] | tuf |
| *Actinobacillus actinomycetemcomitans* | HK1651 | Genome project[2] | tuf (EF-G) |
| *Agrobacterium tumefaciens* | | X99673 | tuf |
| *Agrobacterium tumefaciens* | | X99673 | tuf (EF-G) |
| *Agrobacterium tumefaciens* | | X99674 | tuf |
| *Anacystis nidulans* | PCC 6301 | X17442 | tuf |
| *Aquifex aeolicus* | VF5 | AE000669 | tuf |
| *Aquifex aeolicus* | VF5 | AE000669 | tuf (EF-G) |
| *Aquifex pyrophilus* | | Genome project[2] | tuf (EF-G) |
| *Aquifex pyrophilus* | | Y15787 | tuf |
| *Bacillus anthracis* | Ames | Genome project[2] | tuf |
| *Bacillus anthracis* | Ames | Genome project[2] | tuf (EF-G) |
| *Bacillus halodurans* | C-125 | AB017508 | tuf |
| *Bacillus halodurans* | C-125 | AB017508 | tuf (EF-G) |
| *Bacillus stearothermophilus* | CCM 2184 | AJ000260 | tuf |
| *Bacillus subtilis* | 168 | D64127 | tuf |
| *Bacillus subtilis* | 168 | D64127 | tuf (EF-G) |
| *Bacillus subtilis* | DSM 10 | Z99104 | tuf |
| *Bacillus subtilis* | DSM 10 | Z99104 | tuf (EF-G) |
| *Bacteroides forsythus* | ATCC 43037 | AB035466 | tuf |
| *Bacteroides fragilis* | DSM 1151 | —[1] | tuf |
| *Bordetella bronchiseptica* | RB50 | Genome project[2] | tuf |
| *Bordetella pertussis* | Tohama 1 | Genome project[2] | tuf |
| *Bordetella pertussis* | Tohama 1 | Genome project[2] | tuf (EF-G) |
| *Borrelia burdorgferi* | B31 | U78193 | tuf |
| *Borrelia burgdorferi* | | AE001155 | tuf (EF-G) |
| *Brevibacterium linens* | DSM 20425 | X76863 | tuf |
| *Buchnera aphidicola* | Ap | Y12307 | tuf |
| *Burkholderia pseudomallei* | K96243 | Genome project[2] | tuf (EF-G) |
| *Campylobacter jejuni* | NCTC 11168 | Y17167 | tuf |
| *Campylobacter jejuni* | NCTC 11168 | CJ11168X2 | tuf (EF-G) |
| *Chlamydia pneumoniae* | CWL029 | AE001592 | tuf |
| *Chlamydia pneumoniae* | CWL029 | AE001639 | tuf (EF-G) |
| *Chlamydia trachomatis* | | M74221 | tuf |
| *Chlamydia trachomatis* | D/UW-3/CX | AE001317 | tuf (EF-G) |
| *Chlamydia trachomatis* | D/UW-3/CX | AE001305 | tuf |
| *Chlamydia trachomatis* | F/IC-Cal-13 | L22216 | tuf |
| *Chlorobium vibrioforme* | DSM 263 | X77033 | tuf |
| *Chloroflexus aurantiacus* | DSM 636 | X76865 | tuf |
| *Clostridium acetobutylicum* | ATCC 824 | Genome project[2] | tuf |
| *Clostridium difficile* | 630 | Genome project[2] | tuf |
| *Clostridium difficile* | 630 | Genome project[2] | tuf (EF-G) |
| *Corynebacterium diphtheriae* | NCTC 13129 | Genome project[2] | tuf |
| *Corynebacterium diphtheriae* | NCTC 13129 | Genome project[2] | tuf (EF-G) |
| *Corynebacterium glutamicum* | ASO 19 | X77034 | tuf |
| *Corynebacterium glutamicum* | MJ-233 | E09634 | tuf |
| *Coxiella burnetii* | Nine Mile phase I | AF136604 | tuf |
| *Cytophaga lytica* | DSM 2039 | X77035 | tuf |
| *Deinococcus radiodurans* | R1 | AE001891 | tuf (EF-G) |
| *Deinococcus radiodurans* | R1 | AE180092 | tuf |
| *Deinococcus radiodurans* | R1 | AE002041 | tuf |
| *Deinonema* sp. | | —[1] | tuf |
| *Eikenella corrodens* | ATCC 23834 | Z12610 | tuf |
| *Eikenella corrodens* | ATCC 23834 | Z12610 | tuf (EF-G) |

TABLE 11-continued

Microbial species for which tuf and/or atpD and/or recA sequences are available in public databases.

| Species | Strain | Accession number | Coding gene* |
|---|---|---|---|
| *Enterococcus faecalis* | | Genome project[2] | tuf (EF-G) |
| *Escherichia coli* | | J01690 | tuf |
| *Escherichia coli* | | J01717 | tuf |
| *Escherichia coli* | | X00415 | tuf (EF-G) |
| *Escherichia coli* | | X57091 | tuf |
| *Escherichia coli* | K-12 MG1655 | U00006 | tuf |
| *Escherichia coli* | K-12 MG1655 | U00096 | tuf |
| *Escherichia coli* | K-12 MG1655 | AE000410 | tuf (EF-G) |
| *Fervidobacterium islandicum* | DSM 5733 | Y15788 | tuf |
| *Fibrobacter succinogenes* | S85 | X76866 | tuf |
| *Flavobacterium ferrigeneum* | DSM 13524 | X76867 | tuf |
| *Flexistipes sinusarabici* | | X59461 | tuf |
| *Gloeobacter violaceus* | PCC 7421 | U09433 | tuf |
| *Gloeothece* sp. | PCC 6501 | U09434 | tuf |
| *Haemophilus actinomycetemcomitans* | HK1651 | Genome project[2] | tuf |
| *Haemophilus ducreyi* | 35000 | AF087414 | tuf (EF-G) |
| *Haemophilus influenzae* | Rd | U32739 | tuf |
| *Haemophilus influenzae* | Rd | U32746 | tuf |
| *Haemophilus influenzae* | Rd | U32739 | tuf (EF-G) |
| *Helicobacter pylori* | 26695 | AE000511 | tuf |
| *Helicobacter pylori* | J99 | AE001539 | tuf (EF-G) |
| *Helicobacter pylori* | J99 | AE001541 | tuf |
| *Herpetosiphon aurantiacus* | Hpga1 | X76868 | tuf |
| *Klebsiella pneumoniae* | M6H 78578 | Genome project[2] | tuf |
| *Klebsiella pneumoniae* | M6H 78578 | Genome project[2] | tuf (EF-G) |
| *Lactobacillus paracasei* | | E13922 | tuf |
| *Legionella pneumophila* | Philadelphia-1 | Genome project[2] | tuf |
| *Leptospira interrogans* | | AF115283 | tuf |
| *Leptospira interrogans* | | AF115283 | tuf (EF-G) |
| *Micrococcus luteus* | IFO 3333 | M17788 | tuf (EF-G) |
| *Micrococcus luteus* | IFO 3333 | M17788 | tuf |
| *Moraxella* sp. | TAC II 25 | AJ249258 | tuf |
| *Mycobacterium avium* | 104 | Genome project[2] | tuf |
| *Mycobacterium avium* | 104 | Genome project[2] | tuf (EF-G) |
| *Mycobacterium bovis* | AF2122/97 | Genome project[2] | tuf |
| *Mycobacterium bovis* | AF2122/97 | Genome project[2] | tuf (EF-G) |
| *Mycobacterium leprae* | | L13276 | tuf |
| *Mycobacterium leprae* | | Z14314 | tuf |
| *Mycobacterium leprae* | | Z14314 | tuf (EF-G) |
| *Mycobacterium leprae* | Thai 53 | D13869 | tuf |
| *Mycobacterium tuberculosis* | Erdmann | S40925 | tuf |
| *Mycobacterium tuberculosis* | H37Rv | AL021943 | tuf (EF-G) |
| *Mycobacterium tuberculosis* | H37Rv | Z84395 | tuf |
| *Mycobacterium tuberculosis* | y42 | AD000005 | tuf |
| *Mycobacterium tuberculosis* | CSU#93 | Genome project[2] | tuf |
| *Mycobacterium tuberculosis* | CSU#93 | Genome project[2] | tuf (EF-G) |
| *Mycoplasma capricolum* | PG-31 | X16462 | tuf |
| *Mycoplasma genitalium* | G37 | U39732 | tuf |
| *Mycoplasma genitalium* | G37 | U39689 | tuf (EF-G) |
| *Mycoplasma hominis* | | X57136 | tuf |
| *Mycoplasma hominis* | PG21 | M57675 | tuf |
| *Mycoplasma pneumoniae* | M129 | AE000019 | tuf |
| *Mycoplasma pneumoniae* | M129 | AE000058 | tuf (EF-G) |
| *Neisseria gonorrhoeae* | MS11 | L36380 | tuf |
| *Neisseria gonorrhoeae* | MS11 | L36380 | tuf (EF-G) |
| *Neisseria meningitidis* | Z2491 | Genome project[2] | tuf (EF-G) |
| *Neisseria meningitidis* | Z2491 | Genome project[2] | tuf |
| *Pasteurella multocida* | Pm70 | Genome project[2] | tuf |
| *Peptococcus niger* | DSM 20745 | X76869 | tuf |
| *Phormidium ectocarpi* | PCC 7375 | U09443 | tuf |
| *Planobispora rosea* | ATCC 53773 | U67308 | tuf |
| *Planobispora rosea* | ATCC 53733 | X98830 | tuf |
| *Planobispora rosea* | ATCC 53733 | X98830 | tuf (EF-G) |
| *Plectonema boryanum* | PCC 73110 | U09444 | tuf |
| *Porphyromonas gingivalis* | W83 | Genome project[2] | tuf |
| *Porphyromonas gingivalis* | W83 | Genome project[2] | tuf (EF-G) |
| *Porphyromonas gingivalis* | FDC 381 | AB035461 | tuf |
| *Porphyromonas gingivalis* | W83 | AB035462 | tuf |
| *Porphyromonas gingivalis* | SUNY 1021 | AB035463 | tuf |
| *Porphyromonas gingivalis* | A7A1-28 | AB035464 | tuf |
| *Porphyromonas gingivalis* | ATCC 33277 | AB035465 | tuf |
| *Porphyromonas gingivalis* | ATCC 33277 | AB035471 | tuf (EF-G) |
| *Prochlorothrix hollandica* | | U09445 | tuf |
| *Pseudomonas aeruginosa* | PAO-1 | Genome project[2] | tuf |
| *Pseudomonas putida* | | Genome project[2] | tuf |

TABLE 11-continued

Microbial species for which tuf and/or atpD and/or recA sequences are available in public databases.

| Species | Strain | Accession number | Coding gene* |
|---|---|---|---|
| *Rickettsia prowazekii* | Madrid E | AJ235272 | tuf |
| *Rickettsia prowazekii* | Madrid E | AJ235270 | tuf (EF-G) |
| *Rickettsia prowazekii* | Madrid E | Z54171 | tuf (EF-G) |
| *Salmonella choleraesuis* subsp. *choleraesuis* serotype *Typhimurium* | | X64591 | tuf (EF-G) |
| *Salmonella choleraesuis* subsp. *choleraesuis* serotype *Typhimurium* | LT2 trpE91 | X55116 | tuf |
| *Salmonella choleraesuis* subsp. *choleraesuis* serotype *Typhimurium* | LT2 trpE91 | X55117 | tuf |
| *Serpulina hyodysenteriae* | B204 | U51635 | tuf |
| *Serratia marcescens* | | AF058451 | tuf |
| *Shewanella putrefaciens* | DSM 50426 | —[1] | tuf |
| *Shewanella putrefaciens* | MR-1 | Genome project[2] | tuf |
| *Spirochaeta aurantia* | DSM 1902 | X76874 | tuf |
| *Staphylococcus aureus* | | AJ237696 | tuf (EF-G) |
| *Staphylococcus aureus* | EMRSA-16 | Genome project[2] | tuf |
| *Staphylococcus aureus* | NCTC 8325 | Genome project[2] | tuf |
| *Staphylococcus aureus* | COL | Genome project[2] | tuf |
| *Staphylococcus aureus* | EMRSA-16 | Genome project[2] | tuf (EF-G) |
| *Stigmatella aurantiaca* | DW4 | X82820 | tuf |
| *Stigmatella aurantiaca* | Sg a1 | X76870 | tuf |
| *Streptococcus mutans* | GS-5 Kuramitsu | U75481 | tuf |
| *Streptococcus mutans* | UAB159 | Genome project[2] | tuf |
| *Streptococcus oralis* | NTCC 11427 | P331701 | tuf |
| *Streptococcus pyogenes* | | Genome project[2] | tuf (EF-G) |
| *Streptococcus pyogenes* | M1-GAS | Genome project[2] | tuf |
| *Streptomyces aureofaciens* | ATCC 10762 | AF007125 | tuf |
| *Streptomyces cinnamoneus* | Tue89 | X98831 | tuf |
| *Streptomyces coelicolor* | A3(2) | AL031013 | tuf (EF-G) |
| *Streptomyces coelicolor* | A3(2) | X77039 | tuf (EF-G) |
| *Streptomyces coelicolor* | M145 | X77039 | tuf |
| *Streptomyces collinus* | BSM 40733 | S79408 | tuf |
| *Streptomyces netropsis* | Tu1063 | AF153618 | tuf |
| *Streptomyces ramocissimus* | | X67057 | tuf |
| *Streptomyces ramocissimus* | | X67058 | tuf |
| *Streptomyces ramocissimus* | | X67057 | tuf (EF-G) |
| *Synechococcus* sp. | PCC 6301 | X17442 | tuf (EF-G) |
| *Synechococcus* sp. | PCC 6301 | X17442 | tuf |
| *Synechocystis* sp. | PCC 6803 | D90913 | tuf (EF-G) |
| *Synechocystis* sp. | PCC 6803 | D90913 | tuf |
| *Synechocystis* sp. | PCC 6803 | X65159 | tuf (EF-G) |
| *Taxeobacter occealus* | Myx 2105 | X77036 | tuf |
| *Thermotoga maritima* | | Genome project[2] | tuf (EF-G) |
| *Thermotoga maritima* | | M27479 | tuf |
| *Thermus aquaticus* | EP 00276 | X66322 | tuf |
| *Thermus thermophilus* | HB8 | X16278 | tuf (EF-G) |
| *Thermus thermophilus* | HB8 | X05977 | tuf |
| *Thermus thermophilus* | HB8 | X06657 | tuf |
| *Thiomonas cuprina* | DSM 5495 | U78300 | tuf |
| *Thiomonas cuprina* | DSM 5495 | U78300 | tuf (EF-G) |
| *Thiomonas cuprina* | Hoe5 | X76871 | tuf |
| *Treponema denticola* | | Genome project[2] | tuf |
| *Treponema denticola* | | Genome project[2] | tuf (EF-G) |
| *Treponema pallidum* | | AE001202 | tuf |
| *Treponema pallidum* | | AE001222 | tuf (EF-G) |
| *Treponema pallidum* | | AE001248 | tuf (EF-G) |
| *Ureaplasma urealyticum* | ATCC 33697 | Z34275 | tuf |
| *Ureaplasma urealyticum* | serovar 3 biovar 1 | AE002151 | tuf |
| *Ureaplasma urealyticum* | serovar 3 biovar 1 | AE002151 | tuf (EF-G) |
| *Vibrio cholerae* | N16961 | Genome project[2] | tuf |
| *Wolinella succinogenes* | DSM 1740 | X76872 | tuf |
| *Yersinia pestis* | CO-92 | Genome project[2] | tuf |
| *Yersinia pestis* | CO-92 | Genome project[2] | tuf (EF-G) |
| Archaebacteria | | | |
| *Archaeoglobus fulgidus* | | Genome project[2] | tuf (EF-G) |
| *Halobacterium marismortui* | | X16677 | tuf |
| *Methanobacterium thermoautrophicum* | delta H | AE000877 | tuf |
| *Methanococcus jannaschii* | ATCC 43067 | U67486 | tuf |
| *Methanococcus vannielii* | | X05698 | tuf |
| *Pyrococcus abyssi* | Orsay | AJ248285 | tuf |
| *Thermoplasma acidophilum* | DSM 1728 | X53866 | tuf |

TABLE 11-continued

Microbial species for which tuf and/or atpD and/or recA sequences are available in public databases.

| Species | Strain | Accession number | Coding gene* |
|---|---|---|---|
| Fungi | | | |
| *Absidia glauca* | CBS 101.48 | X54730 | tuf (EF-1) |
| *Arxula adeninivorans* | Ls3 | Z47379 | tuf (EF-1) |
| *Aspergillus oryzae* | KBN616 | AB007770 | tuf (EF-1) |
| *Aureobasidium pullulans* | R106 | U19723 | tuf (EF-1) |
| *Candida albicans* | SC5314 | Genome project[2] | tuf (M) |
| *Candida albicans* | SC5314 | M29934 | tuf (EF-1) |
| *Candida albicans* | SC5314 | M29935 | tuf (EF-1) |
| *Cryptococcus neoformans* | B3501 | U81803 | tuf (EF-1) |
| *Cryptococcus neoformans* | M1-106 | U81804 | tuf (EF-1) |
| *Eremothecium gossypii* | ATCC 10895 | X73978 | tuf (EF-1) |
| *Eremothecium gossypii* | | A29820 | tuf (EF-1) |
| *Fusarium oxysporum* | NRRL 26037 | AF008498 | tuf (EF-1) |
| *Histoplasma capsulatum* | 186AS | U14100 | tuf (EF-1) |
| *Podospora anserina* | | X74799 | tuf (EF-1) |
| *Podospora curvicolla* | VLV | X96614 | tuf (EF-1) |
| *Prototheca wickerhamii* | 263-11 | AJ245645 | tuf (EF-1) |
| *Puccinia graminis* | race 32 | X73529 | tuf (EF-1) |
| *Reclinomonas americana* | ATCC 50394 | AF007261 | tuf (M) |
| *Rhizomucor racemosus* | ATCC 1216B | X17475 | tuf (EF-1) |
| *Rhizomucor racemosus* | ATCC 1216B | J02605 | tuf (EF-1) |
| *Rhizomucor racemosus* | ATCC 1216B | X17476 | tuf (EF-1) |
| *Rhodotorula mucilaginosa* | | AF016239 | tuf (EF-1) |
| *Saccharomyces cerevisiae* | | K00428 | tuf (M) |
| *Saccharomyces cerevisiae* | | M59369 | tuf (EF-G) |
| *Saccharomyces cerevisiae* | | X00779 | tuf (EF-1) |
| *Saccharomyces cerevisiae* | | X01638 | tuf (EF-1) |
| *Saccharomyces cerevisiae* | | M10992 | tuf (EF-1) |
| *Saccharomyces cerevisiae* | Alpha S288 | X78993 | tuf (EF-1) |
| *Saccharomyces cerevisiae* | | M15666 | tuf (EF-1) |
| *Saccharomyces cerevisiae* | | Z35987 | tuf (EF-1) |
| *Saccharomyces cerevisiae* | S288C (AB972) | U51033 | tuf (EF-1) |
| *Schizophyllum commune* | 1-40 | X94913 | tuf (EF-1) |
| *Schizosaccharomyces pombe* | 972h- | AL021816 | tuf (EF-1) |
| *Schizosaccharomyces pombe* | 972h- | AL021813 | tuf (EF-1) |
| *Schizosaccharomyces pombe* | 972h- | D82571 | tuf (EF-1) |
| *Schizosaccharomyces pombe* | | U42189 | tuf (EF-1) |
| *Schizosaccharomyces pombe* | PR745 | D89112 | tuf (EF-1) |
| *Sordaria macrospora* | OOO | X96615 | tuf (EF-1) |
| *Trichoderma reesei* | QM9414 | Z23012 | tuf (EF-1) |
| *Yarrowia lipolytica* | | AF054510 | tuf (EF-1) |
| Parasites | | | |
| *Blastocystis hominis* | HE87-1 | D64080 | tuf (EF-1) |
| *Cryptosporidium parvum* | | U69697 | tuf (EF-1) |
| *Eimeria tenella* | LS18 | AI755521 | tuf (EF-1) |
| *Entamoeba histolytica* | HM1:IMSS | X83565 | tuf (EF-1) |
| *Entamoeba histolytica* | NIH 200 | M92073 | tuf (EF-1) |
| *Giardia lamblia* | | D14342 | tuf (EF-1) |
| *Kentrophoros* sp. | | AF056101 | tuf (EF-1) |
| *Leishmania amazonensis* | IFLA/BR/67/PH8 | M92653 | tuf (EF-1) |
| *Leishmania braziliensis* | | U72244 | tuf (EF-1) |
| *Onchocerca volvulus* | | M64333 | tuf (EF-1) |
| *Porphyra purpurea* | Avonport | U08844 | tuf (EF-1) |
| *Plasmodium berghei* | ANKA | AJ224150 | tuf (EF-1) |
| *Plasmodium falciparum* | K1 | X60488 | tuf (EF-1) |
| *Plasmodium knowlesi* | line H | AJ224153 | tuf (EF-1) |
| *Toxoplasma gondii* | RH | Y11431 | tuf (EF-1) |
| *Trichomonas tenax* | ATCC 30207 | D78479 | tuf (EF-1) |
| *Trypanosoma brucei* | LVH/75/ USAMRU-K/18 | U10562 | tuf (EF-1) |
| *Trypanosoma cruzi* | Y | L76077 | tuf (EF-1) |
| Human and plants | | | |
| *Arabidopsis thaliana* | Columbia | X89227 | tuf (EF-1) |
| *Glycine max* | Ceresia | X89058 | tuf (EF-1) |
| *Glycine max* | Ceresia | Y15107 | tuf (EF-1) |
| *Glycine max* | Ceresia | Y15108 | tuf (EF-1) |
| *Glycine max* | Maple Arrow | X66062 | tuf (EF-1) |
| *Homo sapiens* | | X03558 | tuf (EF-1) |
| *Pyramimonas disomata* | | AB008010 | tuf |

TABLE 11-continued

Microbial species for which tuf and/or atpD and/or recA sequences are available in public databases.

| Species | Strain | Accession number | Coding gene* |
|---|---|---|---|
| | atpD sequences | | |
| Bacteria | | | |
| *Acetobacterium woodi* | DSM 1030 | U10505 | atpD |
| *Actinobacillus actinomycetemcomitans* | HK1651 | Genome project[2] | atpD |
| *Bacillus anthracis* | Ames | Genome project[2] | atpD |
| *Bacillus firmus* | OF4 | M60117 | atpD |
| *Bacillus megaterium* | QM B1551 | M20255 | atpD |
| *Bacillus stearothermophilus* | | D38058 | atpD |
| *Bacillus stearothermophilus* | IFO1035 | D38060 | atpD |
| *Bacillus subtilis* | 168 | Z28592 | atpD |
| *Bacteroides fragilis* | DSM 2151 | M22247 | atpD |
| *Bordetella bronchiseptica* | RB50 | Genome project[2] | atpD |
| *Bordetella pertussis* | Tohama 1 | Genome project[2] | atpD |
| *Borrelia burgdorferi* | B31 | AE001122 | atpD (V) |
| *Burkholderia cepacia* | DSM50181 | X76877 | atpD |
| *Burkholderia pseudomallei* | K96243 | Genome project[2] | atpD |
| *Campylobacter jejuni* | NCTC 11168 | CJ11168X1 | atpD |
| *Chlamydia pneumoniae* | | Genome project[2] | atpD (V) |
| *Chlamydia trachomatis* | MoPn | Genome project[2] | atpD (V) |
| *Chlorobium vibrioforme* | DSM 263 | X76873 | atpD |
| *Citrobacter freundii* | JEO503 | AF037156 | atpD |
| *Clostridium acetobutylicum* | ATCC 824 | Genome project[2] | atpD |
| *Clostridium acetobutylicum* | DSM 792 | AF101055 | atpD |
| *Clostridium difficile* | 630 | Genome project[2] | atpD |
| *Corynebacterium diphtheriae* | NCTC13129 | Genome project[2] | atpD |
| *Corynebacterium glutamicum* | ASO 19 | X76875 | atpD |
| *Corynebacterium glutamicum* | MJ-233 | E09634 | atpD |
| *Cytophaga lytica* | DSM 2039 | M22535 | atpD |
| *Enterobacter aerogenes* | DSM 30053 | —[3] | atpD |
| *Enterococcus faecalis* | V583 | Genome project[2] | atpD (V) |
| *Enterococcus hirae* | | M90060 | atpD |
| *Enterococcus hirae* | ATCC 9790 | D17462 | atpD (V) |
| *Escherichia coli* | | J01594 | atpD |
| *Escherichia coli* | | M25464 | atpD |
| *Escherichia coli* | | V00267 | atpD |
| *Escherichia coli* | | V00311 | atpD |
| *Escherichia coli* | K12 MG1655 | L10328 | atpD |
| *Flavobacterium ferrugineum* | DSM 13524 | —[3] | atpD |
| *Haemophilus actinomycetemcomitans* | | Genome project[2] | atpD |
| *Haemophilus influenzae* | Rd | U32730 | atpD |
| *Helicobacter pylori* | NCTC 11638 | AF004014 | atpD |
| *Helicobacter pylori* | 26695 | Genome project[2] | atpD |
| *Helicobacter pylori* | J99 | Genome project[2] | atpD |
| *Klebsiella pneumoniae* | M6H 78578 | Genome project[2] | atpD |
| *Lactobacillus casei* | DSM 20021 | X64542 | atpD |
| *Legionella pneumophila* | Philadelphia-1 | Genome project[2] | atpD |
| *Moorella thermoacetica* | ATCC 39073 | U64318 | atpD |
| *Mycobacterium avium* | 104 | Genome project[2] | atpD |
| *Mycobacterium bovis* | AF2122/97 | Genome project[2] | atpD |
| *Mycobacterium leprae* | | U15186 | atpD |
| *Mycobacterium leprae* | | Genome project[2] | atpD |
| *Mycobacterium tuberculosis* | H37Rv | Z73419 | atpD |
| *Mycobacterium tuberculosis* | CSU#93 | Genome project[2] | atpD |
| *Mycoplasma gallisepticum* | | X64256 | atpD |
| *Mycoplasma genitalium* | G37 | U39725 | atpD |
| *Mycoplasma pneumoniae* | M129 | U43738 | atpD |
| *Neisseria gonorrhoeae* | FA 1090 | Genome project[2] | atpD |
| *Neisseria meningitidis* | Z2491 | Genome project[2] | atpD |
| *Pasteurella multocida* | Pm70 | Genome project[2] | atpD |
| *Pectinatus frisingensis* | DSM 20465 | X64543 | atpD |
| *Peptococcus niger* | DSM 20475 | X76878 | atpD |
| *Pirellula marina* | IFAM 1313 | X57204 | atpD |
| *Porphyromonas gingivalis* | W83 | Genome project[2] | atpD (V) |
| *Propionigenium modestum* | DSM 2376 | X58461 | atpD |
| *Pseudomonas aeruginosa* | PAO1 | Genome project[2] | atpD |
| *Pseudomonas putida* | | Genome project[2] | atpD |
| *Rhodobacter capsulatus* | B100 | X99599 | atpD |
| *Rhodospirillum rubrum* | | X02499 | atpD |
| *Rickettsia prowazekii* | F-12 | AF036246 | atpD |
| *Rickettsia prowazekii* | Madrid | Genome project[2] | atpD |
| *Ruminococcus albus* | 7ATCC | AB006151 | atpD |
| *Salmonella bongori* | JEO4162 | AF037155 | atpD |
| *Salmonella bongori* | BR1859 | AF037154 | atpD |

TABLE 11-continued

Microbial species for which tuf and/or atpD and/or recA sequences are available in public databases.

| Species | Strain | Accession number | Coding gene* |
|---|---|---|---|
| *Salmonella choleraesuis* subsp. *arizonae* | S83769 | AF037146 | atpD |
| *Salmonella choleraesuis* subsp. *arizonae* | u24 | AF037147 | atpD |
| *Salmonella choleraesuis* subsp. *choleraesuis* serotype Dublin | K228 | AF037140 | atpD |
| *Salmonella choleraesuis* subsp. *choleraesuis* serotype Dublin | K771 | AF037139 | atpD |
| *Salmonella choleraesuis* subsp. *choleraesuis* serotype Infantis | Div36-86 | AF037142 | atpD |
| *Salmonella choleraesuis* subsp. *choleraesuis* serotype Tennessee | Div95-86 | AF037143 | atpD |
| *Salmonella choleraesuis* subsp. *choleraesuis* serotype *Typhimurium* | LT2 | AF037141 | atpD |
| *Salmonella choleraesuis* subsp. *diarizonae* | DS210/89 | AF037149 | atpD |
| *Salmonella choleraesuis* subsp. *diarizonae* | JEO307 | AF037148 | atpD |
| *Salmonella choleraesuis* subsp. *diarizonae* | S109671 | AF037150 | atpD |
| *Salmonella choleraesuis* subsp. *houtenae* | S84366 | AF037151 | atpD |
| *Salmonella choleraesuis* subsp. *houtenae* | S84098 | AF037152 | atpD |
| *Salmonella choleraesuis* subsp. *indica* | BR2047 | AF037153 | atpD |
| *Salmonella choleraesuis* subsp. *salamae* | NSC72 | AF037144 | atpD |
| *Salmonella choleraesuis* subsp. *salamae* | S114655 | AF037145 | atpD |
| *Shewanella putrefaciens* | MR-1 | Genome project[2] | atpD |
| *Staphylococcus aureus* | COL | Genome project[2] | atpD |
| *Stigmatella aurantiaca* | Sga1 | X76879 | atpD |
| *Streptococcus bovis* | JB-1 | AB009314 | atpD |
| *Streptococcus mutans* | GS-5 | U31170 | atpD |
| *Streptococcus mutans* | UAB159 | Genome project[2] | atpD |
| *Streptococcus pneumoniae* | Type 4 | Genome project[2] | atpD (V) |
| *Streptococcus pneumoniae* | Type 4 | Genome project[2] | atpD |
| *Streptococcus pyogenes* | M1-GAS | Genome project[2] | atpD (V) |
| *Streptococcus pyogenes* | M1-GAS | Genome project[2] | atpD |
| *Streptococcus sanguinis* | 10904 | AF001955 | atpD |
| *Streptomyces lividans* | 1326 | Z22606 | atpD |
| *Thermus thermophilus* | HB8 | D63799 | atpD (V) |
| *Thiobacillus ferrooxidans* | ATCC 33020 | M81087 | atpD |
| *Treponema pallidum* | Nichols | AE001228 | atpD (V) |
| *Vibrio alginolyticus* | | X16050 | atpD |
| *Vibrio cholerae* | N16961 | Genome project[2] | atpD |
| *Wolinella succinogenes* | DSM 1470 | X76880 | atpD |
| *Yersinia enterocolitica* | NCTC 10460 | AF037157 | atpD |
| *Yersinia pestis* | CO-92 | Genome project[2] | atpD |
| Archaebacteria | | | |
| *Archaeoglobus fulgidus* | DSM 4304 | AE001023 | atpD (V) |
| *Halobacterium salinarum* | | S56356 | atpD (V) |
| *Haloferax volcanii* | WR 340 | X79516 | atpD |
| *Methanococcus jannaschii* | DSM 2661 | U67477 | atpD (V) |
| *Methanosarcina barkeri* | DSM 800 | J04836 | atpD (V) |
| Fungi | | | |
| *Candida albicans* | SC5314 | Genome project[2] | atpD |
| *Candida tropicalis* | | M64984 | atpD (V) |
| *Kluyveromyces lactis* | 2359/152 | U37764 | atpD |
| *Neurospora crassa* | | X53720 | atpD |
| *Saccharomyces cerevisiae* | | M12082 | atpD |
| *Saccharomyces cerevisiae* | X2180-1A | J05409 | atpD (V) |
| *Schizosaccharomyces pombe* | 972 h- | S47814 | atpD (V) |
| *Schizosaccharomyces pombe* | 972 h- | M57956 | atpD |
| Parasites | | | |
| *Giardia lamblia* | WB | U18938 | atpD |
| *Plasmodium falciparum* | 3D7 | L08200 | atpD (V) |
| *Trypanosoma congolense* | IL3000 | Z25814 | atpD (V) |

TABLE 11-continued

Microbial species for which tuf and/or atpD and/or recA sequences are available in public databases.

| Species | Strain | Accession number | Coding gene* |
|---|---|---|---|
| Human and plants | | | |
| *Homo sapiens* | | L09234 | atpD (V) |
| *Homo sapiens* | | M27132 | atpD |
| | recA sequences | | |
| Bacteria | | | |
| *Acetobacter aceti* | no. 1023 | S60630 | recA |
| *Acetobacter altoacetigenes* | MH-24 | E05290 | recA |
| *Acetobacter polyoxogenes* | NBI 1028 | D13183 | recA |
| *Acholeplasma laidlawii* | 8195 | M81465 | recA |
| *Acidiphilium facilis* | ATCC 35904 | D16538 | recA |
| *Acidothermus cellulolyticus* | ATCC 43068 | AJ006705 | recA |
| *Acinetobacter calcoaceticus* | BD413/ADP1 | L26100 | recA |
| *Actinobacillus actinomycetemcomitans* | HK1651 | Genome project[2] | recA |
| *Aeromonas salmonicida* | A449 | U83688 | recA |
| *Agrobacterium tumefaciens* | C58 | L07902 | recA |
| *Allochromatium vinosum* | | AJ000677 | recA |
| *Aquifex aeolicus* | VF5 | AE000775 | recA |
| *Aquifex pyrophilus* | Kol5a | L23135 | recA |
| *Azotobacter vinelandii* | | S96898 | recA |
| *Bacillus stearothermophilus* | 10 | Genome project[2] | recA |
| *Bacillus subtilis* | PB1831 | U87792 | recA |
| *Bacillus subtilis* | 168 | Z99112 | recA |
| *Bacteroides fragilis* | | M63029 | recA |
| *Bifidobacterium breve* | NCFB 2258 | AF094756 | recA |
| *Blastochloris viridis* | DSM 133 | AF022175 | recA |
| *Bordetella pertussis* | 165 | X53457 | recA |
| *Bordetella pertussis* | Tohama I | Genome project[2] | recA |
| *Borrelia burgdorferi* | Sh-2-82 | U23457 | recA |
| *Borrelia burgdorferi* | B31 | AE001124 | recA |
| *Brevibacterium flavum* | MJ-233 | E10390 | recA |
| *Brucella abortus* | 2308 | L00679 | recA |
| *Burkholderia cepacia* | ATCC 17616 | U70431 | recA |
| *Burkholderia cepacia* | | D90120 | recA |
| *Burkholderia pseudomallei* | K96243 | Genome project[2] | recA |
| *Campylobacter fetus* subsp. *fetus* | 23D | AF020677 | recA |
| *Campylobacter jejuni* | 81-176 | U03121 | recA |
| *Campylobacter jejuni* | NCTC 11168 | AL139079 | recA |
| *Chlamydia trachomatis* | L2 | U16739 | recA |
| *Chlamydia trachomatis* | D/UW-3/CX | AE001335 | recA |
| *Chlamydophila pneumoniae* | CWL029 | AE001658 | recA |
| *Chloroflexus aurantiacus* | J-10-fl | AF037259 | recA |
| *Clostridium acetobutylicum* | | M94057 | recA |
| *Clostridium perfringens* | 13 | U61497 | recA |
| *Corynebacterium diphtheriae* | NCTC13129 | Genome project[2] | recA |
| *Corynebacterium glutamicum* | AS019 | U14965 | recA |
| *Corynebacterium pseudotuberculosis* | C231 | U30387 | recA |
| *Deinococcus radiodurans* | KD8301 | AB005471 | recA |
| *Deinococcus radiodurans* | R1 | U01876 | recA |
| *Enterobacter agglomerans* | 339 | L03291 | recA |
| *Enterococcus faecalis* | OGIX | M81466 | recA |
| *Erwinia carotovora* | | X55554 | recA |
| *Escherichia coli* | | J01672 | recA |
| *Escherichia coli* | | X55552 | recA |
| *Escherichia coli* | K-12 | AE000354 | recA |
| *Frankia alni* | Arl3 | AJ006707 | recA |
| *Gluconobacter oxydans* | | U21001 | recA |
| *Haemophilus influenzae* | Rd | U32687 | recA |
| *Haemophilus influenzae* | Rd | U32741 | recA |
| *Haemophilus influenzae* | Rd | L07529 | recA |
| *Helicobacter pylori* | 69A | Z35478 | recA |
| *Helicobacter pylori* | 26695 | AE000536 | recA |
| *Helicobacter pylori* | J99 | AE001453 | recA |
| *Klebsiella pneumoniae* | M6H 78578 | Genome project[2] | recA |
| *Lactococcus lactis* | ML3 | M88106 | recA |
| *Legionella pneumophila* | | X55453 | recA |
| *Leptospira biflexa* | serovar patoc | U32625 | recA |
| *Leptospira interrogans* | serovar pomona | U29169 | recA |
| *Magnetospirillum magnetotacticum* | MS-1 | X17371 | recA |
| *Methylobacillus flagellatus* | MFK1 | M35325 | recA |
| *Methylomonas clara* | ATCC 31226 | X59514 | recA |
| *Mycobacterium avium* | 104 | Genome project[2] | recA |
| *Mycobacterium bovis* | AF122/97 | Genome project[2] | recA |
| *Mycobacterium leprae* | | X73822 | recA |

TABLE 11-continued

Microbial species for which tuf and/or atpD and/or recA sequences are available in public databases.

| Species | Strain | Accession number | Coding gene* |
|---|---|---|---|
| *Mycobacterium tuberculosis* | H37Rv | X58485 | recA |
| *Mycobacterium tuberculosis* | CSU#93 | Genome project[2] | recA |
| *Mycoplasma genitalium* | G37 | U39717 | recA |
| *Mycoplasma mycoides* | GM9 | L22073 | recA |
| *Mycoplasma pneumoniae* | ATCC 29342 | MPAE000033 | recA |
| *Mycoplasma pulmonis* | KD735 | L22074 | recA |
| *Myxococcus xanthus* | | L40368 | recA |
| *Myxococcus xanthus* | | L40367 | recA |
| *Neisseria animalis* | NCTC 10212 | U57910 | recA |
| *Neisseria cinerea* | LCDC 81-176 | AJ223869 | recA |
| *Neisseria cinerea* | LNP 1646 | U57906 | recA |
| *Neisseria cinerea* | NCTC 10294 | AJ223871 | recA |
| *Neisseria cinerea* | Vedros M601 | AJ223870 | recA |
| *Neisseria elongata* | CCUG 2131 | AJ223882 | recA |
| *Neisseria elongata* | CCUG 4165A | AJ223880 | recA |
| *Neisseria elongata* | NCTC 10660 | AJ223881 | recA |
| *Neisseria elongata* | NCTC 11050 | AJ223878 | recA |
| *Neisseria elongata* | NHITCC 2376 | AJ223877 | recA |
| *Neisseria elongata* subsp. *intermedia* | CCUG 4557 | AJ223879 | recA |
| *Neisseria flava* | Bangor 9 | AJ223873 | recA |
| *Neisseria flavescens* | LNP 444 | U57907 | recA |
| *Neisseria gonorrhoeae* | CH95 | U57902 | recA |
| *Neisseria gonorrhoeae* | FA19 | X64842 | recA |
| *Neisseria gonorrhoeae* | MS11 | X17374 | recA |
| *Neisseria gonorrhoeae* | | Genome project[2] | recA |
| *Neisseria lactamica* | CCUC 7757 | AJ223866 | recA |
| *Neisseria lactamica* | CCUG 7852 | Y11819 | recA |
| *Neisseria lactamica* | LCDC 77-143 | Y11818 | recA |
| *Neisseria lactamica* | LCDC 80-111 | AJ223864 | recA |
| *Neisseria lactamica* | LCDC 845 | AJ223865 | recA |
| *Neisseria lactamica* | NCTC 10617 | U57905 | recA |
| *Neisseria lactamica* | NCTC 10618 | AJ223863 | recA |
| *Neisseria meningitidis* | 44/46 | X64849 | recA |
| *Neisseria meningitidis* | Bangor 13 | AJ223868 | recA |
| *Neisseria meningitidis* | HF116 | X64848 | recA |
| *Neisseria meningitidis* | HF130 | X64844 | recA |
| *Neisseria meningitidis* | HF46 | X64847 | recA |
| *Neisseria meningitidis* | M470 | X64850 | recA |
| *Neisseria meningitidis* | N94II | X64846 | recA |
| *Neisseria meningitidis* | NCTC 8249 | AJ223867 | recA |
| *Neisseria meningitidis* | P63 | X64845 | recA |
| *Neisseria meningitidis* | S3446 | U57903 | recA |
| *Neisseria meningitidis* | FAM18 | Genome project[2] | recA |
| *Neisseria mucosa* | LNP 405 | U57908 | recA |
| *Neisseria mucosa* | Vedros M1801 | AJ223875 | recA |
| *Neisseria perflava* | CCUG 17915 | AJ223876 | recA |
| *Neisseria perflava* | LCDC 85402 | AJ223862 | recA |
| *Neisseria pharyngis* var. *flava* | NCTC 4590 | U57909 | recA |
| *Neisseria polysaccharea* | CCUG 18031 | Y11815 | recA |
| *Neisseria polysaccharea* | CCUG 24845 | Y11816 | recA |
| *Neisseria polysaccharea* | CCUG 24846 | Y11814 | recA |
| *Neisseria polysaccharea* | INS MA 3008 | Y11817 | recA |
| *Neisseria polysaccharea* | NCTC 11858 | U57904 | recA |
| *Neisseria sicca* | NRL 30016 | AJ223872 | recA |
| *Neisseria subflava* | NRL 30017 | AJ223874 | recA |
| *Paracoccus denitrificans* | DSM 413 | U59631 | recA |
| *Pasteurella multocida* | | X99324 | recA |
| *Porphyromonas gingivalis* | W83 | U70054 | recA |
| *Prevotella ruminicola* | JCM 8958 | U61227 | recA |
| *Proteus mirabilis* | pG1300 | X14870 | recA |
| *Proteus vulgaris* | | X55555 | recA |
| *Pseudomonas aeruginosa* | | X05691 | recA |
| *Pseudomonas aeruginosa* | PAM 7 | X52261 | recA |
| *Pseudomonas aeruginosa* | PAO12 | D13090 | recA |
| *Pseudomonas fluorescens* | OE 28.3 | M96558 | recA |
| *Pseudomonas putida* | | L12684 | recA |
| *Pseudomonas putida* | PpS145 | U70864 | recA |
| *Rhizobium leguminosarum* biovar *viciae* | VF39 | X59956 | recA |
| *Rhizobium phaseoli* | CNPAF512 | X62479 | recA |
| *Rhodobacter capsulatus* | J50 | X82183 | recA |
| *Rhodobacter sphaeroides* | 2.4.1 | X72705 | recA |
| *Rhodopseudomonas palustris* | N 7 | D84467 | recA |
| *Rickettsia prowazekii* | Madrid E | AJ235273 | recA |

TABLE 11-continued

Microbial species for which tuf and/or atpD and/or recA sequences are available in public databases.

| Species | Strain | Accession number | Coding gene* |
|---|---|---|---|
| *Rickettsia prowazekii* | Madrid E | U01959 | recA |
| *Serratia marcescens* | | M22935 | recA |
| *Shigella flexneri* | | X55553 | recA |
| *Shigella sonnei* | KNIH104S | AF101227 | recA |
| *Sinorhizobium meliloti* | 2011 | X59957 | recA |
| *Staphylococcus aureus* | | L25893 | recA |
| *Streptococcus gordonii* | Challis V288 | L20574 | recA |
| *Streptococcus mutans* | UA96 | M81468 | recA |
| *Streptococcus mutans* | GS-5 | M61897 | recA |
| *Streptococcus pneumoniae* | | Z17307 | recA |
| *Streptococcus pneumoniae* | R800 | Z34303 | recA |
| *Streptococcus pyogenes* | NZ131 | U21934 | recA |
| *Streptococcus pyogenes* | D471 | M81469 | recA |
| *Streptococcus salivarius* subsp. *thermophilus* | | M94062 | recA |
| *Streptomyces ambofaciens* | DSM 40697 | Z30324 | recA |
| *Streptomyces coelicolor* | A3(2) | AL020958 | recA |
| *Streptomyces lividans* | TK24 | X76076 | recA |
| *Streptomyces rimosus* | R6 | X94233 | recA |
| *Streptomyces venezuelae* | ATCC10712 | U04837 | recA |
| *Synechococcus* sp. | PR6 | M29495 | recA |
| *Synechocystis* sp. | PCC6803 | D90917 | recA |
| *Thermotoga maritima* | | L23425 | recA |
| *Thermotoga maritima* | | AE001823 | recA |
| *Thermus aquaticus* | | L20095 | recA |
| *Thermus thermophilus* | HB8 | D17392 | recA |
| *Thiobacillus ferrooxidans* | | M26933 | recA |
| *Treponema denticola* | | Genome project[2] | recA |
| *Treponema pallidum* | Nichols | AE001243 | recA |
| *Vibrio anguillarum* | | M80525 | recA |
| *Vibrio cholerae* | 017 | X71969 | recA |
| *Vibrio cholerae* | 2740-80 | U10162 | recA |
| *Vibrio cholerae* | 569B | L42384 | recA |
| *Vibrio cholerae* | M549 | AF117881 | recA |
| *Vibrio cholerae* | M553 | AF117882 | recA |
| *Vibrio cholerae* | M645 | AF117883 | recA |
| *Vibrio cholerae* | M793 | AF117878 | recA |
| *Vibrio cholerae* | M794 | AF117880 | recA |
| *Vibrio cholerae* | M967 | AF117879 | recA |
| *Xanthomonas citri* | XW47 | AF006590 | recA |
| *Xanthomonas oryzae* | | AF013600 | recA |
| *Xenorhabdus bovienii* | T228/1 | U87924 | recA |
| *Xenorhabdus nematophilus* | AN6 | AF127333 | recA |
| *Yersinia pestis* | 231 | X75336 | recA |
| *Yersinia pestis* | CO-92 | Genome project[2] | recA |
| Fungi, parasites, human and plants | | | |
| *Anabaena variabilis* | ATCC 29413 | M29680 | recA |
| *Arabidopsis thaliana* | | U43652 | recA (Rad51) |
| *Candida albicans* | | U39808 | recA (Dmc1) |
| *Coprinus cinereus* | Okayama-7 | U21905 | recA (Rad51) |
| *Emericella nidulans* | | Z80341 | recA (Rad51) |
| *Gallus gallus* | | L09655 | recA (Rad51) |
| *Homo sapiens* | | D13804 | recA (Rad51) |
| *Homo sapiens* | | D63882 | recA (Dmc1) |
| *Leishmania major* | Friedlin | AF062379 | recA (Rad51) |
| *Leishmania major* | Friedlin | AF062380 | recA (Dmc1) |
| *Mus musculus* | | D58419 | recA (Dmc1) |
| *Neurospora crassa* | 74-OR23-1A | D29638 | recA (Rad51) |
| *Saccharomyces cerevisiae* | | D10023 | recA (Rad51) |
| *Schizosaccharomyces pombe* | | Z22691 | recA (Rad51) |
| *Schizosaccharomyces pombe* | 972h- | AL021817 | recA (Dmc1) |
| *Tetrahymena thermophila* | PB9R | AF064516 | recA (Rad51) |
| *Trypanosoma brucei* | stock 427 | Y13144 | recA (Rad51) |
| *Ustilago maydis* | | U62484 | recA (Rad51) |
| *Xenopus laevis* | | D38488 | recA (Rad51) |
| *Xenopus laevis* | | D38489 | recA (Rad51) |

*tuf indicates tuf sequences, including tuf genes, fusA genes and fusA-tuf intergenic spacers. tuf (C) indicates tuf sequences divergent from main (usually A and B) copies of the elongation factor-Tu tuf (EF-1) indicates tuf sequences of the eukaryotic type (elongation factor 1α) tuf (M) indicates tuf sequences from organellar (mostly mitochondrial) origin atpD indicates atpD sequences of the F-type atpD (V) indicates atpD sequences of the V-Type recA indicates recA sequences recA (Rad51) indicates rad51 sequences or homologs recA (Dmc1) indicates dmc1 sequences or homologs

[1]Nucleotides sequences published in Arch. Microbiol. 1990 153: 241-247

[2]These sequences are from the TIGR database (http://www.tigr.org/tdb/tdb.html)

[3]Nucleotides sequences published in FEMS Microbiology Letters 1988 50: 101-106

TABLE 12

Bacterial species used to test the specificity of the *Staphylococcus*-specific amplification primers derived from tuf sequences.

| Strain | Reference number |
|---|---|
| Staphylococcal species (n = 27) | |
| *Staphylococcus arlettae* | ATCC 43957 |
| *Staphylococcus aureus* subsp. *anaerobius* | ATCC 35844 |
| *Staphylococcus aureus* subsp. *aureus* | ATCC 43300 |
| *Staphylococcus auricularis* | ATCC 33753 |
| *Staphylococcus capitis* subsp. *capitis* | ATCC 27840 |
| *Staphylococcus caprae* | ATCC 35538 |
| *Staphylococcus carnosus* | ATCC 51365 |
| *Staphylococcus chromogenes* | ATCC 43764 |
| *Staphylococcus cohnii* subsp. *urealyticum* | DSM 20260 |
| *Staphylococcus delphini* | ATCC 49171 |
| *Staphylococcus epidermidis* | ATCC 14990 |
| *Staphylococcus equorum* | ATCC 43958 |
| *Staphylococcus felis* | ATCC 49168 |
| *Staphylococcus gallinarum* | ATCC 35539 |
| *Staphylococcus haemolyticus* | ATCC 29970 |
| *Staphylococcus hominis* | ATCC 27844 |
| *Staphylococcus hyicus* | ATCC 11249 |
| *Staphylococcus intermedius* | ATCC 29663 |
| *Staphylococcus kloosis* | ATCC 43959 |
| *Staphylococcus lentus* | ATCC 29070 |
| *Staphylococcus lugdunensis* | ATCC 43809 |
| *Staphylococcus saprophyticus* | ATCC 15305 |
| *Staphylococcus schleiferi* subsp. *coagulans* | ATCC 49545 |
| *Staphylococcus sciuri* subsp. *sciuri* | ATCC 29060 |
| *Staphylococcus simulans* | ATCC 27848 |
| *Staphylococcus warneri* | ATCC 27836 |
| *Staphylococcus xylosus* | ATCC 29971 |
| Other Gram-positive bacteria (n = 20) | |
| *Bacillus subtilis* | ATCC 27370 |
| *Enterococcus avium* | ATCC 14025 |
| *Enterococcus durans* | ATCC 19432 |
| *Enterococcus faecalis* | ATCC 19433 |
| *Enterococcus faecium* | ATCC 19434 |
| *Enterococcus flavescens* | ATCC 49996 |
| *Enterococcus gallinarum* | ATCC 49573 |
| *Lactobacillus acidophilus* | ATCC 4356 |
| *Lactococcus lactis* | ATCC 11454 |
| *Listeria innocua* | ATCC 33090 |
| *Listeria ivanovii* | ATCC 19119 |
| *Listeria monocytogenes* | ATCC 15313 |
| *Macrococcus caseolyticus* | ATCC 13548 |
| *Streptococcus agalactiae* | ATCC 13813 |
| *Streptococcus anginosus* | ATCC 33397 |
| *Streptococcus bovis* | ATCC 33317 |
| *Streptococcus mutans* | ATCC 25175 |
| *Streptococcus pneumoniae* | ATCC 6303 |
| *Streptococcus pyogenes* | ATCC 19615 |
| *Streptococcus salivarius* | ATCC 7073 |
| Gram-negative bacteria (n = 33) | |
| *Acinetobacter baumannii* | ATCC 19606 |
| *Bacteroides distasonis* | ATCC 8503 |
| *Bacteroides fragilis* | ATCC 25285 |
| *Bulkholderia cepacia* | ATCC 25416 |
| *Bordetella pertussis* | ATCC 9797 |
| *Citrobacter freundii* | ATCC 8090 |
| *Enterobacter aerogenes* | ATCC 13048 |
| *Enterobacter cloacae* | ATCC 13047 |
| *Escherichia coli* | ATCC 25922 |
| *Haemophilus influenzae* | ATCC 8907 |
| *Haemophilus parahaemolyticus* | ATCC 10014 |
| *Haemophilus parainfluenzae* | ATCC 7901 |
| *Hafnia alvei* | ATCC 13337 |
| *Kingella indologenes* | ATCC 25869 |
| *Klebsiella oxytoca* | ATCC 13182 |
| *Klebsiella pneumoniae* | ATCC 13883 |

TABLE 12-continued

Bacterial species used to test the specificity of the *Staphylococcus*-specific amplification primers derived from tuf sequences.

| Strain | Reference number |
|---|---|
| *Moraxella catarrhalis* | ATCC 25240 |
| *Morganella morganii* | ATCC 25830 |
| *Neisseria gonorrhoeae* | ATCC 35201 |
| *Neisseria meningitidis* | ATCC 13077 |
| *Proteus mirabilis* | ATCC 25933 |
| *Proteus vulgaris* | ATCC 13315 |
| *Providencia rettgeri* | ATCC 9250 |
| *Providencia stuartii* | ATCC 29914 |
| *Pseudomonas aeruginosa* | ATCC 27853 |
| *Pseudomonas fluorencens* | ATCC 13525 |
| *Salmonella choleraesuis* | ATCC 7001 |
| *Salmonella typhimurium* | ATCC 14028 |
| *Serratia marcescens* | ATCC 8100 |
| *Shigella flexneri* | ATCC 12022 |
| *Shigella sonnei* | ATCC 29930 |
| *Stenotrophomonas maltophilia* | ATCC 13843 |
| *Yersinia enterocolitica* | ATCC 9610 |

TABLE 13

Bacterial species used to test the specificity of the penicillin-resistant *Streptococcus pneumoniae* assay.

| Strain | Reference number |
|---|---|
| Gram-positive species (n = 67) | |
| *Abiotrophia adiacens* | ATCC 49175 |
| *Abiotrophia defectiva* | ATCC 49176 |
| *Actinomyces pyogenes* | ATCC 19411 |
| *Bacillus anthracis* | ATCC 4229 |
| *Bacillus cereus* | ATCC 14579 |
| *Bifidobacterium breve* | ATCC 15700 |
| *Clostridium difficile* | ATCC 9689 |
| *Enterococcus avium* | ATCC 14025 |
| *Enterococcus casseliflavus* | ATCC 25788 |
| *Enterococcus dispar* | ATCC 51266 |
| *Enterococcus durans* | ATCC 19432 |
| *Enterococcus faecalis* | ATCC 29212 |
| *Enterococcus faecium* | ATCC 19434 |
| *Enterococcus flavescens* | ATCC 49996 |
| *Enterococcus gallinarum* | ATCC 49573 |
| *Enterococcus hirae* | ATCC 8043 |
| *Enterococcus mundtii* | ATCC 43186 |
| *Enterococcus raffinosus* | ATCC 49427 |
| *Lactobacillus lactis* | ATCC 19435 |
| *Lactobacillus monocytogenes* | ATCC 15313 |
| *Mobiluncus curtisii* | ATCC 35242 |
| *Peptococcus niger* | ATCC 27731 |
| *Peptostreptococcus acones* | ATCC 6919 |
| *Peptostreptococcus anaerobius* | ATCC 27337 |
| *Peptostreptococcus asaccharolyticus* | ATCC 2639 |
| *Peptostreptococcus lactolyticus* | ATCC 51172 |
| *Peptostreptococcus magnus* | ATCC 15794 |
| *Peptostreptococcus prevotii* | ATCC 9321 |
| *Peptostreptococcus tetradius* | ATCC 35098 |
| *Staphylococcus aureus* | ATCC 25923 |
| *Staphylococcus capitis* | ATCC 27840 |
| *Staphylococcus epidermidis* | ATCC 14990 |
| *Staphylococcus haemolyticus* | ATCC 29970 |
| *Staphylococcus hominis* | ATCC 27844 |
| *Staphylococcus lugdunensis* | ATCC 43809 |
| *Staphylococcus saprophyticus* | ATCC 15305 |
| *Staphylococcus simulans* | ATCC 27848 |
| *Staphylococcus. warneri* | ATCC 27836 |
| *Streptococcus acidominimus* | ATCC 51726 |
| *Streptococcus agalactiae* | ATCC 12403 |
| *Streptococcus anginosus* | ATCC 33397 |
| *Streptococcus bovis* | ATCC 33317 |
| *Streptococcus constellatus* | ATCC 27823 |
| *Streptococcus cricetus* | ATCC 19624 |

TABLE 13-continued

Bacterial species used to test the specificity of the penicillin-resistant *Streptococcus pneumoniae* assay.

| Strain | Reference number |
|---|---|
| *Streptococcus cristatus* | ATCC 51100 |
| *Streptococcus downei* | ATCC 33748 |
| *Streptococcus dysgalactiae* | ATCC 43078 |
| *Streptococcus equi* | ATCC 9528 |
| *Streptococcus ferus* | ATCC 33477 |
| *Streptococcus gordonii* | ATCC 10558 |
| *Streptococcus intermedius* | ATCC 27335 |
| *Streptococcus mitis* | ATCC 903 |
| *Streptococcus mitis* | LSPQ 2583 |
| *Streptococcus mitis* | ATCC 49456 |
| *Streptococcus mutans* | ATCC 27175 |
| *Streptococcus oralis* | ATCC 10557 |
| *Streptococcus oralis* | ATCC 9811 |
| *Streptococcus oralis* | ATCC 35037 |
| *Streptococcus parasanguinis* | ATCC 15912 |
| *Streptococcus parauberis* | ATCC 6631 |
| *Streptococcus rattus* | ATCC 15912 |
| *Streptococcus salivarius* | ATCC 7073 |
| *Streptococcus sanguinis* | ATCC 10556 |
| *Streptococcus suis* | ATCC 43765 |
| *Streptococcus uberis* | ATCC 19436 |
| *Streptococcus vestibularis* | ATCC 49124 |
| Gram-negative species (n = 33) | |
| *Actinetobacter baumannii* | ATCC 19606 |
| *Bordetella pertussis* | ATCC 9797 |
| *Citrobacter diversus* | ATCC 27028 |
| *Citrobacter freundii* | ATCC 8090 |
| *Enterobacter aerogenes* | ATCC 13048 |
| *Enterobacter agglomerans* | ATCC 27155 |
| *Enterobacter cloacae* | ATCC 13047 |
| *Escherichia coli* | ATCC 25922 |
| *Haemophilus ducreyi* | ATCC 33940 |
| *Haemophilus haemolyticus* | ATCC 33390 |
| *Haemophilus influenzae* | ATCC 9007 |
| *Haemophilus parainfluenzae* | ATCC 7901 |
| *Hafnia alvei* | ATCC 13337 |
| *Klebsiella oxytoca* | ATCC 13182 |
| *Klebsiella pneumoniae* | ATCC 13883 |
| *Moraxella atlantae* | ATCC 29525 |
| *Moraxella catarrhalis* | ATCC 43628 |
| *Moraxella morganii* | ATCC 13077 |
| *Neisseria gonorrhoeae* | ATCC 35201 |
| *Neisseria meningitidis* | ATCC 13077 |
| *Proteus mirabilis* | ATCC 25933 |
| *Proteus vulgaris* | ATCC 13315 |
| *Providencia alcalifaciens* | ATCC 9886 |
| *Providencia rettgeri* | ATCC 9250 |
| *Providencia rustigianii* | ATCC 33673 |
| *Providencia stuartii* | ATCC 33672 |
| *Pseudomonas aeruginosa* | ATCC 35554 |
| *Pseudomonas fluorescens* | ATCC 13525 |
| *Pseudomonas stutzeri* | ATCC 17588 |
| *Salmonella typhimurium* | ATCC 14028 |
| *Serratia marcescens* | ATCC 13880 |
| *Shigella flexneri* | ATCC 12022 |
| *Yersina enterocolitica* | ATCC 9610 |

TABLE 14

Bacterial species (n = 104) detected by the platelet contaminants assay. Bold characters indicate the major bacterial contaminants found in platelet concentrates.

*Abiotrophia adiacens*
*Abiotrophia defectiva*
*Acinetobacter baumannii*
*Acinetobacter lwoffi*
*Aerococcus viridans*
*Bacillus anthracis*
*Bacillus cereus*
*Bacillus subtilis*

TABLE 14-continued

Bacterial species (n = 104) detected by the platelet contaminants assay. Bold characters indicate the major bacterial contaminants found in platelet concentrates.

*Brucella abortus*
*Burkholderia cepacia*
*Citrobacter diversus*
*Citrobacter freundii*
*Enterobacter aerogenes*
*Enterobacter agglomerans*
*Enterobacter cloacae*
*Enterococcus avium*
*Enterococcus casseliflavus*
*Enterococcus dispar*
*Enterococcus durans*
*Enterococcus faecalis*
*Enterococcus faecium*
*Enterococcus flavescens*
*Enterococcus gallinarum*
*Enterococcus mundtii*
*Enterococcus raffinosus*
*Enterococcus solitarius*
*Escherichia coli*
*Gemella morbillorum*
*Haemophilus ducreyi*
*Haemophilus haemolyticus*
*Haemophilus influenzae*
*Haemophilus parahaemolyticus*
*Haemophilus parainfluenzae*
*Hafnia alvei*
*Kingella kingae*
*Klebsiella oxytoca*
*Klebsiella pneumoniae*
*Legionella pneumophila*
*Megamonas hypermegale*
*Moraxella atlantae*
*Moraxella catarrhalis*
*Morganella morganii*
*Neisseria gonorrheae*
*Neisseria meningitidis*
*Pasteurella aerogenes*
*Pasteurella multocida*
*Peptostreptococcus magnus*
*Proteus mirabilis*
*Providencia alcalifaciens*
*Providencia rettgeri*
*Providencia rustigianii*
*Providencia stuartii*
*Pseudomonas aeruginosa*
*Pseudomonas fluorescens*
*Pseudomonas stutzeri*
*Salmonella bongori*
*Salmonella choleraesuis*
*Salmonella enteritidis*
*Salmonella gallinarum*
*Salmonella typhimurium*
*Serratia liquefaciens*
*Serratia marcescens*
*Shigella flexneri*
*Shigella sonnei*
*Staphylococcus aureus*
*Staphylococcus capitis*
*Staphylococcus epidermidis*
*Staphylococcus haemolyticus*
*Staphylococcus hominis*
*Staphylococcus lugdunensis*
*Staphylococcus saprophyticus*
*Staphylococcus simulans*
*Staphylococcus warneri*
*Stenotrophomonas maltophilia*
*Streptococcus acidominimus*
*Streptococcus agalactiae*
*Streptococcus anginosus*
*Streptococcus bovis*
*Streptococcus constellatus*
*Streptococcus cricetus*
*Streptococcus cristatus*
*Streptococcus dysgalactiae*
*Streptococcus equi*
*Streptococcus ferus*

TABLE 14-continued

| Bacterial species (n = 104) detected by the platelet contaminants assay. Bold characters indicate the major bacterial contaminants found in platelet concentrates. |
|---|
| *Streptococcus gordonii* |
| *Streptococcus intermedius* |
| *Streptococcus macacae* |
| *Streptococcus mitis* |
| ***Streptococcus mutans*** |
| *Streptococcus oralis* |
| *Streptococcus parasanguinis* |
| *Streptococcus parauberis* |
| *Streptococcus pneumoniae* |
| ***Streptococcus pyogenes*** |
| *Streptococcus ratti* |
| ***Streptococcus salivarius*** |
| ***Streptococcus sanguinis*** |
| *Streptococcus sobrinus* |
| *Streptococcus uberis* |
| *Streptococcus vestibularis* |
| *Vibrio cholerae* |
| *Yersinia enterocolitica* |
| *Yersinia pestis* |
| ***Yersinia pseudotuberculos*** |

TABLE 15

| Microorganisms identified by commercial systems[1]. |
|---|
| *Abiotrophia adiacens* (*Streptococcus adjacens*) |
| *Abiotrophia defectiva* (*Streptococcus defectivus*) |
| *Achromobacter* species |
| *Acidaminococcus fermentans* |
| *Acinetobacter alcaligenes* |
| *Acinetobacter anitratus* |
| *Acinetobacter baumannii* |
| *Acinetobacter calcoaceticus* |
| *Acinetobacter calcoaceticus* biovar *anitratus* |
| *Acinetobacter calcoaceticus* biovar *lwoffi* |
| *Acinetobacter* genomospecies |
| *Acinetobacter haemolyticus* |
| *Acinetobacter johnsonii* |
| *Acinetobacter junii* |
| *Acinetobacter lwoffii* |
| *Acinetobacter radioresistens* |
| *Acinetobacter* species |
| *Actinobacillus actinomycetemcomitans* |
| *Actinobacillus capsulatus* |
| *Actinobacillus equuli* |
| *Actinobacillus hominis* |
| *Actinobacillus lignieresii* |
| *Actinobacillus pleuropneumoniae* |
| *Actinobacillus* species |
| *Actinobacillus suis* |
| *Actinobacillus ureae* |
| *Actinomyces bovis* |
| *Actinomyces israelii* |
| *Actinomyces meyeri* |
| *Actinomyces naeslundii* |
| *Actinomyces neuii* subsp. *anitratus* |
| *Actinomyces neuii* subsp. *neuii* |
| *Actinomyces odontolyticus* |
| *Actinomyces pyogenes* |
| *Actinomyces radingae* |
| *Actinomyces* species |
| *Actinomyces turicensis* |
| *Actinomyces viscosus* |
| *Aerococcus* species |
| *Aerococcus viridans* |
| *Aeromonas caviae* |
| *Aeromonas hydrophila* |
| *Aeromonas hydrophila* group |

TABLE 15-continued

| Microorganisms identified by commercial systems[1]. |
|---|
| *Aeromonas jandaei* |
| *Aeromonas salmonicida* |
| *Aeromonas salmonicida* subsp. *achromogenes* |
| *Aeromonas salmonicida* subsp. *masoucida* |
| *Aeromonas salmonicida* subsp. *salmonicida* |
| *Aeromonas schubertii* |
| *Aeromonas sobria* |
| *Aeromonas* species |
| *Aeromonas trota* |
| *Aeromonas veronii* |
| *Aeromonas veronii* biovar *sobria* |
| *Aeromonas veronii* biovar *veronii* |
| *Agrobacterium radiobacter* |
| *Agrobacterium* species |
| *Agrobacterium tumefaciens* |
| *Alcaligenes denitrificans* |
| *Alcaligenes faecalis* |
| *Alcaligenes odorans* |
| *Alcaligenes odorans* (*Alcaligenes faecalis*) |
| *Alcaligenes* species |
| *Alcaligenes xylosoxidans* |
| *Alcaligenes xylosoxidans* subsp. *denitrificans* |
| *Alcaligenes xylosoxidans* subsp. *xylosoxidans* |
| *Alloiococcus otitis* |
| *Anaerobiospirillum succiniciproducens* |
| *Anaerovibrio lipolytica* |
| *Arachnia propionica* |
| *Arcanobacterium* (*Actinomyces*) *bemardiae* |
| *Arcanobacterium* (*Actinomyces*) *pyogenes* |
| *Arcanobacterium haemolyticum* |
| *Arcobacter cryaerophilus* (*Campylobacter cryaerophila*) |
| *Arthrobacter globiformis* |
| *Arthrobacter* species |
| *Arxiozyma telluris* (*Torulopsis pintolopesii*) |
| *Atopobium minutum* (*Lactobacillus minutus*) |
| *Aureobacterium* species |
| *Bacillus amyloliquefaciens* |
| *Bacillus anthracis* |
| *Bacillus badius* |
| *Bacillus cereus* |
| *Bacillus circulans* |
| *Bacillus coagulans* |
| *Bacillus firmus* |
| *Bacillus lentus* |
| *Bacillus licheniformis* |
| *Bacillus megaterium* |
| *Bacillus mycoides* |
| *Bacillus pantothenticus* |
| *Bacillus pumilus* |
| *Bacillus* species |
| *Bacillus sphaericus* |
| *Bacillus stearothermophilus* |
| *Bacillus subtilis* |
| *Bacillus thuringiensis* |
| *Bacteroides caccae* |
| *Bacteroides capillosus* |
| *Bacteroides distasonis* |
| *Bacteroides eggerthii* |
| *Bacteroides fragilis* |
| *Bacteroides merdae* |
| *Bacteroides ovatus* |
| *Bacteroides* species |
| *Bacteroides splanchnicus* |
| *Bacteroides stercoris* |
| *Bacteroides thetaiotaomicron* |
| *Bacteroides uniformis* |
| *Bacteroides ureolyticus* (*B. corrodens*) |

TABLE 15-continued

| Microorganisms identified by commercial systems[1]. |
| --- |
| *Bacteroides vulgatus* |
| *Bergeyella* (*Weeksella*) *zoohelcum* |
| *Bifidobacterium adolescentis* |
| *Bifidobacterium bifidum* |
| *Bifidobacterium breve* |
| *Bifidobacterium dentium* |
| *Bifidobacterium infantis* |
| *Bifidobacterium* species |
| *Blastoschizomyces* (*Dipodascus*) *capitatus* |
| *Bordetella avium* |
| *Bordetella bronchiseptica* |
| *Bordetella parapertussis* |
| *Bordetella pertussis* |
| *Bordetella* species |
| *Borrelia* species |
| *Branhamella* (*Moraxella*) *catarrhalis* |
| *Branhamella* species |
| *Brevibacillus brevis* |
| *Brevibacillus laterosporus* |
| *Brevibacterium casei* |
| *Brevibacterium epidermidis* |
| *Brevibacterium linens* |
| *Brevibacterium* species |
| *Brevundimonas* (*Pseudomonas*) *diminuta* |
| *Brevundimonas* (*Pseudomonas*) *vesicularis* |
| *Brevundimonas* species |
| *Brochothrix thermosphacta* |
| *Brucella abortus* |
| *Brucella canis* |
| *Brucella melitensis* |
| *Brucella ovis* |
| *Brucella* species |
| *Brucella suis* |
| *Budvicia aquatica* |
| *Burkholderia* (*Pseudomonas*) *cepacia* |
| *Burkholderia* (*Pseudomonas*) *gladioli* |
| *Burkholderia* (*Pseudomonas*) *mallei* |
| *Burkholderia* (*Pseudomonas*) *pseudomallei* |
| *Burkholderia* species |
| *Buttiauxella agrestis* |
| *Campylobacter coli* |
| *Campylobacter concisus* |
| *Campylobacter fetus* |
| *Campylobacter fetus* subsp. *fetus* |
| *Campylobacter fetus* subsp. *venerealis* |
| *Campylobacter hyointestinalis* |
| *Campylobacter jejuni* subsp. *doylei* |
| *Campylobacter jejuni* subsp. *jejuni* |
| *Campylobacter lari* |
| *Campylobacter lari* subsp. UPTC |
| *Campylobacter mucosalis* |
| *Campylobacter* species |
| *Campylobacter sputorum* |
| *Campylobacter sputorum* subsp. *bubulus* |
| *Campylobacter sputorum* subsp. *fecalis* |
| *Campylobacter sputorum* subsp. *sputorum* |
| *Campylobacter upsaliensis* |
| *Candida* (*Clavispora*) *lusitaniae* |
| *Candida* (*Pichia*) *guilliermondii* |
| *Candida* (*Torulopsis*) *glabrata* |
| *Candida albicans* |
| *Candida boidinii* |
| *Candida catenulata* |
| *Candida ciferrii* |
| *Candida colliculosa* |
| *Candida conglobata* |
| *Candida curvata* (*Cryptococcus curvatus*) |
| *Candida dattila* |
| *Candida dubliniensis* |

TABLE 15-continued

| Microorganisms identified by commercial systems[1]. |
| --- |
| *Candida famata* |
| *Candida globosa* |
| *Candida hellenica* |
| *Candida holmii* |
| *Candida humicola* |
| *Candida inconspicua* |
| *Candida intermedia* |
| *Candida kefyr* |
| *Candida krusei* |
| *Candida lambica* |
| *Candida magnoliae* |
| *Candida maris* |
| *Candida melibiosica* |
| *Candida membranaefaciens* |
| *Candida norvegensis* |
| *Candida norvegica* |
| *Candida parapsilosis* |
| *Candida paratropicalis* |
| *Candida pelliculosa* |
| *Candida pseudotropicalis* |
| *Candida pulcherrima* |
| *Candida ravautii* |
| *Candida rugosa* |
| *Candida sake* |
| *Candida silvicola* |
| *Candida* species |
| *Candida sphaerica* |
| *Candida stellatoidea* |
| *Candida tenuis* |
| *Candida tropicalis* |
| *Candida utilis* |
| *Candida valida* |
| *Candida vini* |
| *Candida viswanathii* |
| *Candida zeylanoides* |
| *Capnocytophaga gingivalis* |
| *Capnocytophaga ochracea* |
| *Capnocytophaga* species |
| *Capnocytophaga sputigena* |
| *Cardiobacterium hominis* |
| *Carnobacterium divergens* |
| *Carnobacterium piscicola* |
| CDC group ED-2 |
| CDC group EF4 (*Pasteurella* sp.) |
| CDC group EF-4A |
| CDC group EF-4B |
| CDC group EQ-Z |
| CDC group HB-5 |
| CDC group II K-2 |
| CDC group IV C-2 (*Bordetella*-like) |
| CDC group M5 |
| CDC group M6 |
| *Cedecea davisae* |
| *Cedecea lapagei* |
| *Cedecea neteri* |
| *Cedecea* species |
| *Cellulomonas* (*Oerskovia*) *turbata* |
| *Cellulomonas* species |
| *Chlamydia* species |
| *Chromobacterium violaceum* |
| *Chryseobacterium* (*Flavobacterium*) *indologenes* |
| *Chryseobacterium* (*Flavobacterium*) *meningosepticum* |
| *Chryseobacterium gleum* |
| *Chryseobacterium* species |
| *Chryseomonas indologenes* |
| *Citeromyces matritensis* |
| *Citrobacter amalonaticus* |
| *Citrobacter braakii* |
| *Citrobacter diversus* |
| *Citrobacter farmeri* |
| *Citrobacter freundii* |
| *Citrobacter freundii* complex |
| *Citrobacter koseri* |
| *Citrobacter sedlakii* |
| *Citrobacter* species |
| *Citrobacter werkmanii* |

TABLE 15-continued

| Microorganisms identified by commercial systems[1]. |
| --- |
| *Citrobacter youngae* |
| *Clostridium acetobutylicum* |
| *Clostridium barati* |
| *Clostridium beijerinckii* |
| *Clostridium bifermentans* |
| *Clostridium botulinum* |
| *Clostridium botulinum* (NP) B&F |
| *Clostridium botulinum* (NP) E |
| *Clostridium botulinum* (P) A&H |
| *Clostridium botulinum* (P) F |
| *Clostridium botulinum* G1 |
| *Clostridium botulinum* G2 |
| *Clostridium butyricum* |
| *Clostridium cadaveris* |
| *Clostridium chauvoei* |
| *Clostridium clostridiiforme* |
| *Clostridium difficile* |
| *Clostridium fallax* |
| *Clostridium glycolicum* |
| *Clostridium hastiforme* |
| *Clostridium histolyticum* |
| *Clostridium innocuum* |
| *Clostridium limosum* |
| *Clostridium novyi* |
| *Clostridium novyi* A |
| *Clostridium paraputrificum* |
| *Clostridium perfringens* |
| *Clostridium putrificum* |
| *Clostridium ramosum* |
| *Clostridium septicum* |
| *Clostridium sordellii* |
| *Clostridium* species |
| *Clostridium sphenoides* |
| *Clostridium sporogenes* |
| *Clostridium subterminale* |
| *Clostridium tertium* |
| *Clostridium tetani* |
| *Clostridium tyrobutyricum* |
| *Comamonas* (*Pseudomonas*) *acidovorans* |
| *Comamonas* (*Pseudomonas*) *testosteroni* |
| *Comamonas* species |
| *Corynebacterium accolens* |
| *Corynebacterium afermentans* |
| *Corynebacterium amycolatum* |
| *Corynebacterium aquaticum* |
| *Corynebacterium argentoratense* |
| *Corynebacterium auris* |
| *Corynebacterium bovis* |
| *Corynebacterium coyleae* |
| *Corynebacterium cystitidis* |
| *Corynebacterium diphtheriae* |
| *Corynebacterium diphtheriae* biotype *belfanti* |
| *Corynebacterium diphtheriae* biotype *gravis* |
| *Corynebacterium diphtheriae* biotype *intermedius* |
| *Corynebacterium diphtheriae* biotype *mitis* |
| *Corynebacterium flavescens* |
| *Corynebacterium glucuronolyticum* |
| *Corynebacterium glucuronolyticum-seminale* |
| *Corynebacterium* group A |
| *Corynebacterium* group A-4 |
| *Corynebacterium* group A-5 |
| *Corynebacterium* group ANF |
| *Corynebacterium* group B |
| *Corynebacterium* group B-3 |
| *Corynebacterium* group F |
| *Corynebacterium* group F-1 |
| *Corynebacterium* group F-2 |
| *Corynebacterium* group G |
| *Corynebacterium* group G-1 |
| *Corynebacterium* group G-2 |
| *Corynebacterium* group I |

TABLE 15-continued

| Microorganisms identified by commercial systems[1]. |
| --- |
| *Corynebacterium* group I-2 |
| *Corynebacterium jeikeium* (group JK) |
| *Corynebacterium kutscheri* (*C. murium*) |
| *Corynebacterium macginleyi* |
| *Corynebacterium minutissimum* |
| *Corynebacterium pilosum* |
| *Corynebacterium propinquum* |
| *Corynebacterium pseudodiphtheriticum* |
| *Corynebacterium pseudotuberculosis* |
| *Corynebacterium pyogenes* |
| *Corynebacterium renale* |
| *Corynebacterium renale* group |
| *Corynebacterium seminale* |
| *Corynebacterium* species |
| *Corynebacterium striatum* (*C. flavidum*) |
| *Corynebacterium ulcerans* |
| *Corynebacterium urealyticum* (group D2) |
| *Corynebacterium xerosis* |
| *Cryptococcus albidus* |
| *Cryptococcus ater* |
| *Cryptococcus cereanus* |
| *Cryptococcus gastricus* |
| *Cryptococcus humicolus* |
| *Cryptococcus lactativorus* |
| *Cryptococcus laurentii* |
| *Cryptococcus luteolus* |
| *Cryptococcus melibiosum* |
| *Cryptococcus neoformans* |
| *Cryptococcus* species |
| *Cryptococcus terreus* |
| *Cryptococcus uniguttulatus* |
| *Debaryomyces hansenii* |
| *Debaryomyces marama* |
| *Debaryomyces polymorphus* |
| *Debaryomyces* species |
| *Dermabacter hominis* |
| *Dermacoccus* (*Micrococcus*) *nishinomiyaensis* |
| *Dietzia* species |
| *Edwardsiella hoshinae* |
| *Edwardsiella ictaluri* |
| *Edwardsiella* species |
| *Edwardsiella tarda* |
| *Eikenella corrodens* |
| *Empedobacter brevis* (*Flavobacterium breve*) |
| *Enterobacter aerogenes* |
| *Enterobacter agglomerans* |
| *Enterobacter amnigenus* |
| *Enterobacter amnigenus asburiae* (CDC enteric group 17) |
| *Enterobacter amnigenus* biogroup 1 |
| *Enterobacter amnigenus* biogroup 2 |
| *Enterobacter asburiae* |
| *Enterobacter cancerogenus* |
| *Enterobacter cloacae* |
| *Enterobacter gergoviae* |
| *Enterobacter hormaechei* |
| *Enterobacter intermedius* |
| *Enterobacter sakazakii* |
| *Enterobacter* species |
| *Enterobacter taylorae* |
| *Enterobacter taylorae* (CDC enteric group 19) |
| *Enterococcus* (*Streptococcus*) *cecorum* |
| *Enterococcus* (*Streptococcus*) *faecalis* (Group D) |
| *Enterococcus* (*Streptococcus*) *faecium* (Group D) |
| *Enterococcus* (*Streptococcus*) *saccharolyticus* |
| *Enterococcus avium* (Group D) |
| *Enterococcus casseliflavus* (*Steptococcus faecium* subsp. *casseliflavus*) |

TABLE 15-continued

| Microorganisms identified by commercial systems[1]. |
|---|
| *Enterococcus durans* (*Streptococcus faecium* subsp. *durans*) (Group D) |
| *Enterococcus gallinarum* |
| *Enterococcus hirae* |
| *Enterococcus malodoratus* |
| *Enterococcus mundtii* |
| *Enterococcus raffinosus* |
| *Enterococcus* species |
| *Erwinia amylovora* |
| *Erwinia carotovora* |
| *Erwinia carotovora* subsp. *atroseptica* |
| *Erwinia carotovora* subsp. *betavasculorum* |
| *Erwinia carotovora* subsp. *carotovora* |
| *Erwinia chrysanthemi* |
| *Erwinia cypripedii* |
| *Erwinia mallotivora* |
| *Erwinia nigrifluens* |
| *Erwinia quercina* |
| *Erwinia rhapontici* |
| *Erwinia rubrifaciens* |
| *Erwinia salicis* |
| *Erwinia* species |
| *Erysipelothrix rhusiopathiae* |
| *Erysipelothrix* species |
| *Escherichia blattae* |
| *Escherichia coli* |
| *Escherichia coli* A-D |
| *Escherichia coli* O157:H7 |
| *Escherichia fergusonii* |
| *Escherichia hermannii* |
| *Escherichia* species |
| *Escherichia vulneris* |
| *Eubacterium aerofaciens* |
| *Eubacterium alactolyticum* |
| *Eubacterium lentum* |
| *Eubacterium limosum* |
| *Eubacterium* species |
| *Ewingella americana* |
| *Filobasidiella neoformans* |
| *Filobasidium floriforme* |
| *Filobasidium uniguttulatum* |
| *Flavimonas oryzihabitans* |
| *Flavobacterium gleum* |
| *Flavobacterium indologenes* |
| *Flavobacterium odoratum* |
| *Flavobacterium* species |
| *Francisella novicida* |
| *Francisella philomiragia* |
| *Francisella* species |
| *Francisella tularensis* |
| *Fusobacterium mortiferum* |
| *Fusobacterium necrogenes* |
| *Fusobacterium necrophorum* |
| *Fusobacterium nucleatum* |
| *Fusobacterium* species |
| *Fusobacterium varium* |
| *Gaffkya* species |
| *Gardnerella vaginalis* |
| *Gemella haemolysans* |
| *Gemella morbillorum* |
| *Gemella* species |
| *Geotrichum candidum* |
| *Geotrichum fermentans* |
| *Geotrichum penicillarum* |
| *Geotrichum penicillatum* |
| *Geotrichum* species |
| *Gordona* species |
| *Haemophilus aegyptius* |
| *Haemophilus aphrophilus* |
| *Haemophilus ducreyi* |
| *Haemophilus haemoglobinophilus* |
| *Haemophilus haemolyticus* |
| *Haemophilus influenzae* |
| *Haemophilus influenzae* biotype I |
| *Haemophilus influenzae* biotype II |
| *Haemophilus influenzae* biotype III |
| *Haemophilus influenzae* biotype IV |

TABLE 15-continued

| Microorganisms identified by commercial systems[1]. |
|---|
| *Haemophilus influenzae* biotype V |
| *Haemophilus influenzae* biotype VI |
| *Haemophilus influenzae* biotype VII |
| *Haemophilus influenzae* biotype VIII |
| *Haemophilus paragallinarum* |
| *Haemophilus parahaemolyticus* |
| *Haemophilus parainfluenzae* |
| *Haemophilus parainfluenzae* biotype I |
| *Haemophilus parainfluenzae* biotype II |
| *Haemophilus parainfluenzae* biotype III |
| *Haemophilus parainfluenzae* biotype IV |
| *Haemophilus parainfluenzae* biotype V |
| *Haemophilus parainfluenzae* biotype VI |
| *Haemophilus parainfluenzae* biotype VII |
| *Haemophilus parainfluenzae* biotype VIII |
| *Haemophilus paraphrohaemolyticus* |
| *Haemophilus paraphrophilus* |
| *Haemophilus segnis* |
| *Haemophilus somnus* |
| *Haemophilus* species |
| *Hafnia alvei* |
| *Hanseniaspora guilliermondii* |
| *Hanseniaspora uvarum* |
| *Hanseniaspora valbyensis* |
| *Hansenula anomala* |
| *Hansenula holstii* |
| *Hansenula polymorpha* |
| *Helicobacter* (*Campylobacter*) *cinaedi* |
| *Helicobacter* (*Campylobacter*) *fennelliae* |
| *Helicobacter* (*Campylobacter*) *pylori* |
| *Issatchenkia orientalis* |
| *Kingella denitrificans* |
| *Kingella indologenes* |
| *Kingella kingae* |
| *Kingella* species |
| *Klebsiella ornithinolytica* |
| *Klebsiella oxytoca* |
| *Klebsiella planticola* |
| *Klebsiella pneumoniae* subsp. *ozaenae* |
| *Klebsiella pneumoniae* subsp. *pneumoniae* |
| *Klebsiella pneumoniae* subsp. *rhinoscleromatis* |
| *Klebsiella* species |
| *Klebsiella terrigena* |
| *Kloeckera apiculata* |
| *Kloeckera apis* |
| *Kloeckera japonica* |
| *Kloeckera* species |
| *Kluyvera ascorbata* |
| *Kluyvera cryocrescens* |
| *Kluyvera* species |
| *Kluyveromyces lactis* |
| *Kluyveromyces marxianus* |
| *Kluyveromyces thermotolerans* |
| *Kocuria* (*Micrococcus*) *kristinae* |
| *Kocuria* (*Micrococcus*) *rosea* |
| *Kocuria* (*Micrococcus*) *varians* |
| *Koserella trabulsii* |
| *Kytococcus* (*Micrococcus*) *sedentarius* |
| *Lactobacillus* (*Weissella*) *viridescens* |
| *Lactobacillus* A |
| *Lactobacillus acidophilus* |
| *Lactobacillus* B |
| *Lactobacillus brevis* |
| *Lactobacillus buchneri* |
| *Lactobacillus casei* |
| *Lactobacillus casei* subsp. *casei* |
| *Lactobacillus casei* subsp. *lactosus* |
| *Lactobacillus casei* subsp. *rhamnosus* |

TABLE 15-continued

| Microorganisms identified by commercial systems[1]. |
|---|
| *Lactobacillus catenaformis* |
| *Lactobacillus cellobiosus* |
| *Lactobacillus collinoides* |
| *Lactobacillus coprophilus* |
| *Lactobacillus crispatus* |
| *Lactobacillus curvatus* |
| *Lactobacillus delbrueckii* subsp. *bulgaricus* |
| *Lactobacillus delbrueckii* subsp. *delbrueckii* |
| *Lactobacillus delbrueckii* subsp. *lactis* |
| *Lactobacillus fermentum* |
| *Lactobacillus fructivorans* |
| *Lactobacillus helveticus* |
| *Lactobacillus helveticus* subsp. *jugurti* |
| *Lactobacillus jensenii* |
| *Lactobacillus lindneri* |
| *Lactobacillus minutus* |
| *Lactobacillus paracasei* subsp. *paracasei* |
| *Lactobacillus pentosus* |
| *Lactobacillus plantarum* |
| *Lactobacillus salivarius* |
| *Lactobacillus salivarius* var. *salicinius* |
| *Lactobacillus* species |
| *Lactococcus diacitilactis* |
| *Lactococcus garvieae* |
| *Lactococcus lactis* subsp. *cremoris* |
| *Lactococcus lactis* subsp. *diacitilactis* |
| *Lactococcus lactis* subsp. *hordniae* |
| *Lactococcus lactis* subsp. *lactis* |
| *Lactococcus plantarum* |
| *Lactococcus raffinolactis* |
| *Leclercia adecarboxylata* |
| *Legionella* species |
| *Leminorella* species |
| *Leptospira* species |
| *Leptotrichia buccalis* |
| *Leuconostoc* (*Weissella*) *paramesenteroides* |
| *Leuconostoc carnosum* |
| *Leuconostoc citreum* |
| *Leuconostoc gelidum* |
| *Leuconostoc lactis* |
| *Leuconostoc mesenteroides* |
| *Leuconostoc mesenteroides* subsp. *cremoris* |
| *Leuconostoc mesenteroides* subsp. *dextranicum* |
| *Leuconostoc mesenteroides* subsp. *mesenteroides* |
| *Leuconostoc* species |
| *Listeria grayi* |
| *Listeria innocua* |
| *Listeria ivanovii* |
| *Listeria monocytogenes* |
| *Listeria murrayi* |
| *Listeria seeligeri* |
| *Listeria* species |
| *Listeria welshimeri* |
| *Megasphaera elsdenii* |
| *Methylobacterium mesophilicum* |
| *Metschnikowia pulcherrima* |
| *Microbacterium* species |
| *Micrococcus luteus* |
| *Micrococcus lylae* |
| *Micrococcus* species |
| *Mobiluncus curtisii* |
| *Mobiluncus mulieris* |
| *Mobiluncus* species |
| *Moellerella wisconsensis* |
| *Moraxella* (*Branhamella*) *catarrhalis* |
| *Moraxella atlantae* |
| *Moraxella bovis* |
| *Moraxella lacunata* |
| *Moraxella nonliquefaciens* |
| *Moraxella osloensis* |
| *Moraxella phenylpyruvica* |
| *Moraxella* species |
| *Morganella morganii* |
| *Morganella morganii* subsp. *morganii* |
| *Morganella morganii* subsp. *sibonii* |
| *Mycobacterium africanum* |
| *Mycobacterium asiaticum* |
| *Mycobacterium avium* |
| *Mycobacterium bovis* |
| *Mycobacterium chelonae* |
| *Mycobacterium fortuitum* |
| *Mycobacterium gordonae* |
| *Mycobacterium kansasii* |
| *Mycobacterium malmoense* |
| *Mycobacterium marinum* |
| *Mycobacterium phlei* |
| *Mycobacterium scrofulaceum* |
| *Mycobacterium smegmatis* |
| *Mycobacterium* species |
| *Mycobacterium tuberculosis* |
| *Mycobacterium ulcerans* |
| *Mycobacterium xenopi* |
| *Mycoplasma fermentans* |
| *Mycoplasma hominis* |
| *Mycoplasma orale* |
| *Mycoplasma pneumoniae* |
| *Mycoplasma* species |
| *Myroides* species |
| *Neisseria cinerea* |
| *Neisseria elongata* subsp. *elongata* |
| *Neisseria flava* |
| *Neisseria flavescens* |
| *Neisseria gonorrhoeae* |
| *Neisseria lactamica* |
| *Neisseria meningitidis* |
| *Neisseria mucosa* |
| *Neisseria perflava* |
| *Neisseria polysaccharea* |
| *Neisseria saprophytes* |
| *Neisseria sicca* |
| *Neisseria subflava* |
| *Neisseria weaveri* |
| *Neisseria weaveri* (CDC group M5) |
| *Nocardia* species |
| *Ochrobactrum anthropi* |
| *Oerskovia* species |
| *Oerskovia xanthineolytica* |
| *Oligella* (*Moraxella*) *urethralis* |
| *Oligella* species |
| *Oligella ureolytica* |
| *Paenibacillus alvei* |
| *Paenibacillus macerans* |
| *Paenibacillus polymyxa* |
| *Pantoea agglomerans* |
| *Pantoea ananas* (*Erwinia uredovora*) |
| *Pantoea dispersa* |
| *Pantoea* species |
| *Pantoea stewartii* |
| *Pasteurella* (*Haemophilus*) *avium* |
| *Pasteurella aerogenes* |
| *Pasteurella gallinarum* |
| *Pasteurella haemolytica* |
| *Pasteurella haemolyticus* |
| *Pasteurella multocida* |
| *Pasteurella multocida* SF |
| *Pasteurella multocida* subsp. *multocida* |
| *Pasteurella multocida* subsp. *septica* |
| *Pasteurella pneumotropica* |
| *Pasteurella* species |
| *Pasteurella ureae* |
| *Pediococcus acidilactici* |
| *Pediococcus damnosus* |
| *Pediococcus pentosaceus* |
| *Pediococcus* species |
| *Peptococcus niger* |
| *Peptococcus* species |
| *Peptostreptococcus anaerobius* |
| *Peptostreptococcus asaccharolyticus* |

TABLE 15-continued

| Microorganisms identified by commercial systems[1]. |
| --- |
| *Peptostreptococcus indolicus* |
| *Peptostreptococcus magnus* |
| *Peptostreptococcus micros* |
| *Peptostreptococcus parvulus* |
| *Peptostreptococcus prevotii* |
| *Peptostreptococcus productus* |
| *Peptostreptococcus* species |
| *Peptostreptococcus tetradius* |
| *Phaecoccomyces exophialiae* |
| *Photobacterium damselae* |
| *Pichia* (*Hansenula*) *anomala* |
| *Pichia* (*Hansenula*) *jadinii* |
| *Pichia* (*Hansenula*) *petersonii* |
| *Pichia angusta* (*Hansenula polymorpha*) |
| *Pichia carsonii* (*P. vini*) |
| *Pichia etchellsii* |
| *Pichia farinosa* |
| *Pichia fermentans* |
| *Pichia membranaefaciens* |
| *Pichia norvegensis* |
| *Pichia ohmeri* |
| *Pichia spartinae* |
| *Pichia* species |
| *Plesiomonas shigelloides* |
| *Porphyromonas asaccharolytica* |
| *Porphyromonas endodontalis* |
| *Porphyromonas gingivalis* |
| *Porphyromonas levii* |
| *Prevotella* (*Bacteroides*) *buccae* |
| *Prevotella* (*Bacteroides*) *buccalis* |
| *Prevotella* (*Bacteroides*) *corporis* |
| *Prevotella* (*Bacteroides*) *denticola* |
| *Prevotella* (*Bacteroides*) *loescheii* |
| *Prevotella* (*Bacteroides*) *oralis* |
| *Prevotella* (*Bacteroides*) *disiens* |
| *Prevotella* (*Bacteroides*) *oris* |
| *Prevotella bivia* (*Bacteroides bivius*) |
| *Prevotella intermedia* (*Bacteroides intermedius*) |
| *Prevotella melaninogenica* (*Bacteroides melaninogenicus*) |
| *Prevotella ruminicola* |
| *Propionibacterium acnes* |
| *Propionibacterium avidum* |
| *Propionibacterium granulosum* |
| *Propionibacterium propionicum* |
| *Propionibacterium* species |
| *Proteus mirabilis* |
| *Proteus penneri* |
| *Proteus* species |
| *Proteus vulgaris* |
| *Prototheca* species |
| *Prototheca wickerhamii* |
| *Prototheca zopfii* |
| *Providencia alcalifaciens* |
| *Providencia heimbachae* |
| *Providencia rettgeri* |
| *Providencia rustigianii* |
| *Providencia* species |
| *Providencia stuartii* |
| *Providencia stuartii* urea + |
| *Pseudomonas* (*Chryseomonas*) *luteola* |
| *Pseudomonas acidovorans* |
| *Pseudomonas aeruginosa* |
| *Pseudomonas alcaligenes* |
| *Pseudomonas cepacia* |
| *Pseudomonas chlororaphis* (*P. aureofaciens*) |
| *Pseudomonas fluorescens* |
| *Pseudomonas fluorescens* group |
| *Pseudomonas mendocina* |
| *Pseudomonas pseudoalcaligenes* |
| *Pseudomonas putida* |
| *Pseudomonas* species |
| *Pseudomonas stutzeri* |
| *Pseudomonas testosteroni* |
| *Pseudomonas vesicularis* |

TABLE 15-continued

| Microorganisms identified by commercial systems[1]. |
| --- |
| *Pseudoramibacter* (*Eubacterium*) *alactolyticus* |
| *Psychrobacter* (*Moraxella*) *phenylpyruvicus* |
| *Rahnella aquatilis* |
| *Ralstonia* (*Pseudomonas*, *Burkholderia*) *pickettii* |
| *Rhodococcus* (*Corynebacterium*) *equi* |
| *Rhodococcus* species |
| *Rhodosporidium toruloides* |
| *Rhodotorula glutinis* |
| *Rhodotorula minuta* |
| *Rhodotorula mucilaginosa* (*R. rubra*) |
| *Rhodotorula* species |
| *Rickettsia* species |
| *Rothia dentocariosa* |
| *Saccharomyces cerevisiae* |
| *Saccharomyces exiguus* |
| *Saccharomyces kluyverii* |
| *Saccharomyces* species |
| *Sakaguchia dacryoides* (*Rhodosporidium dacryoidum*) |
| *Salmonella arizonae* |
| *Salmonella choleraesuis* |
| *Salmonella enteritidis* |
| *Salmonella gallinarum* |
| *Salmonella paratyphi* A |
| *Salmonella paratyphi* B |
| *Salmonella pullorum* |
| *Salmonella* species |
| *Salmonella typhi* |
| *Salmonella typhimurium* |
| *Salmonella typhisuis* |
| *Salmonella*/Arizona |
| *Serratia ficaria* |
| *Serratia fonticola* |
| *Serratia grimesii* |
| *Serratia liquefaciens* |
| *Serratia marcescens* |
| *Serratia odorifera* |
| *Serratia odorifera* type 1 |
| *Serratia odorifera* type 2 |
| *Serratia plymuthica* |
| *Serratia proteamaculans* |
| *Serratia proteamaculans* subsp. *proteamaculans* |
| *Serratia proteamaculans* subsp. *quinovora* |
| *Serratia rubidaea* |
| *Serratia* species |
| *Shewanella* (*Pseudomonas*, *Alteromonas*) *putrefaciens* |
| *Shigella boydii* |
| *Shigella dysenteriae* |
| *Shigella flexneri* |
| *Shigella sonnei* |
| *Shigella* species |
| *Sphingobacterium multivorum* |
| *Sphingobacterium* species |
| *Sphingobacterium spiritivorum* |
| *Sphingobacterium thalpophilum* |
| *Sphingomonas* (*Pseudomonas*) *paucimobilis* |
| *Sporidiobolus salmonicolor* |
| *Sporobolomyces roseus* |
| *Sporobolomyces salmonicolor* |
| *Sporobolomyces* species |
| *Staphylococcus* (*Peptococcus*) *saccharolyticus* |
| *Staphylococcus arlettae* |
| *Staphylococcus aureus* |
| *Staphylococcus aureus* (Coagulase-negative) |
| *Staphylococcus auricularis* |
| *Staphylococcus capitis* |
| *Staphylococcus capitis* subsp. *capitis* |
| *Staphylococcus capitis* subsp. *ureolyticus* |

TABLE 15-continued

| Microorganisms identified by commercial systems[1]. |
| --- |
| *Staphylococcus caprae* |
| *Staphylococcus carnosus* |
| *Staphylococcus caseolyticus* |
| *Staphylococcus chromogenes* |
| *Staphylococcus cohnii* |
| *Staphylococcus cohnii* subsp. *cohnii* |
| *Staphylococcus cohnii* subsp. *urealyticum* |
| *Staphylococcus epidermidis* |
| *Staphylococcus equorum* |
| *Staphylococcus gallinarum* |
| *Staphylococcus haemolyticus* |
| *Staphylococcus hominis* |
| *Staphylococcus hominis* subsp. *hominis* |
| *Staphylococcus hominis* subsp. *novobiosepticus* |
| *Staphylococcus hyicus* |
| *Staphylococcus intermedius* |
| *Staphylococcus kloosii* |
| *Staphylococcus lentus* |
| *Staphylococcus lugdunensis* |
| *Staphylococcus saprophyticus* |
| *Staphylococcus schleiferi* |
| *Staphylococcus sciuri* |
| *Staphylococcus simulans* |
| *Staphylococcus* species |
| *Staphylococcus warneri* |
| *Staphylococcus xylosus* |
| *Stenotrophomonas* (*Xanthomonas*) *maltophilia* |
| *Stephanoascus ciferrii* |
| *Stomatococcus mucilaginosus* |
| *Streptococcus acidominimus* |
| *Streptococcus agalactiae* |
| *Streptococcus agalactiae* (Group B) |
| *Streptococcus agalactiae* hemolytic |
| *Streptococcus agalactiae* non-hemolytic |
| *Streptococcus alactolyticus* |
| *Streptococcus anginosus* |
| *Streptococcus anginosus* (Group D, *nonenterococci*) |
| *Streptococcus* beta-hemolytic group A |
| *Streptococcus* beta-hemolytic non-group A or B |
| *Streptococcus* beta-hemolytic non-group A |
| *Streptococcus* beta-hemolytic |
| *Streptococcus bovis* (Group D, *nonenterococci*) |
| *Streptococcus bovis* I |
| *Streptococcus bovis* II |
| *Streptococcus canis* |
| *Streptococcus constellatus* |
| *Streptococcus constellatus* (*Streptococcus milleri* I) |
| *Streptococcus constellatus* (*viridans Streptococcus*) |
| *Streptococcus downei* |
| *Streptococcus dysgalactiae* subsp. *dysgalactiae* |
| *Streptococcus dysgalactiae* subsp. *equisimilis* |
| *Streptococcus equi* (Group C/Group G *Streptococcus*) |
| *Streptococcus equi* subsp. *equi* |
| *Streptococcus equi* subsp. *zooepidemicus* |
| *Streptococcus equinus* |
| *Streptococcus equinus* (Group D, *nonenterococci*) |
| *Streptococcus equisimilis* |
| *Streptococcus equisimulis* (Group C/Group G *Streptococcus*) |
| *Streptococcus* Gamma (non)-hemolytic |
| *Streptococcus gordonii* |

TABLE 15-continued

| Microorganisms identified by commercial systems[1]. |
| --- |
| *Streptococcus* Group B |
| *Streptococcus* Group C |
| *Streptococcus* Group D |
| *Streptococcus* Group E |
| *Streptococcus* Group F |
| *Streptococcus* Group G |
| *Streptococcus* Group L |
| *Streptococcus* Group P |
| *Streptococcus* Group U |
| *Streptococcus intermedius* |
| *Streptococcus intermedius* (*Streptococcus milleri* II) |
| *Streptococcus intermedius* (*viridans Streptococcus*) |
| *Streptococcus milleri* group |
| *Streptococcus mitis* |
| *Streptococcus mitis* (*viridans Streptococcus*) |
| *Streptococcus mitis* group |
| *Streptococcus mutans* |
| *Streptococcus mutans* (*viridans Streptococcus*) |
| *Streptococcus oralis* |
| *Streptococcus parasanguis* |
| *Streptococcus pneumoniae* |
| *Streptococcus porcinus* |
| *Streptococcus pyogenes* |
| *Streptococcus pyogenes* (Group A) |
| *Streptococcus salivarius* |
| *Streptococcus salivarius* (*viridans Streptococcus*) |
| *Streptococcus salivarius* subsp. *salivarius* |
| *Streptococcus salivarius* subsp. *thermophilus* |
| *Streptococcus sanguis* |
| *Streptococcus sanguis* I (*viridans Streptococcus*) |
| *Streptococcus sanguis* II |
| *Streptococcus sanguis* II (*viridans Streptococcus*) |
| *Streptococcus sobrinus* |
| *Streptococcus* species |
| *Streptococcus suis* I |
| *Streptococcus suis* II |
| *Streptococcus uberis* |
| *Streptococcus uberis* (*viridans Streptococcus*) |
| *Streptococcus vestibularis* |
| *Streptococcus zooepidemicus* |
| *Streptococcus zooepidemicus* (Group C) |
| *Streptomyces somaliensis* |
| *Streptomyces* species |
| *Suttonella* (*Kingella*) *indologenes* |
| *Tatumella ptyseos* |
| *Tetragenococcus* (*Pediococcus*) *halophilus* |
| *Torulaspora delbrueckii* (*Saccharomyces rosei*) |
| *Torulopsis candida* |
| *Torulopsis haemulonii* |
| *Torulopsis inconspicua* |
| *Treponema* species |
| *Trichosporon asahii* |
| *Trichosporon asteroides* |
| *Trichosporon beigelii* |
| *Trichosporon cutaneum* |
| *Trichosporon inkin* |
| *Trichosporon mucoides* |
| *Trichosporon ovoides* |
| *Trichosporon pullulans* |
| *Trichosporon* species |
| *Turicella otitidis* |
| *Ureaplasma* species |
| *Ureaplasma urealyticum* |
| *Veillonella parvula* (*V. alcalescens*) |
| *Veillonella* species |

TABLE 15-continued

Microorganisms identified by commercial systems[1].

| |
|---|
| *Vibrio alginolyticus* |
| *Vibrio cholerae* |
| *Vibrio damsela* |
| *Vibrio fluvialis* |
| *Vibrio furnissii* |
| *Vibrio harveyi* |
| *Vibrio hollisae* |
| *Vibrio metschnikovii* |
| *Vibrio mimicus* |
| *Vibrio parahaemolyticus* |
| *Vibrio* species |
| *Vibrio* species SF |
| *Vibrio vulnificus* |
| *Weeksella* (*Bergeylla*) *virosa* |
| *Weeksella* species |
| *Weeksella virosa* |
| *Williopsis* (*Hansenula*) *saturnus* |
| *Xanthomonas campestris* |
| *Xanthomonas* species |
| *Yarrowia* (*Candida*) *lipolytica* |
| *Yersinia aldovae* |
| *Yersinia enterocolitica* |
| *Yersinia enterocolitica* group |
| *Yersinia frederiksenii* |
| *Yersinia intermedia* |
| *Yersinia intermedius* |
| *Yersinia kristensenii* |
| *Yersinia pestis* |
| *Yersinia pseudotuberculosis* |
| *Yersinia pseudotuberculosis* SF |
| *Yersinia ruckeri* |
| *Yersinia* species |
| *Yokenella regensburgei* |
| *Yokenella regensburgei* (*Koserella trabulsii*) |
| *Zygoascus hellenicus* |
| *Zygosaccharomyces* species |

[1]The list includes microorganisms that may be identified by API identification test systems and VITEK ® automated identification system from bioMérieux Inc., or by the MicroScan ®-WalkAway ® automated systems from Dade Behring. Identification relies on classical identification methods using batteries of biochemical and other phenotypical tests.

TABLE 16 tuf gene sequences obtained in our laboratory (Example 42).

| Species | Strain no. | Gene | GenBank Accession no.* |
|---|---|---|---|
| *Abiotrophia adiacens* | ATCC49175 | tuf | AF124224 |
| *Enterococcus avium* | ATCC14025 | tufA | AF124220 |
| | | tufB | AF274715 |
| *Enterococcus casseliflavus* | ATCC25788 | tufA | AF274716 |
| | | tufB | AF274717 |
| *Enterococcus cecorum* | ATCC43198 | tuf | AF274718 |
| *Enterococcus columbae* | ATCC51263 | tuf | AF274719 |
| *Enterococcus dispar* | ATCC51266 | tufA | AF274720 |
| | | tufB | AF274721 |
| *Enterococcus durans* | ATCC19432 | tufA | AF274722 |
| | | tufB | AF274723 |
| *Enterococcus faecalis* | ATCC29212 | tuf | AF124221 |
| *Enterococcus faecium* | ATCC 19434 | tufA | AF124222 |
| | | tufB | AF274724 |

TABLE 16-continued tuf gene sequences obtained in our laboratory (Example 42).

| Species | Strain no. | Gene | GenBank Accession no.* |
|---|---|---|---|
| *Enterococcus gallinarum* | ATCC49573 | tufA | AF124223 |
| | | tufB | AF274725 |
| *Enterococcus hirae* | ATCC8043 | tufA | AF274726 |
| | | tufB | AF274727 |
| *Enterococcus malodoratus* | ATCC43197 | tufA | AF274728 |
| | | tufB | AF274729 |
| *Enterococcus mundtii* | ATCC43186 | tufA | AF274730 |
| | | tufB | AF274731 |
| *Enterococcus pseudoavium* | ATCC49372 | tufA | AF274732 |
| | | tufB | AF274733 |
| *Enterococcus raffinosus* | ATCC49427 | tufA | AF274734 |
| | | tufB | AF274735 |
| *Enterococcus saccharolyticus* | ATCC43076 | tuf | AF274736 |
| *Enterococcus solitarius* | ATCC49428 | tuf | AF274737 |
| *Enterococcus sulfureus* | ATCC49903 | tuf | AF274738 |
| *Lactococcus lactis* | ATCC11154 | tuf | AF274745 |
| *Listeria monocytogenes* | ATCC15313 | tuf | AF274746 |
| *Listeria seeligeri* | ATCC35967 | tuf | AF274747 |
| *Staphylococcus aureus* | ATCC25923 | tuf | AF274739 |
| *Staphylococcus epidermidis* | ATCC14990 | tuf | AF274740 |
| *Streptococcus mutans* | ATCC25175 | tuf | AF274741 |
| *Streptococcus pneumoniae* | ATCC6303 | tuf | AF274742 |
| *Streptococcus pyogenes* | ATCC19615 | tuf | AF274743 |
| *Streptococcus suis* | ATCC43765 | tuf | AF274744 |

*Corresponding sequence ID NO. for the above ATCC strains are given in table 7.

TABLE 17 tuf gene sequences selected from databases for Example 42.

| Species | Gene | Accession no.* |
|---|---|---|
| *Agrobacterium tumefaciens* | tufA | X99673 |
| | tufB | X99674 |
| *Anacystis nidulans* | tuf | X17442 |
| *Aquifex aeolicus* | tufA | AE000657 |
| | tufB | AE000657 |
| *Bacillus stearothermophilus* | tuf | AJ000260 |
| *Bacillus subtilis* | tuf | AL009126 |
| *Bacteroides fragilis* | tuf | P33165 |
| *Borrelia burgdorferi* | tuf | AE000783 |
| *Brevibacterium linens* | tuf | X76863 |
| *Bulkholderia cepacia* | tuf | P33167 |
| *Campylobacter jejuni* | tufB | Y17167 |
| *Chlamydia pneumoniae* | tuf | AE001363 |
| *Chlamydia trachomatis* | tuf | M74221 |
| *Corynebacterium glutamicum* | tuf | X77034 |
| *Cytophaga lytica* | tuf | X77035 |
| *Deinococcus radiodurans* | tuf | AE000513 |
| *Escherichia coli* | tufA | J01690 |
| | tufB | J01717 |
| *Fervidobacterium islandicum* | tuf | Y15788 |
| *Haemophilus influenzae* | tufA | L42023 |
| | tufB | L42023 |
| *Helicobacter pylori* | tuf | AE000511 |
| *Homo sapiens* (Human) | EF-1α | X03558 |
| *Methanococcus jannaschii* | EF-1α | U67486 |
| *Mycobacterium leprae* | tuf | D13869 |
| *Mycobacterium tuberculosis* | tuf | X63539 |
| *Mycoplasma genitalium* | tuf | L43967 |
| *Mycoplasma pneumoniae* | tuf | U00089 |
| *Neisseria gonorrhoeae* | tufA | L36380 |
| *Nicotiana tabacum* (Tobacco) | EF-1α | U04632 |

TABLE 17-continued tuf gene sequences selected from databases for Example 42.

| Species | Gene | Accession no.* |
|---|---|---|
| *Peptococcus niger* | tuf | X76869 |
| *Planobispora rosea* | tufl | U67308 |
| *Saccharomyces cerevisiae* (Yeast) | EF-1α | X00779 |
| *Salmonella typhimurium* | tufA | X55116 |
| | tufB | X55117 |
| *Shewanella putrefaciens* | tuf | P33169 |
| *Spirochaeta aurantia* | tuf | X76874 |
| *Spirulina platensis* | tufA | X15646 |
| *Streptomyces aureofaciens* | tufl | AF007125 |
| *Streptomyces cinnamoneus* | tufl | X98831 |
| *Streptomyces coelicolor* | tufl | X77039 |
| | tuf3 | X77040 |
| *Streptomyces collinus* | tufl | S79408 |
| *Streptomyces ramocissimus* | tufl | X67057 |
| | tuf2 | X67058 |
| | tuf3 | X67059 |
| *Synechocystis* sp. | tuf | AB001339 |
| *Taxeobacter ocellatus* | tuf | X77036 |
| *Thermotoga maritima* | tuf | AE000512 |
| *Thermus aquaticus* | tuf | X66322 |
| *Thermus thermophilus* | tuf | X06657 |
| *Thiobacillus cuprinus* | tuf | U78300 |
| *Treponema pallidum* | tuf | AE000520 |
| *Wolinella succinogenes* | tuf | X76872 |

*Sequence data were obtained from GenBank, EMBL, and SWISSPROT databases. Genes were designated as appeared in the references.

TABLE 18

Nucleotide and amino acid sequence identities of EF-Tu between different *enterococci* and other low G + C gram-positive bacteria.

| Bacterial tuf gene | 1 | 2 | 3 | 4 | 5 | 6 | 7 | 8 | 9 | 10 | 11 | 12 | 13 | 14 | 15 | 16 | 17 | 18 | 19 | 20 |
|---|---|---|---|---|---|---|---|---|---|---|---|---|---|---|---|---|---|---|---|---|
| 1. *E. avium* tufA | | 96 | 98 | 96 | 96 | 96 | 96 | 97 | 95 | 98 | 99 | 95 | 95 | 96 | 94 | 96 | 93 | 86 | 87 | 85 |
| 2. *E. casseliflavus* tufA | 90 | | 97 | 96 | 96 | 99 | 96 | 95 | 96 | 96 | 96 | 95 | 95 | 96 | 96 | 94 | 93 | 87 | 88 | 86 |
| 3. *E. dispar* tufA | 93 | 90 | | 95 | 95 | 96 | 95 | 96 | 95 | 97 | 97 | 91 | 90 | 95 | 95 | 95 | 93 | 86 | 87 | 85 |
| 4. *E. durans* tufA | 90 | 89 | 90 | | 98 | 96 | 99 | 93 | 99 | 95 | 96 | 90 | 91 | 94 | 95 | 94 | 92 | 87 | 87 | 86 |
| 5. *E. faecium* tufA | 89 | 90 | 89 | 96 | | 96 | 98 | 93 | 98 | 95 | 96 | 89 | 91 | 88 | 94 | 93 | 92 | 87 | 88 | 86 |
| 6. *E. gallinarum* tufA | 90 | 97 | 89 | 89 | 89 | | 96 | 93 | 95 | 96 | 96 | 88 | 89 | 89 | 96 | 93 | 92 | 87 | 87 | 86 |
| 7. *E. hirae* tufA | 90 | 90 | 89 | 99 | 96 | 89 | | 93 | 99 | 95 | 96 | 91 | 91 | 89 | 95 | 94 | 92 | 86 | 87 | 86 |
| 8. *E. malodoratus* tufA | 96 | 91 | 94 | 90 | 89 | 90 | 89 | | 92 | 97 | 97 | 89 | 89 | 90 | 93 | 96 | 92 | 86 | 85 | 82 |
| 9. *E. mundtii* tufA | 89 | 89 | 88 | 96 | 93 | 89 | 96 | 88 | | 94 | 95 | 88 | 90 | 88 | 94 | 94 | 92 | 87 | 87 | 86 |
| 10. *E. pseudoavium* tufA | 97 | 92 | 93 | 90 | 89 | 91 | 89 | 97 | 89 | | 98 | 90 | 90 | 91 | 95 | 96 | 94 | 87 | 87 | 86 |
| 11. *E. raffinosus* tufA | 97 | 91 | 93 | 90 | 89 | 89 | 89 | 97 | 88 | 97 | | 91 | 90 | 90 | 94 | 96 | 93 | 86 | 87 | 85 |
| 12. *E. cecorum* tufA | 90 | 90 | 95 | 96 | 96 | 95 | 96 | 92 | 95 | 95 | 95 | | 98 | 95 | 93 | 93 | 93 | 88 | 88 | 87 |
| 13. *E. columbae* tufA | 90 | 90 | 95 | 96 | 97 | 96 | 96 | 93 | 95 | 95 | 95 | 97 | | 95 | 94 | 92 | 92 | 89 | 88 | 86 |
| 14. *E. faecalis* tufA | 91 | 91 | 90 | 89 | 96 | 97 | 94 | 94 | 94 | 95 | 96 | 90 | 89 | | 94 | 94 | 93 | 87 | 87 | 86 |
| 15. *E. saccharolyticus* tufA | 91 | 91 | 91 | 90 | 87 | 90 | 89 | 91 | 89 | 92 | 91 | 89 | 89 | 92 | | 94 | 92 | 86 | 87 | 85 |
| 16. *E. sulfureus* tufA | 91 | 89 | 90 | 91 | 88 | 88 | 90 | 91 | 89 | 92 | 91 | 88 | 89 | 91 | 94 | | 91 | 85 | 84 | 81 |
| 17. *E solitarius* tuf | 83 | 84 | 83 | 83 | 84 | 83 | 82 | 84 | 83 | 84 | 84 | 84 | 83 | 84 | 83 | 83 | | 88 | 87 | 86 |
| 18. *E. avium* tufB | 77 | 77 | 78 | 78 | 76 | 77 | 78 | 78 | 77 | 78 | 77 | 78 | 78 | 78 | 77 | 76 | 77 | | 93 | 93 |
| 19. *E. casseliflavus* tufB | 71 | 72 | 72 | 72 | 70 | 72 | 72 | 70 | 71 | 72 | 72 | 72 | 70 | 72 | 72 | 68 | 72 | 79 | | 93 |
| 20. *E. dispar* tufB | 76 | 78 | 77 | 77 | 77 | 77 | 77 | 76 | 77 | 76 | 77 | 77 | 77 | 77 | 78 | 75 | 78 | 82 | 79 | |
| 21. *E. durans* tufB | 77 | 78 | 78 | 78 | 76 | 77 | 78 | 77 | 78 | 77 | 78 | 77 | 77 | 78 | 78 | 75 | 75 | 83 | 80 | 82 |
| 22. *E. faecium* tufB | 76 | 75 | 76 | 76 | 75 | 77 | 76 | 76 | 76 | 75 | 76 | 77 | 77 | 77 | 76 | 74 | 74 | 80 | 78 | 79 |
| 23. *E. gallinarum* tufB | 72 | 73 | 72 | 73 | 72 | 74 | 72 | 71 | 72 | 72 | 72 | 72 | 72 | 73 | 73 | 72 | 72 | 78 | 81 | 77 |
| 24. *E. hirae* tufB | 75 | 74 | 75 | 75 | 75 | 75 | 75 | 75 | 76 | 75 | 75 | 74 | 74 | 74 | 75 | 72 | 74 | 80 | 79 | 79 |
| 25. *E. malodoratus* tufB | 76 | 76 | 76 | 77 | 77 | 77 | 77 | 74 | 77 | 76 | 76 | 77 | 75 | 77 | 77 | 73 | 78 | 90 | 79 | 83 |
| 26. *E. mundtii* tufB | 74 | 74 | 74 | 75 | 73 | 74 | 74 | 74 | 74 | 74 | 74 | 74 | 74 | 75 | 74 | 71 | 73 | 80 | 80 | 78 |
| 27. *E. pseudoavium* tufB | 77 | 77 | 78 | 77 | 76 | 78 | 77 | 77 | 76 | 78 | 78 | 77 | 77 | 78 | 78 | 77 | 78 | 91 | 80 | 85 |
| 28. *E. raffinosus* tufB | 78 | 79 | 79 | 78 | 77 | 77 | 78 | 78 | 77 | 79 | 79 | 78 | 78 | 78 | 79 | 77 | 79 | 90 | 79 | 84 |
| 29. *A. adiacens* tuf | 88 | 87 | 87 | 86 | 88 | 86 | 86 | 89 | 86 | 88 | 88 | 87 | 88 | 88 | 88 | 90 | 82 | 77 | 70 | 76 |
| 30. *B. subtilis* tuf | 81 | 80 | 79 | 79 | 80 | 80 | 79 | 79 | 79 | 80 | 81 | 80 | 81 | 81 | 80 | 78 | 78 | 73 | 69 | 73 |
| 31. *L. monocytogenes* tuf | 82 | 81 | 82 | 82 | 82 | 82 | 82 | 81 | 81 | 81 | 82 | 81 | 81 | 81 | 81 | 79 | 79 | 76 | 71 | 75 |
| 32. *L. seeligeri* tuf | 82 | 81 | 82 | 82 | 82 | 81 | 82 | 81 | 82 | 81 | 82 | 81 | 82 | 80 | 81 | 79 | 79 | 76 | 71 | 76 |
| 33. *S. aureus* tuf | 84 | 84 | 83 | 83 | 83 | 84 | 84 | 82 | 84 | 83 | 84 | 86 | 86 | 84 | 82 | 81 | 79 | 75 | 69 | 75 |
| 34. *S. epidermidis* tuf | 83 | 85 | 83 | 84 | 83 | 84 | 84 | 82 | 84 | 83 | 83 | 86 | 87 | 85 | 83 | 82 | 79 | 75 | 69 | 75 |
| 35. *S. mutans* tuf | 76 | 77 | 76 | 76 | 76 | 77 | 76 | 75 | 76 | 76 | 76 | 77 | 76 | 76 | 76 | 74 | 78 | 79 | 72 | 77 |
| 36. *S. pneumoniae* tuf | 76 | 77 | 76 | 77 | 77 | 77 | 77 | 75 | 78 | 76 | 76 | 77 | 76 | 77 | 75 | 74 | 75 | 76 | 72 | 76 |
| 37. *S. pyogenes* tuf | 76 | 77 | 76 | 77 | 76 | 75 | 77 | 74 | 77 | 76 | 75 | 76 | 75 | 77 | 75 | 73 | 75 | 74 | 71 | 75 |
| 38. *S. suis* tuf | 74 | 78 | 76 | 76 | 74 | 75 | 76 | 74 | 78 | 76 | 77 | 77 | 75 | 78 | 76 | 73 | 75 | 74 | 71 | 75 |
| 39. *L. lactis* tuf | 75 | 76 | 75 | 76 | 75 | 75 | 76 | 75 | 76 | 76 | 76 | 77 | 76 | 76 | 75 | 72 | 74 | 75 | 72 | 75 |

TABLE 18-continued

Nucleotide and amino acid sequence identities of EF-Tu between different *enterococci* and other low G + C gram-positive bacteria.

| Bacterial tuf gene | 21 | 22 | 23 | 24 | 25 | 26 | 27 | 28 | 29 | 30 | 31 | 32 | 33 | 34 | 35 | 36 | 37 | 38 | 39 |
|---|---|---|---|---|---|---|---|---|---|---|---|---|---|---|---|---|---|---|---|
| 1. *E. avium* tufA | 86 | 86 | 86 | 86 | 85 | 86 | 87 | 86 | 92 | 91 | 90 | 90 | 90 | 92 | 84 | 85 | 84 | 82 | 83 |
| 2. *E. casseliflavus* tufA | 87 | 87 | 86 | 87 | 87 | 87 | 88 | 88 | 94 | 91 | 90 | 91 | 91 | 92 | 86 | 87 | 85 | 85 | 85 |
| 3. *E. dispar* tufA | 87 | 87 | 86 | 87 | 86 | 87 | 87 | 87 | 93 | 90 | 89 | 90 | 90 | 92 | 85 | 86 | 84 | 85 | 84 |
| 4. *E. durans* tufA | 86 | 86 | 85 | 86 | 87 | 87 | 88 | 87 | 94 | 90 | 90 | 90 | 90 | 91 | 85 | 86 | 84 | 84 | 84 |
| 5. *E. faecium* tufA | 86 | 87 | 87 | 86 | 87 | 87 | 88 | 87 | 94 | 92 | 91 | 91 | 91 | 93 | 85 | 86 | 84 | 84 | 84 |
| 6. *E. gallinarum* tufA | 87 | 87 | 87 | 86 | 87 | 87 | 88 | 87 | 93 | 92 | 90 | 90 | 90 | 93 | 85 | 86 | 84 | 83 | 84 |
| 7. *E. hirae* tufA | 86 | 86 | 85 | 86 | 86 | 87 | 87 | 87 | 94 | 90 | 90 | 90 | 90 | 91 | 85 | 86 | 84 | 84 | 84 |
| 8. *E. malodoratus* tufA | 85 | 85 | 85 | 85 | 83 | 85 | 86 | 86 | 92 | 90 | 88 | 88 | 89 | 91 | 83 | 84 | 83 | 83 | 82 |
| 9. *E. mundtii* tufA | 86 | 86 | 85 | 86 | 87 | 87 | 88 | 87 | 94 | 90 | 89 | 90 | 89 | 91 | 85 | 86 | 84 | 84 | 84 |
| 10. *E. pseudoavium* tufA | 87 | 87 | 86 | 87 | 86 | 87 | 88 | 88 | 93 | 90 | 89 | 90 | 90 | 91 | 85 | 86 | 85 | 85 | 84 |
| 11. *E. raffinosus* tufA | 86 | 86 | 85 | 86 | 85 | 87 | 87 | 87 | 93 | 89 | 89 | 90 | 89 | 91 | 84 | 85 | 84 | 84 | 83 |
| 12. *E. cecorum* tufA | 87 | 87 | 86 | 86 | 89 | 87 | 89 | 89 | 93 | 90 | 90 | 91 | 91 | 93 | 86 | 86 | 84 | 85 | 84 |
| 13. *E. columbae* tufA | 87 | 88 | 88 | 87 | 87 | 87 | 89 | 89 | 94 | 92 | 91 | 91 | 92 | 93 | 86 | 86 | 85 | 86 | 85 |
| 14. *E. faecalis* tufA | 87 | 87 | 86 | 86 | 87 | 87 | 88 | 87 | 93 | 91 | 89 | 90 | 91 | 93 | 86 | 86 | 86 | 85 | 85 |
| 15. *E. saccharolyticus* tufA | 87 | 86 | 84 | 86 | 85 | 87 | 87 | 87 | 92 | 90 | 89 | 89 | 88 | 90 | 84 | 85 | 84 | 84 | 84 |
| 16. *E. sulfureus* tufA | 84 | 85 | 84 | 84 | 81 | 84 | 85 | 85 | 91 | 90 | 87 | 88 | 89 | 91 | 82 | 83 | 83 | 82 | 82 |
| 17. *E solitarius* tuf | 87 | 87 | 86 | 87 | 88 | 88 | 88 | 89 | 92 | 91 | 89 | 90 | 90 | 91 | 86 | 85 | 85 | 85 | 84 |
| 18. *E. avium* tufB | 94 | 94 | 94 | 92 | 98 | 93 | 99 | 97 | 87 | 86 | 87 | 86 | 85 | 86 | 89 | 88 | 87 | 85 | 86 |
| 19. *E. casseliflavus* tufB | 95 | 95 | 96 | 95 | 93 | 95 | 94 | 94 | 87 | 86 | 88 | 88 | 84 | 85 | 90 | 90 | 89 | 88 | 88 |
| 20. *E. dispar* tufB | 91 | 91 | 92 | 91 | 94 | 92 | 93 | 93 | 86 | 83 | 85 | 85 | 82 | 84 | 89 | 89 | 87 | 87 | 86 |
| 21. *E. durans* tufB | | 98 | 95 | 97 | 94 | 97 | 95 | 94 | 87 | 86 | 88 | 88 | 84 | 85 | 90 | 91 | 89 | 88 | 89 |
| 22. *E. faecium* tufB | 86 | | 96 | 97 | 95 | 97 | 95 | 94 | 87 | 87 | 88 | 88 | 84 | 86 | 90 | 90 | 89 | 87 | 87 |
| 23. *E. gallinarum* tufB | 81 | 82 | | 94 | 94 | 95 | 95 | 94 | 85 | 87 | 89 | 89 | 84 | 86 | 90 | 90 | 89 | 87 | 88 |
| 24. *E. hirae* tufB | 84 | 83 | 79 | | 93 | 97 | 93 | 94 | 87 | 85 | 86 | 88 | 83 | 85 | 89 | 90 | 88 | 88 | 87 |
| 25. *E. malodoratus* tufB | 81 | 80 | 77 | 79 | | 93 | 98 | 97 | 87 | 86 | 87 | 87 | 85 | 86 | 88 | 89 | 87 | 85 | 86 |
| 26. *E. mundtii* tufB | 85 | 85 | 80 | 84 | 80 | | 94 | 94 | 87 | 86 | 88 | 88 | 84 | 86 | 90 | 90 | 89 | 88 | 89 |
| 27. *E. pseudoavium* tufB | 84 | 81 | 79 | 80 | 91 | 80 | | 98 | 88 | 87 | 88 | 87 | 85 | 87 | 90 | 89 | 88 | 86 | 87 |
| 28. *E. raffinosus* tufB | 84 | 81 | 77 | 80 | 90 | 81 | 92 | | 87 | 85 | 87 | 88 | 84 | 86 | 90 | 89 | 88 | 88 | 87 |
| 29. *A. adiacens* tuf | 77 | 76 | 71 | 73 | 77 | 73 | 78 | 78 | | 90 | 88 | 89 | 90 | 91 | 85 | 86 | 84 | 85 | 83 |
| 30. *B. subtilis* tuf | 73 | 71 | 70 | 71 | 72 | 71 | 74 | 74 | 78 | | 91 | 92 | 90 | 90 | 82 | 82 | 83 | 82 | 84 |
| 31. *L. monocytogenes* tuf | 75 | 75 | 73 | 74 | 75 | 73 | 78 | 76 | 79 | 82 | | 99 | 88 | 90 | 84 | 84 | 84 | 84 | 84 |
| 32. *L. seeligeri* tuf | 75 | 74 | 73 | 75 | 75 | 73 | 77 | 76 | 79 | 82 | 99 | | 88 | 91 | 84 | 85 | 85 | 84 | 85 |
| 33. *S. aureus* tuf | 75 | 73 | 69 | 72 | 74 | 72 | 74 | 74 | 83 | 79 | 81 | 81 | | 96 | 81 | 82 | 82 | 80 | 82 |
| 34. *S. epidermidis* tuf | 75 | 73 | 68 | 72 | 74 | 72 | 74 | 75 | 81 | 79 | 82 | 81 | 94 | | 83 | 83 | 83 | 83 | 83 |
| 35. *S. mutans* tuf | 78 | 77 | 74 | 75 | 78 | 75 | 78 | 81 | 77 | 75 | 76 | 77 | 74 | 73 | | 97 | 96 | 94 | 88 |
| 36. *S. pneumoniae* tuf | 78 | 76 | 73 | 74 | 77 | 75 | 75 | 78 | 75 | 76 | 77 | 76 | 74 | 74 | 87 | | 96 | 96 | 89 |
| 37. *S. pyogenes* tuf | 78 | 75 | 73 | 74 | 75 | 75 | 75 | 77 | 76 | 77 | 76 | 76 | 73 | 72 | 87 | 93 | | 94 | 89 |
| 38. *S. suis* tuf | 78 | 74 | 70 | 74 | 75 | 73 | 73 | 77 | 77 | 77 | 77 | 77 | 72 | 73 | 88 | 93 | 91 | | 88 |
| 39. *L. lactis* tuf | 77 | 76 | 71 | 75 | 74 | 75 | 75 | 75 | 75 | 75 | 77 | 76 | 74 | 74 | 80 | 83 | 82 | 81 | |

The upper right triangle represents the deduced amino acid sequence identities of gram-positive bacterial EF-Tu, while the lower left triangle represents the DNA sequence identities of the corresponding tuf genes. The sequence identities between different *enterococcal* tufA genes are boxed while those between *enterococcal* tufB genes are shaded.

TABLE 19

Strains analyzed in Example 43.

| Taxon | Strain* | Strain† | 16S rDNA sequence accession number |
|---|---|---|---|
| *Cedecea davisae* | ATCC $33431^T$ | | |
| *Cedecea lapagei* | ATCC $33432^T$ | | |
| *Cedecea neteri* | ATCC $33855^T$ | | |
| *Citrobacter amalonaticus* | ATCC $25405^T$ | CDC $9020\text{-}77^T$ | AF025370 |
| *Citrobacter braakii* | ATCC 43162 | CDC $080\text{-}58^T$ | AF025368 |
| *Citrobacter farmeri* | ATCC $51112^T$ | CDC $2991\text{-}81^T$ | AF025371 |
| *Citrobacter freundii* | ATCC $8090^T$ | DSM $30039^T$ | AJ233408 |
| *Citrobacter koseri* | ATCC $27156^T$ | | |
| *Citrobacter sedlakii* | ATCC $51115^T$ | CDC $4696\text{-}86^T$ | AF025364 |
| *Citrobacter werkmanii* | ATCC $51114^T$ | CDC $0876\text{-}58^T$ | AF025373 |
| *Citrobacter youngae* | ATCC $29935^T$ | | |
| *Edwardsiella hoshinae* | ATCC $33379^T$ | | |
| *Edwardsiella tarda* | ATCC $15947^T$ | CDC 4411-68 | AF015259 |
| *Enterobacter aerogenes* | ATCC $13048^T$ | JCM $1235^T$ | AB004750 |
| *Enterobacter agglomerans* | ATCC 27989 | | |
| *Enterobacter amnigenus* | ATCC $33072^T$ | JCM $1237^T$ | AB004749 |
| *Enterobacter asburiae* | ATCC $35953^T$ | JCM $6051^T$ | AB004744 |

TABLE 19-continued

Strains analyzed in Example 43.

| Taxon | Strain* | Strain† | 16S rDNA sequence accession number |
|---|---|---|---|
| *Enterobacter cancerogenus* | ATCC $35317^T$ | | |
| *Enterobacter cloacae* | ATCC $13047^T$ | | |
| *Enterobacter gergoviae* | ATCC $33028^T$ | JCM $1234^T$ | AB004748 |
| *Enterobacter hormaechei* | ATCC $49162^T$ | | |
| *Enterobacter sakazakii* | ATCC $29544^T$ | JCM $1233^T$ | AB004746 |
| *Escherichia coli* | ATCC $11775^T$ | ATCC $11775^T$ | X80725 |
| *Escherichia coli* | ATCC 25922 | ATCC 25922 | X80724 |
| *Escherichia coli* (ETEC) | ATCC 35401 | | |
| *Escherichia coli* (O157:H7) | ATCC 43895 | ATCC 43895 | Z83205 |
| *Escherichia fergusonii* | ATCC $35469^T$ | | |
| *Escherichia hermanii* | ATCC $33650^T$ | | |
| *Escherichia vulneris* | ATCC $33821^T$ | ATCC $33821^T$ | X80734 |
| *Ewingella americana* | ATCC $33852^T$ | NCPPB 3905 | X88848 |
| *Hafnia alvei* | ATCC $13337^T$ | ATCC $13337^T$ | M59155 |
| *Klebsiella ornithinolytica* | ATCC 31898 | CIP 103.364 | U78182 |
| *Klebsiella oxytoca* | ATCC 33496 | ATCC $13182^T$ | U78183 |
| *Klebsiella planticola* | ATCC $33531^T$ | JCM $7251^T$ | AB004755 |

TABLE 19-continued

Strains analyzed in Example 43.

| Taxon | Strain* | Strain† | 16S rDNA sequence accession number |
|---|---|---|---|
| *Klebsiella pneumoniae* | | | |
| subsp. *pneumoniae* | ATCC 13883$^T$ | DSM 30104$^T$ | AJ233420 |
| subsp. *ozaenae* | ATCC 11296$^T$ | ATCC 11296$^T$ | Y17654 |
| subsp. *rhinoscleromatis* | ATCC 13884$^T$ | | |
| *Kluyvera ascorbata* | ATCC 33433$^T$ | ATCC 14236 | Y07650 |
| *Kluyvera cryocrescens* | ATCC 33435$^T$ | | |
| *Kluyvera georgiana* | ATCC 51603$^T$ | | |
| *Leclercia adecarboxylata* | ATCC 23216$^T$ | | |
| *Leminorella grimontii* | ATCC 33999$^T$ | DSM 5078$^T$ | AJ233421 |
| *Moellerella wisconsensis* | ATCC 35017$^T$ | | |
| *Morganella morganii* | ATCC 25830$^T$ | | |
| *Pantoea agglomerans* | ATCC 27155$^T$ | DSM 3493$^T$ | AJ233423 |
| *Pantoea dispersa* | ATCC 14589$^T$ | | |
| *Plesiomonas shigelloides* | ATCC 14029$^T$ | | |
| *Pragia fontium* | ATCC 49100$^T$ | DSM 5563$^T$ | AJ233424 |
| *Proteus mirabilis* | ATCC 25933 | | |
| *Proteus penneri* | ATCC 33519$^T$ | | |
| *Proteus vulgaris* | ATCC 13315$^T$ | DSM 30118$^T$ | AJ233425 |
| *Providencia alcalifaciens* | ATCC 9886$^T$ | | |
| *Providencia rettgeri* | ATCC 9250 | | |
| *Providencia rustigianii* | ATCC 33673$^T$ | | |
| *Providencia stuartii* | ATCC 33672 | | |
| *Rahnella aquatilis* | ATCC 33071$^T$ | DSM 4594$^T$ | AJ233426 |
| *Salmonella choleraesuis* | | | |
| subsp. *arizonae* | ATCC 13314$^T$ | | |
| subsp. *choleraesuis* | | | |
| serotype *Choleraesuis* | ATCC 7001 | | |
| serotype Enteritidis‡ | ATCC 13076$^T$ | SE22 | SE22 |
| serotype Gallinarum | ATCC 9184 | | |
| serotype Heidelberg | ATCC 8326 | | |
| serotype Paratyphi A | ATCC 9150 | | |
| serotype Paratyphi B | ATCC 8759 | | |
| serotype *Typhi*‡ | ATCC 10749 | St111 | U88545 |
| serotype *Typhimurium*‡ | ATCC 14028 | | |
| serotype Virchow | ATCC 51955 | | |
| subsp. *diarizonae* | ATCC 43973$^T$ | | |
| subsp. *houtenae* | ATCC 43974$^T$ | | |
| subsp. *indica* | ATCC 43976$^T$ | | |
| subsp. *salamae* | ATCC 43972$^T$ | | |
| *Serratia fonticola* | DSM 4576$^T$ | DSM 4576$^T$ | AJ233429 |
| *Serratia grimesii* | ATCC 14460$^T$ | DSM 30063$^T$ | AJ233430 |
| *Serratia liquefaciens* | ATCC 27592$^T$ | | |
| *Serratia marcescens* | ATCC 13880$^T$ | DSM 30121$^T$ | AJ233431 |
| *Serratia odorifera* | ATCC 33077$^T$ | DSM 4582$^T$ | AJ233432 |
| *Serratia plymuthica* | DSM 4540$^T$ | DSM 4540$^T$ | AJ233433 |
| *Serratia rubidaea* | DSM 4480$^T$ | DSM 4480$^T$ | AJ233436 |
| *Shigella boydii* | ATCC 9207 | ATCC 9207 | X96965 |
| *Shigella dysenteriae* | ATCC 11835 | | |
| | | ATCC 13313$^T$ | X96966 |
| | | ATCC 25931 | X96964 |
| *Shigella flexneri* | ATCC 12022 | ATCC 12022 | X96963 |
| *Shigella sonnei* | ATCC 29930$^T$ | | |
| *Tatumella ptyseos* | ATCC 33301$^T$ | DSM 5000$^T$ | AJ233437 |
| *Trabulsiella guamensis* | ATCC 49490$^T$ | | |
| *Yersinia enterocolitica* | ATCC 9610$^T$ | ATCC 9610$^T$ | M59292 |
| *Yersinia frederiksenii* | ATCC 33641$^T$ | | |
| *Yersinia intermedia* | ATCC 29909$^T$ | | |
| *Yersinia pestis* | RRB KIMD27 | ATCC 19428$^T$ | X75274 |
| *Yersinia pseudotuberculosis* | ATCC 29833$^T$ | | |
| *Yersinia rohdei* | ATCC 43380$^T$ | ER-2935$^T$ | X75276 |
| *Shewanella putrefaciens* | ATCC 8071$^T$ | | |
| *Vibrio cholerae* | ATCC 25870 | ATCC 14035$^T$ | X74695 |

T Type strain

*Strains used in this study for sequencing of partial tuf and atpD genes. SEQ ID NOs. for tuf and atpD sequences corresponding to the above reference strains are given in table 7.

†Strains used in other studies for sequencing of 16S rDNA gene. When both strain numbers are on the same row, both strains are considered to be the same although strain numbers may be different.

‡Phylogenetic serotypes considered species by the Bacteriological Code (1990 Revision).

TABLE 20

PCR primer pairs used in this study

| Primer SEQ ID NO. | Sequence | Nucleotide positions* | Amplicon length (bp) |
|---|---|---|---|
| Tuf | | | |
| 664 | 5'-AAYATGATIACIGGIGCIGCICARATGGA-3' | 271-299 | 884 |
| 697 | 5'-CCIACIGTICKICCRCCYTCRCG-3' | 1132-1156 | |
| atpD | | | |
| 568 | 5'-RTIATIGGIGCIGTIRTIGAYGT-3' | 25-47 | 884 |
| 567 | 5'-TCRTCIGCIGGIACRTAIAYIGCYTG-3' | 883-908 | |
| 700 | 5'-TIRTIGAYGTCGARTTCCCTCARG-3' | 38-61 | 871 |
| 567 | 5'-TCRTCIGCIGGIACRTAIAYIGCYTG-3' | 883-908 | |

*The nucleotide positions given are for *E. coli* tuf and atpD sequences (GenBank accession no. AE000410 and V00267, respectively). Numbering starts from the first base of the initiation codon.

TABLE 21

Selection of *M. catarrhalis*-specific primer pairs from SEQ ID NO: 29[1] (466 pb DNA fragment) other than those previously tested[2].

| Primer | Sequence | Amplicon size (bp) | *Moraxella catarrhalis* ATCC 43628 | *Moraxella catarrhalis* ATCC 53879 | *Moraxella nonliquefaciens* | *Moraxella lacunata* | *Moraxella osloensis* | *Moraxella atlantae* |
|---|---|---|---|---|---|---|---|---|
| SEQ ID NO: 118<br>SEQ ID NO: 119 | CGCTGACGGCTTGTTTGTACCATGT<br>TTTGAGCTTTTTATTTTTTGA | 118 | +[3] | + | – | – | – | – |
| VBmcat1<br>VBmcat2 | TGCTTAAGATTCACTCTGCCATTTTTA<br>AGTCGCTGACGGCTTGTTT | 93 | + | + | – | – | – | – |

TABLE 21-continued

Selection of *M. catarrhalis*-specific primer pairs from SEQ ID NO: 29[1] (466 pb DNA fragment) other than those previously tested[2].

| | | | | | | | | |
|---|---|---|---|---|---|---|---|---|
| VBmcat3<br>VBmcat4 | CCTGCACCACAA GTCATCAT<br>AATTCACCAACAA TGTCAAAGC | 140 | + | + | − | − | − | − |
| VBmcat5<br>VBmcat6 | AATGATAACCAGTC AAGCAAGC<br>GGTGCATGGTG ATTTGTAAAA | 219 | + | + | − | − | − | − |
| VBmcat7<br>VBmcat8 | GTGTGCGTTCAC TTTTACAAAT<br>GGTGTTAAGCTG ATGATGAGAG | 160 | + | + | − | − | − | − |
| VBmcat9<br>VBmcat10 | TGACCATGCACA CCCTTATT<br>TCATTGGGATGA AAGTATCGTT | 167 | + | + | − | − | − | − |

| Primer | *Moraxella phenylpyruvica* | *Kingella indologenes* | *Kingella kingea* | *Neisseria meningitidis* | *Neisseria gonorrhoeae* | *Escherichia coli* | *Staphylococcus aureus* |
|---|---|---|---|---|---|---|---|
| SEQ ID NO: 118<br>SEQ ID NO: 119 | − | − | − | − | − | − | − |
| VBmcat1<br>VBmcat2 | − | − | − | − | − | − | − |
| VBmcat3<br>VBmcat4 | − | − | − | − | − | − | − |
| VBmcat5<br>VBmcat6 | − | − | − | − | − | − | − |
| VBmcat7<br>VBmcat8 | − | − | − | − | − | − | − |
| VBmcat9<br>VBmcat10 | − | − | − | − | − | − | − |

[1]SEQ ID NO. from U.S. Pat. No. 6,001,564.

[2]All PCR assays were performed with 1 ng of purified genomic DNA by using an annealing temperature of 55° C. and 30 cycles of amplification. The genomic DNA from the various bacterial species above was always isolated from reference strains obtained from ATCC.

[3]All positive results showed a strong amplification signal with genomic DNA from the target species *M. catarrhalis*.

TABLE 22

Selection of *S. epidermidis*-specific primer pairs from SEQ ID NO: 36[1] (705 pb DNA fragment) other than those previously tested.

| Primer | Sequence (all 25 nucleotides) | Amplicon size (bp) | *Staphylococcus epidermidis*, ATCC 14990 | *Staphylococcus epidermidis*, ATCC 12228 | *Staphylococcus capitis* | *Staphylococcus cohnii* | *Staphylococcus aureus* | *Staphylococcus auricularis* | *Staphylococcus* | *Staphylococcus hominis* | *Staphylococcus* | *Staphylococcus* |
|---|---|---|---|---|---|---|---|---|---|---|---|---|
| SEQ ID NO: 145<br>SEQ ID NO: 146 | ATCAAAAA GTTGGCGA ACCTTTT CA<br>CAAAAGAG CGTGGAGA AAAGTAT CA | 125 | +[3] | + | − | − | − | − | − | − | − | − |
| VBsep3 | CATAGTCT GATTGCTC AAAGTCT TG | 208 | + | + | − | − | − | − | + | − | − | − |

TABLE 22-continued

Selection of *S. epidermidis*-specific primer pairs from SEQ ID NO: 36[1] (705 pb DNA fragment) other than those previously tested.

| | | | | | | | | | | | | |
|---|---|---|---|---|---|---|---|---|---|---|---|---|
| VBsep4 | GCGAATA GTGAACTA CATTCTGT TG | | + | + | – | – | – | – | – | – | – | – |
| VBsep5 | CACGCTC TTTTGCAA TTTCCATT GA | 208 | + | + | + | + | + | – | + | + | – | – |
| VBsep6 | GAAGCAAA TATTCAAA ATGCACC AG | | + | + | + | + | + | – | + | + | – | – |
| VBsep7 | AAAGTCTT TTGCTTCT TCAGATT CA | 177 | + | + | – | – | – | – | + | – | – | – |
| VBsep8 | GTGTTCAC AGGTATGG ATGCTCT TA | | + | + | NT | NT | – | NT | – | NT | – | – |
| | | | + | + | NT | NT | – | NT | – | NT | – | – |
| VBsep9 | GAGCATC CATACCTG TGAACACA GA | 153 | + | + | – | – | – | – | + | – | + | + |
| VBsep10 | TTTTCCA ATTACAAG AGACATCA GT | | + | + | NT | NT | – | NT | + | NT | + | – |
| | | | + | + | NT | NT | – | NT | – | NT | – | – |
| VBsep11 | TTTGAATT CGCATGTA CTTTGTT TG | 135 | + | + | – | – | – | – | – | – | – | – |
| VBsep12 | CCCCGGG TTCGAAAT CGATAAAA AG | | | | | | | | | | | |

| Primer | *Staphylococcus simulans* | *Staphylococcus warneri* | *Bacillus subtilis* | *Enterococcus faecalis* | *Enterococcus faecium* | *Enterococcus gallinarum* | *Listeria monocytogenes* | *Streptococcus agalactiae* | *Streptococcus pneumoniae* | *Streptococcus pyogenes* | Annealing temperature[2] (° C.) |
|---|---|---|---|---|---|---|---|---|---|---|---|
| SEQ ID NO: 145 SEQ ID NO: 146 | – | – | – | – | – | – | – | – | – | – | 55 |
| VBsep3 | – | – | – | – | – | – | – | – | – | – | 55 |
| VBsep4 | – | – | – | – | – | – | – | – | – | – | 60 |
| VBsep5 | – | – | – | – | – | – | – | – | – | – | 55 |
| VBsep6 | – | NT | NT | NT | NT | NT | NT | NT | NT | NT | 65 |
| VBsep7 | + | – | – | – | – | – | – | – | – | – | 55 |
| VBsep8 | + | NT | NT | NT | NT | NT | NT | NT | NT | NT | 60 |
| | – | NT | NT | NT | NT | NT | NT | NT | NT | NT | 65 |
| VBsep9 | – | – | – | – | – | – | – | – | – | – | 55 |
| VBsep10 | – | NT | NT | NT | NT | NT | NT | NT | NT | NT | 60 |
| | – | NT | NT | NT | NT | NT | NT | NT | NT | NT | 65 |
| VBsep11 VBsep12 | – | – | – | – | – | – | – | – | – | – | 55 |

[1]SEQ ID NO. from U.S. Pat. No. 6,001,564.

[2]All PCR assays were performed with 1 ng of purified genomic DNA by using an annealing temperature of 55 to 65° C. and 30 cycles of amplification. The genomic DNA from the various bacterial species above was always isolated from reference strains obtained from ATCC.

[3]All positive results showed a strong amplification signal with genomic DNA from the target species S. epidermidis. The instensity of the positive amplification signal with species other than *S. epidermidis* was variable.

NT = NOT TESTED.

TABLE 23

Influence of nucleotide variation(s) on the efficiency of the PCR amplification: Example with SEQ ID NO: 146 from *S. epidermidis.*

| | | | *Staphyloccus epidermidis*[2] ATCC 14990 | | | | *Staphylococcus aureus*[3] |
|---|---|---|---|---|---|---|---|
| | | Number of | 50° C. | 55° C. | | | 50° C. |
| Primer[1] | Sequence (all 25 nucleotides) | mutation | 1 | 1 | 0.1 | 0.01 | 1 |
| SEQ ID NO: 145 | ATCAAAAAGTTGGCGAACCTTTTCA | 0 | | | | | |
| SEQ ID NO: 146 | CAAAAGAGCGTGGAGAAAAGTATCA | 0 | 3+[4] | 3+ | 2+ | + | – |
| VBmut1 | CAAAAGAGCGTGGAGAAAAGTACCA | 1 | 3+ | 3+ | 2+ | + | – |
| VBmut2 | CAAAAGAGCGTGGAGAAAAATATCA | 1 | 3+ | 3+ | 2+ | + | – |
| VBmut3 | CAAAAGAGCGTGGAGAGAAGTATCA | 1 | 3+ | 3+ | 2+ | + | – |
| VBmut4 | CAAAAGAGCGTGGTGAAAAGTATCA | 1 | 3+ | 3+ | 2+ | + | – |
| VBmut5 | CAAAAGAGCGCGGAGAAAAGTATCA | 1 | 3+ | 3+ | 2+ | + | – |
| VBmut6 | CAAAAGAACGTGGAGAAAAGTATCA | 1 | 3+ | 3+ | 2+ | + | – |
| VBmut7 | CAAAGGAGCGTGGAGAAAAGTATCA | 1 | 3+ | 3+ | 2+ | + | – |
| VBmut8 | CTAAAGAGCGTGGAGAAAAGTATCA | 1 | 3+ | 3+ | 2+ | + | – |
| VBmut9 | CAAAAGAGCGTGGAGAGAAGTACCA | 2 | 3+ | 3+ | 2+ | + | – |
| VBmut10 | CAAAAGAGCGCGGAGAGAAGTATCA | 2 | 3+ | 3+ | 2+ | + | – |
| VBmut11 | CAAAGGAGCGCGGAGAAAAGTATCA | 2 | 3+ | 3+ | 2+ | + | – |
| VBmut12 | CAAAGGAGCGTGGTGAAAAGTACCA | 3 | 3+ | 3+ | 2+ | + | – |
| VBmut13 | CAAAGGAGCGCGGAGAGAAGTACCA | 4 | 3+ | 2+ | + | – | – |

[1]All PCR tests were performed with SEQ ID NO: 145 without modification combined with SEQ ID NO: 146 or 13 modified versions of SEQ ID NO: 146. Boxed nucleotides indicate changes in SEQ ID NO: 146. All SEQ ID NOs. are from U.S. Pat. No. 6,001,564.

[2]The tests with *S. epidermidis* were performed by using an annealing temperature of 55° C. with 1, 0.1 and 0.01 ng of purified genomic DNA or at 50° C. with 1 ng of purified genomic DNA.

[3]The tests with *S. aureus* were performed only at 50° C. with 1 ng of genomic DNA.

[4]The intensity of the positive amplification signal was quantified as follows: 3+ = strong signal, 2+ = intermediate signal and + = weak signal.

TABLE 24

Effect of the primer length on the efficiency of the PCR amplification[1]: Example with the AT-rich SEQ ID NO: 145[2] and SEQ ID NO: 146[2] from *S. epidermidis.*

| | | | Staphylococcus epidermidis[3] ATCC 14990 | | | | | | *Staphylococcus* | | *Staphylococcus* | | *Staphylococcus* | | *Staphylococcus* | |
|---|---|---|---|---|---|---|---|---|---|---|---|---|---|---|---|---|
| | | Length | 45° C. | | | 55° C. | | | *aureus*[4] | | *haemolyticus* | | *capitis* | | *warneri* | |
| Primer | Sequence | (nt) | 1 | 0.1 | 0.01 | 1 | 0.1 | 0.01 | 45 | 55 | 45 | 55 | 45 | 55 | 45 | 55 |
| VBsep301<br>VBsep302 | ATATCATCAAAAAGTTG GCGAACCTTTTCA<br>AATTGCAAAAGAGCGTGG AGAAAAGTATCA | 30<br>30 | NT | NT | NT | 4+ | 3+ | 2+ | NT | – | NT | – | NT | – | NT | – |
| SEQ ID NO: 145<br>SEQ ID NO: 146 | ATCAAAAAGTTGGCGA ACCTTTTCA<br>CAAAAGAGCGTGGA GAAAAGTATCA | 25<br>25 | 4+[5] | 3+ | 2+ | 4+ | 3+ | 2+ | – | – | – | – | + | – | – | – |
| VBsep201<br>VBsep202 | AAAGTTGGCGAACCTTTTCA<br>GAGCGTGGAGAAAAGTATCA | 20<br>20 | NT | NT | NT | 4+ | 3+ | 2+ | NT | – | NT | – | NT | – | NT | – |

TABLE 24-continued

Effect of the primer length on the efficiency of the PCR amplification[1]: Example with the AT-rich SEQ ID NO: 145[2] and SEQ ID NO: 146[2] from *S. epidermidis*.

| | | | *Staphylococcus epidermidis*[3] ATCC 14990 | | | | | | *Staphylococcus aureus*[4] | | *Staphylococcus haemolyticus* | | *Staphylococcus capitis* | | *Staphylococcus warneri* | |
|---|---|---|---|---|---|---|---|---|---|---|---|---|---|---|---|---|
| | | Length | 45° C. | | | 55° C. | | | | | | | | | | |
| Primer | Sequence | (nt) | 1 | 0.1 | 0.01 | 1 | 0.1 | 0.01 | 45 | 55 | 45 | 55 | 45 | 55 | 45 | 55 |
| VBsep171 | GTTGGCGAACCTTTTCA | 17 | 4+ | 3+ | 2+ | 3+ | 2+ | + | – | – | – | – | – | – | – | – |
| VBsep172 | CGTGGAGAAAAGTATCA | 17 | | | | | | | | | | | | | | |
| VBsep151 | TGGCGAACCTTTTCA | 15 | 3+ | 2+ | + | – | – | – | – | – | – | – | – | – | – | – |
| VBsep152 | TGGAGAAAAGTATCA | 15 | | | | | | | | | | | | | | |

[1]All PCR tests were performed using an annealing temperature of 45 or 55° C. and 30 cycles of amplification.
[2]All SEQ ID NOs. in this Table are from U.S. Pat. No. 6,001,546.
[3]The tests with *S. epidermidis* were made with 1, 0.1 and 0.01 ng of purified genomic DNA.
[4]The tests with all other bacterial species were made only with 1 ng of purified genomic DNA.
[5]The intensity of the positive amplification signal was quantified as follows: 4+ = very strong signal, 3+ = strong signal, 2+ = intermediate signal and + = weak signal.
NT = not tested.

TABLE 25

Effect of the primer length on the efficiency of the PCR amplification[1]: Example with the GC-rich SEQ ID NO: 83[2] and SEQ ID NO: 84[2] from *P. aeruginosa*.

| | | Length | *Pseudomonas aeruginosa*[3] ATCC 35554 | | | *Pseudomonas* | *Burkholderia* | *Shewanella* | *Stenotrophomonas* | *Neisseria* | *Haemophilus parahae-* |
|---|---|---|---|---|---|---|---|---|---|---|---|
| Primer | Sequence | (nt) | 1 | 0.1 | 0.01 | *fluorescens*[4] | *cepacia* | *putida* | *maltophilia* | *meningitidis* | *molyticus* |
| SEQ ID NO 83 | CGAGCGGGTGGTGTTCATC | 19 | 2+[5] | + | – | – | – | – | – | – | – |
| SEQ ID NO 84 | CAAGTCGTCGTCGGAGGGA | 19 | | | | | | | | | |
| Pse554-16a | CGAGCGGGTGGTGTTC | 16 | 2+ | + | – | – | – | – | – | – | – |
| Pse674-16a | GTCGTCGTCGGAGGGA | 16 | | | | | | | | | |
| Pse554-13b | GCGGGTGGTGTTC | 13 | 2+ | + | – | – | – | – | – | – | – |
| Pse674-13a | GTCGTCGGAGGGA | 13 | | | | | | | | | |

[1]All PCR tests were performed using an annealing temperature of 55° C. and 30 cycles of amplification.
[2]All SEQ ID NOs. in this Table are from U.S. Pat. No. 6,001,546.
[3]The tests with *P. aeruginosa* were made with 1, 0.1 and 0.01 ng of purified genomic DNA.
[4]The tests with all other bacterial species were made only with 1 ng of purified genomic DNA.
[5]The intensity of the positive amplification signal was quantified as follows: 2+ = strong signal and + = moderately strong signal.

TABLE 26

Sequences used for the consensus of the vanA gene

| Organism | GenBank access number | Source |
|---|---|---|
| *E. faecium* | M97297 | |
| *E. faecium* | AX111560 | Sequence 2293 of patent WO0123604 |
| *E. faecium* | AX085668 | Sequence 21 of patent WO0112803 |
| *E. faecium* | AX085648 | Sequence 1 of patent WO0112803 |
| *E. faecium* | AX110408 | Sequence 1141 of patent WO0123604 |
| *E. faecium* | AX110406 | Sequence 1139 of patent WO0123604 |
| *E. faecium* | AX110320 | Sequence 1053 of patent WO0123604. |
| *E. faecium* | AX110319 | Sequence 1052 of patent WO0123604 |
| *E. faecium* | AX110318 | Sequence 1051 of patent WO0123604 |
| *E. faecium* | AX110316 | Sequence 1049 of patent WO0123604 |
| *E. faecalis* | AX110321 | Sequence 1054 of patent WO0123604 |
| *E. gallinarum* | AX110317 | Sequence 1050 of patent WO0123604 |
| *E. gallinarum* | AX110322 | Sequence 1055 of patent WO0123604. |
| *E. flavescens* | AX110324 | Sequence 1057 of patent WO0123604. |
| *S. aureus* (VRSA) | AE017171.1 | Direct deposit to NCBI |

TABLE 27

Sequences used for the consensus of vanB gene

| Organism | GenBank access number | Source |
|---|---|---|
| *E. faecium* SLH475 | AF310954.1 | Tn5382 transposon ligase VanB2 (vanB2) gene |
| *E. faecium* UI709 | AY145441.1 | D-alanine:D-lactate ligase (vanB2) |
| *E. faecium* VRE-1 | AF310953.1 | Tn5382 ligase VanB2 (vanB2) gene |
| *E. faecium* | U94526.1 | vancomycin resistance protein B (vanB) gene, |
| *E. faecium* | AJ306727.1 | plasmid pVREM3123/00 partial vanHB gene and partial vanB2 gene |
| *E. faecium* | AJ306726.1 | plasmid pVREM2497/00 partial vanHB gene and partial vanB2 gene |
| *E. faecium* | Z83305.1 | vanB2, vanHB2 and vanXB2 genes |
| *E. faecium* | Z83305.1 | vanB2, vanHB2 and vanXB2 genes |
| *E. faecium* CG4248 | AF310957.1 | transposon Tn5382 ligase VanB2 (vanB2) gene, |
| *E. faecalis* | L15304.1 | vancomycin resistance vanB2 gene |
| *E. faecalis* | U35369.1 | vancomycin resistance genes, response regulator (vanRB), protein histidine kinase (vanSB), D,D-carboxypeptidase (vanYB), putative D-2-hydroxyacid dehydrogenase (vanHB), D-Ala:D-Lac ligase (vanB), and putative D,D-dipeptidase (vanXB) genes |
| *E. faecalis* | U00456.1 | vanB gene |
| *E. faecalis* | L06138.1 | VANB gene |
| *E. faecalis* | U72704.1 | vancomycin resistance protein (vanB) gene |
| *E. faecalis* T4059 | AF310955.1 | transposon Tn5382 ligase VanB2 (vanB2) gene |
| *E. faecalis* | L15304.1 | vancomycin resistance vanB2 gene |
| *E. faecalis* T4059 | AF310955.1 | transposon Tn5382 ligase VanB2 (vanB2) gene |
| *E. faecalis* | AF192329.1 | transposon Tn1549, complete sequence |
| *S. bovis* biotype II | Z70527.1 | partial vanB2 gene |
| *S. lutetiensis* strain 5-F9 | AY035703.1 | Tn5382-like transposon ligase VanB2 (vanB2) gene |

*Deposited directly to NCBI

TABLE 28

Number of positive assay results out of five in VanR Assay.

| DNA copies number | *E. faecium* | *E. faecalis* |
|---|---|---|
| 0.5 | 2 | 2 |
| 2.5 | 5 | 3 |
| 5 | 5 | 4 |
| 10 | 5 | 5 |
| 20 | 5 | 5 |

TABLE 29

First list of exemplary strains tested with VanR assay.

| No | Strains | ATCC or Ref. number |
|---|---|---|
| 1 | *Enterococcus casseliflavus* | 25788 |
| 2 | *Enterococcus cecorum* | 43198 |
| 3 | *Enterococcus columbae* | 51263 |
| 4 | *Enterococcus malodoratus* | 43197 |
| 5 | *Enterococcus mundtii* | 43186 |
| 6 | *Enterococcus pseudoavium* | 49372 |
| 7 | *Enterococcus raffinosus* | 49427 |
| 8 | *Enterococcus dispar* | 51266 |
| 9 | *Enterococcus durans* | 19432 |
| 10 | *Enterococcus faecalis* | 19433 |
| 11 | *Enterococcus faecalis* | 29212 |
| 12 | *Enterococcus faecalis* | R830 |

TABLE 29-continued

First list of exemplary strains tested with VanR assay.

| No | Strains | ATCC or Ref. number |
|---|---|---|
| 13 | *Enterococcus faecium* | 19434 |
| 14 | *Enterococcus faecium* | N97-330 |
| 15 | *Enterococcus flavescens* | 49996 |
| 16 | *Enterococcus gallinarum* | 49573 |
| 17 | *Enterococcus saccharolyticus* | 43076 |
| 18 | *Enterococcus sulfureus* | 49903 |
| 19 | *Enterococcus faecium* (vanD) | CCRI-14889 |
| 20 | *Enterococcus faecium* (vanD) | CCRI-14889 |
| 21 | *Enterococcus faecalis* (vanE) | CCRI-1908 |
| 22 | *Enterococcus faecalis* (vanE) | CCRI-1908 |
| 23 | *Enterococcus faecalis* (vanG) | CCRI-12848 |
| 24 | *Enterococcus faecalis* (vanG) | CCRI-12848 |

TABLE 30

Second list of exemplary strains tested with VanR assay

| No | Strains | ATCC or Ref. number |
|---|---|---|
| 1 | *Acinetobacter lwoffii* | CDCF 3697 |
| 2 | *Aeromonas hydrophila* | 7966 |
| 3 | *Bacteroides fragilis* | 25285 |
| 4 | *Bacillus cereus* | 13472 |
| 5 | *Bifidobacterium breve* | 15700 |
| 6 | *Candida albicans* | 10231 |
| 7 | *Clostridium difficile* | 9689 |
| 8 | *Clostridium perfringens* | 13124 |
| 9 | *Corynebacterium bovis* | 7715 |
| 10 | *Escherichia coli* | 25922 |
| 11 | *Escherichia coli* | 23511 |
| 12 | *Fusobacterium nucleatum* | 10953 |
| 13 | *Gardnerella vaginalis* | 14019 |
| 14 | *Klebsiella oxytoca* | 33496 |
| 15 | *Klebsiella pneumoniae* | 13883 |
| 16 | *Listeria monocytogenes* | L 374 |
| 17 | *Morganella morganii* subsp. *morganii* | 25830 |
| 18 | *Peptostreptococcus anaerobius* | 27337 |
| 19 | *Peptostreptococcus asaccharolyticus* | LSPQ 2639 |
| 20 | *Porphyromonas asaccharolytica* | 25260 |
| 21 | *Prevotella melaninogenica* | 25845 |
| 22 | *Propionibacterium acnes* | 6919 |
| 23 | *Staphylococcus epidermidis* | 14990 |
| 24 | *Stenotrophomonas maltophilia* | 13637 |

TABLE 31

Third list of exemplary strains tested with VanR assay.

| No | Strains | ATCC or Ref. number |
|---|---|---|
| 1 | *Abiotrophia defectiva* | 49176 |
| 2 | *Acinetobacter baumannii* | 19606 |
| 3 | *Actinomyces pyogenes* | 19411 |
| 4 | *Citrobacter braakii* | 43162 |
| 5 | *Citrobacter koseri* | 27028 |
| 6 | *Corynebacterium genitalium* | LSPQ 3583 |
| 7 | *Enterobacter cloacae* | 13047 |
| 8 | *Hafnia alvei* | 13337 |
| 9 | *Homo sapiens* | 2.16 |
| 10 | *Lactobacillus acidophilus* | 4356 |
| 11 | *Lactobacillus gasseri* | 33323 |
| 12 | *Mobiluncus curtisii* subsp. *holmesii* | 35242 |
| 13 | *Neisseria gonorrhoeae* | 35201 |
| 14 | *Pantoea agglomerans* | 27155 |
| 15 | *Pseudomonas aeruginosa* | 35554 |
| 16 | *Salmonella enterica* subsp. *Arizonae* | 13314 |
| 17 | *Salmonella enterica* subsp. *Enterica* | 7001 |
| 18 | *Salmonella typhimurium* | 14028 |

TABLE 31-continued

| No | Strains | ATCC or Ref. number |
|---|---|---|
| | Third list of exemplary strains tested with VanR assay. | |
| 19 | *Shigella flexneri* | 12022 |
| 20 | *Shigella sonnei* | 29930 |
| 21 | *Staphylococcus aureus* | 43300 |
| 22 | *Streptococcus anginosus* | 33397 |
| 23 | *Streptococcus bovis* | 33317 |
| 24 | *Vibrio cholerae* | 25870 |
| 25 | *Yersinia enterocolitica* subs. *enterolitica* | 23715 |

TABLE 32

Vancomycin resistant strains tested with VanR assay at $10^5$ CFU/rx.

| No | Strains | Resistance gene | ATCC or Ref. number |
|---|---|---|---|
| 1-2 | *Enterococcus casseliflavus* ($10^4$ CFU/rx) | vanC2 | 25788 |
| 3-4 | *Enterococcus casseliflavus* | vanC2 | 25788 |
| 5-6 | *Enterococcus faecalis* | vanG | CCRI-12849 |
| 7-8 | *Enterococcus faecium* | vanD | R832 |
| 9-10 | *Enterococcus faecium* | vanD2 | CCRI-15140 |
| 11-12 | *Enterococcus faecium* | vanD | CCRI-2062 |
| 13-14 | *Enterococcus faecium* | vanD | CCRI-8824 |
| 15-16 | *Enterococcus gallinarum* | vanC | CCRI-9133 |
| 17-18 | *Enterococcus gallinarum* | vanC | CCRI-9131 |
| 19-20 | *Enterococcus gallinarum* | vanA and vanC1 | CCRI-1561 |

TABLE 33

Composition of premix (PM)

| COMPONENT | CONCENTRATION IN FRESHLY PREPARED MIX (28.8 µL FINAL VOLUME) | |
|---|---|---|
| FastStart Taq DNA Polymerase | 0.060 | U/µL |
| $MgCl_2$ | 3.010 | mM |
| Tris | 100.333 | mM |
| KCl | 10.033 | mM |
| $(NH_4)_2SO_4$ | 5.017 | mM |
| dNTPs | 200.667 | µM |
| Primer vanA649 (SEQ ID NO: 1090) | 0.120 | µM |
| Primer vanA754 (SEQ IDNO: 1091) | 0.101 | µM |
| Primer vanB626 (SEQ ID NO: 2298) | 0.702 | µM |
| Primer vanB774 (SEQ ID NO: 1096) | 0.702 | µM |
| Probe VanA-B5c-A0 (SEQ ID NO: 2299) | 0.120 | µM |
| Probe Van8-850-F0 (SEW ID NO: 2300) | 0.351 | µM |
| Probe Sign-B4-B0 (SEQ ID NO: 2301) | 0.201 | µM |
| pERVd Internal control (SEQ ID NO: 2302) | 3.582 | copies/µL (usual) |
| *S. epidermidis* DNA | 895.836 | copies/µL |
| BSA | 0.301 | mg/mL |
| Trehalose | 4.014% | |

*These components were added following Table 21

TABLE 34

Composition of final mix (MM)

| | n | Sign-B4 (SEQ ID NO: 2301) | VanA-B5c (SEQ ID NO: 2299) | VanB-B50 (SEQ ID NO: 2300) | IC (SEQ ID NO: 2302) | Specimen |
|---|---|---|---|---|---|---|
| MM1-a | 10 | x | | | | DNA[3] |
| MM1-b | 5 | x | | | x[1] | TE 1X |
| MM2-a | 10 | | X | | | DNA[3] |
| MM2-b | 5 | | X | | x[1] | TE 1X |
| MM3-a | 10 | | | x | | DNA[3] |

TABLE 34-continued

Composition of final mix (MM)

| | n | Sign-B4 (SEQ ID NO: 2301) | VanA-B5c (SEQ ID NO: 2299) | VanB-B50 (SEQ ID NO: 2300) | IC (SEQ ID NO: 2302) | Specimen |
|---|---|---|---|---|---|---|
| MM3-b | 5 | | | X | x[1] | TE 1X |
| MM4-std | 15 | x | X | X | x[2] | DNA[4]/ TE 1X |

[1]At 100 times the usual concentration

[2]At usual concentration

[3]At 25/50 VanA/VanB DNA copies

[4]At 1 ng/rx VanA/VanB DNA copies

TABLE 35

Positive results obtained in indicated beacon channel

| | Sign-B4 (SEQ ID NO: 2301) TET | VanA-B5 (SEQ ID NO: 2299)c FAM | VanB-B50 (SEQ IDNO: 2300) Texas Red | Target |
|---|---|---|---|---|
| MM1-a | 0/5 | — | — | Efm |
| | 0/5 | — | — | Efs |
| MM1-b | 5/5 | — | — | IC |
| MM2-a | — | 5/5 | — | Efm |
| | — | 0/5 | — | Efs |
| MM2-b | — | 0/5 | — | IC |
| MM3-a | — | — | 0/5 | Efm |
| | — | — | 5/5 | Efs |
| MM3-b | — | — | 0/5 | IC |
| MM4-std | 5/5 | 5/5 | 0/5 | Efm |
| | 5/5 | 0/5 | 5/5 | Efs |
| | 5/5 | 0/5 | 0/5 | IC |

TABLE 36

List of enterococcal strains from different locations around the world tested with VanR assay (dilutions $10^{-3}$).

| No | Strains | Reference number | Location | vanA CT | vanB CT |
|---|---|---|---|---|---|
| 1 | *Enterococcus faecalis* | CCRI-1471 | Texas, USA | 29.91 | — |
| 2 | *Enterococcus faecalis* | CCRI-1528 | Quebec, CAN | 27.05 | — |
| 3 | *Enterococcus faecalis* | CCRI-9741 | USA | — | 31.05 |
| 4 | *Enterococcus gallinarum* | CCRI-1568 | Quebec, CAN | 28.60 | — |
| 5 | *Enterococcus faecium* | CCRI-9911 | Taiwan, China | — | 31.96 |
| 6 | *Enterococcus faecalis* | 725 | Israel | — | 31.55 |
| 7 | *Enterococcus faecalis* | 1435 | Brazil | 28.28 | — |
| 8 | *Enterococcus faecium* | 6169 | Italy | 31.63 | — |
| 9 | *Enterococcus gallinarum* | CCRI-9737 | Norway | — | 29.50 |
| 10 | *Enterococcus faecalis* | CCRI-9738 | Germany | — | 31.35 |
| 11 | *Enterococcus faecium* | CCRI-9740 | Germany | — | 29.41 |
| 12 | *Enterococcus faecalis* | 13024 | Germany | 27.49 | — |
| 13 | *Enterococcus faecalis* | CCRI-9739 | Germany | — | 31.00 |
| 14 | *Enterococcus faecium* | CCRI-9733 | USA | — | 31.93 |
| 15 | *Enterococcus faecium* | 1585 | Argentina | 29.00 | — |
| 16 | *Enterococcus faecium* | 715 | Sweden | — | 30.87 |
| 17 | *Enterococcus faecalis* | CCRI-9954 | Netherlands | — | 31.83 |
| 18 | *Enterococcus faecium* | CCRI-1482 | Toronto, CAN | 29.40 | — |

*All strains gave vanA or vanB positive PCR results.

TABLE 37

| List of resistant non enterococcal strains (vanB genotype) tested with VanR assay. | | | |
|---|---|---|---|
| No | Strains | Reference number | Texas Red CT (cycles) |
| 1 | *Clostridium innocuum* | CCRI-9927 | 29.6 |
| 2 | *Clostridium* sp. | IDI-1987 | 31.9 |
| 3 | *Clostridium* sp. | CCRI-9929 | 32.5 |
| 4 | *Clostridium symbosium* | CCRI-9928 | 31.6 |
| 5 | *Eggerthella lenta* | CCRI-9926 | 32.4 |

*All strains gave vanB positive PCR results.

TABLE 38

| VanR Assay Formulation | | |
|---|---|---|
| Raw Material | Concentration of components at final volume (28 μL) Lyophilized | Concentration of components at final volume (28.8 μL) Fresh |
| FastStart Taq DNA Polymerase | 0..060 U/μL[1] | 0.060 U/μL[1] |
| $MgCl_2$ | 3.000 mM[2] | 3.010 mM[2] |
| Tris | 100.000 mM (pH 8.3)[2] | 100.333 mM (pH 8.3)[2] |
| KCl | 10.000 mM[2] | 10.033 mM[2] |
| $(NH_4)_2SO_4$ | 5.000 mM[2] | 5.017 mM[2] |
| dNTP | 200.000 μM | 200.667 μM |
| Primer VanA 649 (SEQ ID NO: 1090) | 0.120 μM | 0.120 μM |
| Primer Van A 754 (SEQ ID NO: 1091) | 0.100 μM | 0.101 μM |
| Primer Van B 626 (SEQ ID NO: 2298) | 0.700 μM | 0.702 μM |
| Primer van B 774 (SEQ ID NO: 1096) | 0.700 μM | 0.702 μM |
| Probe VanA-B5c-A0 (SEQ ID NO: 2299) | 0.120 μM | 0.120 μM |
| Probe VanB-B50-F0 (SEQ ID NO: 2300) | 0.350 μM | 0.351 μM |
| Probe Sign-B4-B0 (SEQ ID NO: 2301) | 0.200 μM | 0.201 μM |
| Internal control pERVd (SEQ ID NO: 2302) | 3.570 copies/μL | 3.582 copies/μL |
| *S. epidermidis* DNA | 892.857 copies/μL[3] | 895.836 copies/μL[3] |
| BSA | 0.300 mg/mL | 0.301 mg/mL |
| Trehalose | 4.000% | 4.014% |

| Annex I: Specific and ubiquitous primers for nucleic acid amplification (tuf sequences). | | | |
|---|---|---|---|
| | | Originating DNA fragment | |
| SEQ ID NO. | Nucleotide sequence | SEQ ID NO. | Nucleotide position |
| | Bacterial species: *Acinetobacter baumannii* | | |
| 1692 | 5'-GGT GAG AAC TGT GGT ATC TTA CTT | 1 | 478-501 |
| 1693[a] | 5'-CAT TTC AAC GCC TTC TTT CAA CTG | 1 | 691-714 |
| | Bacterial species: *Chlamydia pneumoniae* | | |
| 630 | 5'-CGG AGC TAT CCT AGT CGT TTC A | 20 | 2-23 |
| 629[a] | 5'-AAG TTC CAT CTC AAC AAG GTC AAT A | 20 | 146-170 |
| 2085 | 5'-CAA ACT AAA GAA CAT ATC TTG CTA | 20 | 45-68 |
| 2086[a] | 5'-ATA TAA TTT GCA TCA CCT TCA AG | 20 | 237-259 |
| 2087 | 5'-TCA GCT CGT GGG ATT AGG AGA G | 20 | 431-452 |
| 2088[a] | 5'-AGG CTT CAC GCT GTT AGG CTG A | 20 | 584-605 |
| | Bacterial species: *Chlamydia trachomatis* | | |
| 554 | 5'-GTT CCT TAC ATC GTT GTT TTT CTC | 22 | 82-105 |
| 555[a] | 5'-TCT CGA ACT TTC TCT ATG TAT GCA | 22 | 249-272 |
| | Parasitical species: *Cryptosporidium parvum* | | |
| 798 | 5'-TGG TTG TCC CAG CCG ATC GTT T | 865 | 158-179 |
| 804[a] | 5'-CCT GGG ACG GCC TCT GGC AT | 865 | 664-683 |
| 799 | 5'-ACC TGT GAA TAC AAG CAA TCT | 865 | 280-300 |
| 805[a] | 5'-CTC TTG TCC ATC TTA GCA GT | 865 | 895-914 |
| 800 | 5'-GAT GAA ATC TTC AAC GAA GTT GAT | 865 | 307-330 |

-continued

| | | | |
|---|---|---|---|
| 806[a] | 5'-AGC ATC ACC AGA CTT GAT AAG | 865 | 946-966 |
| 801 | 5'-ACA ACA CCG AGA AGA TCC CA | 865 | 353-372 |
| 803[a] | 5'-ACT TCA GTG GTA ACA CCA GC | 865 | 616-635 |
| 802 | 5'-TTG CCA TTT CTG GTT TCG TT | 865 | 377-396 |
| 807[a] | 5'-AAA GTG GCT TCA AAG GTT GC | 865 | 981-1000 |

Bacterial species: *Enterococcus faecium*

| | | | |
|---|---|---|---|
| 1696 | 5'-ATG TTC CTG TAG TTG CTG GA | 64 | 189-208 |
| 1697[a] | 5'-TTT CTT CAG CAA TAC CAA CAA C | 64 | 422-443 |

Bacterial species: *Klebsiella pneumoniae*

| | | | |
|---|---|---|---|
| 1329 | 5'-TGT AGA GCG CGG TAT CAT CAA AGT A | 103 | 352-377 |
| 1330[a] | 5'-AGA TTC GAA CTT GGT GTG CGG G | 103 | 559-571 |

[a]These sequences are from the complementary DNA strand of the sequence of the originating fragment given in the Sequence Listing.

Bacterial species: *Mycoplasma pneumoniae*

| | | | |
|---|---|---|---|
| 2093 | 5'-TGT TGG CAA TCG AAG ACA CC | 2097[a] | 635-654 |
| 2094[b] | 5'-TTC AAT TTC TTG ACC TAC TTT CAA | 2097[a] | 709-732 |

Bacterial species: *Neisseria gonorrhoeae*

| | | | |
|---|---|---|---|
| 551 | 5'-GAA GAA AAA ATC TTC GAA CTG GCT A | 126 | 256-280 |
| 552[b] | 5'-TAC ACG GCC GGT GAC TAC G | 126 | 378-396 |
| 2173 | 5'-AAG AAA AAA TCT TCG AAC TGG CTA | 126 | 257-280 |
| 2174[b] | 5'-TCT ACA CGG CCG GTG | 126 | 384-398 |
| 2175 | 5'-CCG CCA TAC CCC GTT T | 126 | 654-669 |
| 2176[b] | 5'-CGG CAT TAC CAT TTC CAC ACC TTT | 126 | 736-759 |

Bacterial species: *Pseudomonas aeruginosa*

| | | | |
|---|---|---|---|
| 1694 | 5'-AAG GCA AGG ATG ACA ACG GC | 153 | 231-250 |
| 1695[b] | 5'-ACG ATT TCC ACT TCT TCC TGG | 153 | 418-438 |

Bacterial species: *Streptococcus agalactiae*

| | | | |
|---|---|---|---|
| 549 | 5'-GAA CGT GAT ACT GAC AAA CCT TTA | 207-210[c] | 308-331[d] |
| 550[b] | 5'-GAA GAA GAA CAC CAA CGT TG | 207-210[c] | 520-539[d] |

Bacterial species: *Streptococcus pyogenes*

| | | | |
|---|---|---|---|
| 999 | 5'-TTG ACC TTG TTG ATG ACG AAG AG | 1002 | 143-165 |
| 1000[b] | 5'-TTA GTG TGT GGG TTG ATT GAA CT | 1002 | 622-644 |
| 1001 | 5'-AAG AGT TGC TTG AAT TAG TTG AG | 1002 | 161-183 |
| 1000[b] | 5'-TTA GTG TGT GGG TTG ATT GAA CT | 1002 | 622-644 |

Parasitical species: *Trypanosoma brucei*

| | | | |
|---|---|---|---|
| 820 | 5'-GAA GGA GGT GTC TGC TTA CAC | 864 | 513-533 |
| 821[b] | 5'-GGC GCA AAC GTC ACC ACA TCA | 864 | 789-809 |

-continued

| | | | |
|---|---|---|---|
| 820 | 5'-GAA GGA GGT GTC TGC TTA CAC | 864 | 513-533 |
| 822[b] | 5'-CGG CGG ATG TCC TTA ACA GAA | 864 | 909-929 |

[a]Sequence from databases.
[b]These sequences are from the complementary DNA strand of the sequence of the originating fragment given in the Sequence Listing.
[c]These sequences were aligned to derive the corresponding primer.
[d]The nucleotide positions refer to the *S. agalactiae* tuf sequence fragment (SEQ ID NO. 209).

Parasitical species: *Trypanosoma cruzi*

| | | | |
|---|---|---|---|
| 794 | 5'-GAC GAC AAG TCG GTG AAC TT | 840-842[a] | 281-300[c] |
| 795[b] | 5'-ACT TGC ACG CGA TGT GGC AG | 840-842[a] | 874-893[c] |

Bacterial genus: *Clostridium* sp.

| | | | |
|---|---|---|---|
| 796 | 5'-GGT CCA ATG CCW CAA ACW AGA | 32, 719-724, 736[a] | 32-52[d] |
| 797[b] | 5'-CAT TAA GAA TGG YTT ATC TGT SKC TCT | 32, 719-724, 736[a] | 320-346[d] |
| 808 | 5'-GCI TTA IWR GCA TTA GAA RAY CCA | 32, 719-724, 736[a] | 224-247[d] |
| 809[b] | 5'-TCT TCC TGT WGC AAC TGT TCC TCT | 32, 719-724, 736[a] | 337-360[d] |
| 810 | 5'-AGA GMW ACA GAT AAR SCA TTC TTA | 32, 719-724, 736[a] | 320-343[d] |
| 811[b] | 5'-TRA ART AGA ATT GTG GTC TRT ATC C | 32, 719-724, 736[a] | 686-710[d] |

Bacterial genus: *Corynebacterium* sp.

| | | | |
|---|---|---|---|
| 545 | 5'-TAC ATC CTB GTY GCI CTI AAC AAG TG | 34-44, 662[a] | 89-114[e] |
| 546[b] | 5'-CCR CGI CCG GTR ATG GTG AAG AT | 34-44, 662[a] | 350-372[e] |

Bacterial genus: *Enterococcus* sp.

| | | | |
|---|---|---|---|
| 656 | 5'-AAT TAA TGG CTG CAG TTG AYG A | 58-72[a] | 273-294[f] |
| 657[b] | 5'-TTG TCC ACG TTC GAT RTC TTC A | 58-72[a] | 556-577[f] |
| 656 | 5'-AAT TAA TGG CTG CAG TTG AYG A | 58-72[a] | 273-294[f] |
| 271[b] | 5'-TTG TCC ACG TTG GAT RTC TTC A | 58-72[a] | 556-577[f] |
| 1137 | 5'-AAT TAA TGG CTG CWG TTG AYG AA | 58-72[a] | 273-295[f] |
| 1136[b] | 5'-ACT TGT CCA CGT TSG ATR TCT | 58-72[a] | 559-579[f] |

[a]These sequences were aligned to derive the corresponding primer.
[b]These sequences are from the complementary DNA strand of the sequence of the originating fragment given in the Sequence Listing.
[c]The nucleotide positions refer to the *T. cruzi* tuf sequence fragment (SEQ ID NO. 842).
[d]The nucleotide positions refer to the *C. perfringens* tuf sequence fragment (SEQ ID NO. 32).
[e]The nucleotide positions refer to the *C. diphtheriae* tuf sequence fragment (SEQ ID NO. 662).
[f]The nucleotide positions refer to the *E. durans* tuf sequence fragment (SEQ ID NO. 61).

Bacterial genus: *Legionella* sp.

| | | | |
|---|---|---|---|
| 2081 | 5'-GRA TYR TYA AAG TTG GTG AGG AAG | 111-112[a] | 411-434[b] |
| 2082[c] | 5'-CMA CTT CAT CYC GCT TCG TAC C | 111-112[a] | 548-569[b] |

Bacterial genus: *Staphylococcus* sp.

| | | | |
|---|---|---|---|
| 553 | 5'-GGC CGT GTT GAA CGT GGT CAA ATC A | 176-203[a] | 313-337[d] |
| 575[c] | 5'-TIA CCA TTT CAG TAC CTT CTG GTA A | 176-203[a] | 653-677[d] |

-continued

| | | | |
|---|---|---|---|
| 553 | 5'-GGC CGT GTT GAA CGT GGT CAA ATC A | 176-203[a] | 313-337[d] |
| 707[c] | 5'-TWA CCA TTT CAG TAC CTT CTG GTA A | 176-203[a] | 653-677[d] |
| | Bacterial genus: *Streptococcus* sp. | | |
| 547 | 5'-GTA CAG TTG CTT CAG GAC GTA TC | 206-231[a] | 372-394[e] |
| 548[c] | 5'-ACG TTC GAT TTC ATC ACG TTG | 206-231[a] | 548-568[e] |
| | Fungal genus: *Candida* sp. | | |
| 576 | 5'-AAC TTC RTC AAG AAG GTY GGT TAC AA | 407-426, 428-432[a] | 332-357[f] |
| 632[c] | 5'-CCC TTT GGT GGR TCS TKC TTG GA | 407-426, 428-432[a] | 791-813[f] |
| 631 | 5'-CAG ACC AAC YGA IAA RCC ATT RAG AT | 407-426, 428-432[a] | 523-548[f] |
| 632[c] | 5'-CCC TTT GGT GGR TCS TKC TTG GA | 407-426, 428-432[a] | 791-813[f] |
| 633 | 5'-CAG ACC AAC YGA IAA RCC ITT RAG AT | 407-426, 428-432[a] | 523-548[f] |
| 632[c] | 5'-CCC TTT GGT GGR TCS TKC TTG GA | 407-426, 428-432[a] | 791-813[f] |

[a]These sequences were aligned to derive the corresponding primer.
[b]The nucleotide positions refer to the *L. pneumophila* tuf sequence fragment (SEQ ID NO. 112).
[c]These sequences are from the complementary DNA strand of the sequence of the originating fragment given in the Sequence Listing.
[d]The nucleotide positions refer to the *S. aureus* tuf sequence fragment (SEQ ID NO. 179).
[e]The nucleotide positions refer to the *S. agalactiae* tuf sequence fragment (SEQ ID NO. 209).
[f]The nucleotide positions refer to the *C. albicans* tuf(EF-1) sequence fragment (SEQ ID NO. 408).

| | | | |
|---|---|---|---|
| | Fungal genus: *Cryptococcus* sp. | | |
| 1971 | 5'-CYG ACT GYG CCA TCC TYA TCA | 434, 623, 1281, 1985, 1986[a] | 150-170[b] |
| 1973[c] | 5'-RAC ACC RGI YTT GGW ITC CTT | 434, 623, 1281, 1985, 1986[a] | 464-484[b] |
| 1972 | 5'-MGI CAG CTC ATY ITT GCW KSC | 434, 623, 1281, 1985, 1986[a] | 260-280[b] |
| 1973[c] | 5'-RAC ACC RGI YTT GGW ITC CTT | 434, 623, 1281, 1985, 1986[a] | 464-484[b] |
| | Parasitical genus: *Entamoeba* sp. | | |
| 703 | 5'-TAT GGA AAT TCG AAA CAT CT | 512 | 38-57 |
| 704[c] | 5'-AGT GCT CCA ATT AAT GTT GG | 512 | 442-461 |
| 703 | 5'-TAT GGA AAT TCG AAA CAT CT | 512 | 38-57 |
| 705[c] | 5'-GTA CAG TTC CAA TAC CTG AA | 512 | 534-553 |
| 703 | 5'-TAT GGA AAT TCG AAA CAT CT | 512 | 38-57 |
| 706[c] | 5'-TGA AAT CTT CAC ATC CAA CA | 512 | 768-787 |
| 793 | 5'-TTA TTG TTG CTG CTG GTA CT | 512 | 149-168 |
| 704[c] | 5'-AGT GCT CCA ATT AAT GTT GG | 512 | 442-461 |
| | Parasitical genus: *Giardia* sp. | | |
| 816 | 5'-GCT ACG ACG AGA TCA AGG GC | 513 | 305-324 |
| 819[c] | 5'-TCG AGC TTC TGG AGG AAG AG | 513 | 895-914 |

-continued

| | | | |
|---|---|---|---|
| 817 | 5'-TGG AAG AAG GCC GAG GAG TT | 513 | 355-374 |
| 818[c] | 5'-AGC CGG GCT GGA TCT TCT TC | 513 | 825-844 |

Parasitical genus: *Leishmania* sp.

| | | | |
|---|---|---|---|
| 701 | 5'-GTG TTC ACG ATC ATC GAT GCG | 514-526[a] | 94-114[d] |
| 702[c] | 5'-CTC TCG ATA TCC GCG AAG CG | 514-526[a] | 913-932[d] |

[a]These sequences were aligned to derive the corresponding primer.
[b]The nucleotide positions refer to the *C. neoformans* tuf (EF-1) sequence fragment (SEQ ID NO. 623).
[c]These sequences are from the complementary DNA strand of the sequence of the originating fragment given in the Sequence Listing.
[d]The nucleotide positions refer to the *L. tropica* tuf(EF-1) sequence fragment (SEQ ID NO. 526).

Parasitical genus: *Trypanosoma* sp.

| | | | |
|---|---|---|---|
| 823 | 5'-GAG CGG TAT GAY GAG ATT GT | 529, 840-842, 864[a] | 493-512[b] |
| 824[c] | 5'-GGC TTC TGC GGC ACC ATG CG | 529, 840-842, 864[a] | 1171-1190[b] |

Bacterial family: Enterobacteriaceae

| | | | |
|---|---|---|---|
| 933 | 5'-CAT CAT CGT ITT CMT GAA CAA RTG | 78, 103, 146, 168, 238, 698[a] | 390-413[d] |
| 934[c] | 5'-TCA CGY TTR RTA CCA CGC AGI AGA | 78, 103, 146, 168, 238, 698[a] | 831-854[d] |

Bacterial family: Mycobacteriaceae

| | | | |
|---|---|---|---|
| 539 | 5'-CCI TAC ATC CTB GTY GCI CTI AAC AAG | 122 | 85-111 |
| 540[c] | 5'-GGD GCI TCY TCR TCG WAI TCC TG | 122 | 181-203 |

Bacterial group: *Escherichia coli* and *Shigella*

| | | | |
|---|---|---|---|
| 1661 | 5'-TGG GAA GCG AAA ATC CTG | 1668[e] | 283-300 |
| 1665[c] | 5'-CAG TAC AGG TAG ACT TCT G | 1668[e] | 484-502 |

Bacterial group: *Pseudomonads* group

| | | | |
|---|---|---|---|
| 541 | 5'-GTK GAA ATG TTC CGC AAG CTG CT | 153-155[a] | 476-498[f] |
| 542[c] | 5'-CGG AAR TAG AAC TGS GGA CGG TAG | 153-155[a] | 679-702[f] |
| 541 | 5'-GTK GAA ATG TTC CGC AAG CTG CT | 153-155[a] | 476-498[f] |
| 544[c] | 5'-AYG TTG TCG CCM GGC ATT MCC AT | 153-155[a] | 749-771[f] |

[a]These sequences were aligned to derive the corresponding primer.
[b]The nucleotide positions refer to the *T. brucei* tuf (EF-1) sequence fragment (SEQ ID NO. 864).
[c]These sequences are from the complementary DNA strand of the sequence of the originating fragment given in the Sequence Listing.
[d]The nucleotide positions refer to the *E. coli* tuf sequence fragment (SEQ ID NO. 698).
[e]Sequence from databases.
[f]The nucleotide positions refer to the *P. aeruginosa* tuf sequence fragment (SEQ ID NO. 153).

Parasitical group: Trypanosomatidae family

| | | | |
|---|---|---|---|
| 923 | 5'-GAC GCI GCC ATC CTG ATG ATC | 511, 514-526, 529, 840-842, 864[a] | 166-188[b] |
| 924[c] | 5'-ACC TCA GTC GTC ACG TTG GCG | 511, 514-526, 529, 840-842, 864[a] | 648-668[b] |
| 925 | 5'-AAG CAG ATG GTT GTG TGC TG | 511, 514-526, 529, 840-842, 864[a] | 274-293[b] |

-continued

| | | | |
|---|---|---|---|
| 926[c] | 5'-CAG CTG CTC GTG GTG CAT CTC GAT | 511, 514-526, 529, 840-842, 864[a] | 676-699[b] |
| 927 | 5'-ACG CGG AGA AGG TGC GCT T | 511, 514-526, 529, 840-842, 864[a] | 389-407[b] |
| 928[c] | 5'-GGT CGT TCT TCG AGT CAC CGC A | 511, 514-526, 529, 840-842, 864[a] | 778-799[b] |
| | Universal primers (bacteria) | | |
| 636 | 5'-ACT GGY GTT GAI ATG TTC CGY AA | 7, 54, 78, 100, 103, 159, 209, 224, 227[b] | 470-492[d] |
| 637[c] | 5'-ACG TCA GTI GTA CGG AAR TAG AA | 7, 54, 78, 100, 103, 159, 209, 224, 227[b] | 692-714[d] |
| 638 | 5'-CCA ATG CCA CAA ACI CGT GAR CAC AT | 7, 54, 78, 100, 103, 159, 209, 224, 227[b] | 35-60[e] |
| 639[c] | 5'-TTT ACG GAA CAT TTC WAC ACC WGT IAC A | 7, 54, 78, 100, 103, 159, 209, 224, 227[b] | 469-496[e] |

[a]These sequences were aligned to derive the corresponding primer.
[b]The nucleotide positions refer to the *L. tropica* tuf (EF-1) sequence fragment (SEQ ID NO. 526).
[c]These sequences are from the complementary DNA strand of the sequence of the originating fragment given in the Sequence Listing.
[d]The nucleotide positions refer to the *E. coli* tuf sequence fragment (SEQ ID NO. 78).
[e]The nucleotide positions refer to the *B. cereus* tuf sequence fragment (SEQ ID NO. 7).

| | | | |
|---|---|---|---|
| 643 | 5'-ACT GGI GTI GAR ATG TTC CGY AA | 1, 3, 4, 7, 12, 13, 16, 49, 54, 72, 78, 85, 88, 91, 94, 98, 103, 108, 112, 115, 116, 120, 121, 126, 128, 134, 136, 146, 154, 159, 179, 186, 205, 209, 212, 224, 238[a] | 470-492[b] |
| 644[c] | 5'-ACG TCI GTI GTI CKG AAR TAG AA | same as SEQ ID NO. 643 | 692-714[b] |
| 643 | 5'-ACT GGI GTI GAR ATG TTC CGY AA | 1, 3, 4, 7, 12, 13, 16, 49, 54, 72, 78, 85, 88, 91, 94, 98, 103, 108, 112, 115, 116, 120, 121, 126, 128, 134, 136, 146, 154, 159, 179, 186, 205, 209, 212, 224, 238[a] | 470-492[b] |
| 645[c] | 5'-ACG TCI GTI GTI CKG AAR TAR AA | same as SEQ ID NO. 643 | 692-714[b] |
| 646 | 5'-ATC GAC AAG CCI TTC YTI ATG SC | 2, 13, 82 122, 145[a] | 317-339[d] |
| 647[c] | 5'-ACG TCC GTS GTR CGG AAG TAG AAC TG | 2, 13, 82 122, 145[a] | 686-711[d] |

-continued

| | | | |
|---|---|---|---|
| 646 | 5'-ATC GAC AAG CCI TTC YTI ATG SC | 2, 13, 82 122, 145[a] | 317-339[d] |
| 648[c] | 5'-ACG TCS GTS GTR CGG AAG TAG AAC TG | 2, 13, 82 122, 145[a] | 686-711[d] |

[a]These sequences were aligned to derive the corresponding primer.
[b]The nucleotide positions refer to the *E. coli* tuf sequence fragment (SEQ ID NO. 78).
[c]These sequences are from the complementary DNA strand of the sequence of the originating fragment given in the Sequence Listing.
[d]The nucleotide positions refer to the *A. meyeri* tuf sequence fragment (SEQ ID NO. 2)

| | | | |
|---|---|---|---|
| 649 | 5'-GTC CTA TGC CTC ARA CWC GIG AGC AC | 8, 86, 141, 143[a] | 33-58[b] |
| 650[c] | 5'-TTA CGG AAC ATY TCA ACA CCI GT | 8, 86, 141, 143[a] | 473-495[b] |
| 636 | 5'-ACT GGY GTT GAI ATG TTC CGY AA | 8, 86, 141, 143[a] | 473-495[b] |
| 651[c] | 5'-TGA CGA CCA CCI TCY TCY TTY TTC A | 8, 86, 141, 143[a] | 639-663[b] |

Universal primers (fungi)

| | | | |
|---|---|---|---|
| 1974 | 5'-ACA AGG GIT GGR MSA AGG AGA C | 404, 405, 433, 445, 898, 1268, 1276, 1986[a] | 443-464[d] |
| 1975[c] | 5'-TGR CCR GGG TGG TTR AGG ACG | 404, 405, 433, 445, 898, 1268, 1276, 1986[a] | 846-866[d] |
| 1976 | 5'-GAT GGA YTC YGT YAA ITG GGA | 407-412, 414-426, 428-431, 439, 443, 447, 448, 622, 624, 665, 1685, 1987-1990[a] | 286-306[e] |
| 1978[c] | 5'-CAT CIT GYA ATG GYA ATC TYA AT | same as SEQ ID NO. 1976 | 553-575[e] |
| 1977 | 5'-GAT GGA YTC YGT YAA RTG GGA | same as SEQ ID NO. 1976 | 286-306[e] |
| 1979[c] | 5'-CAT CYT GYA ATG GYA ASC TYA AT | same as SEQ ID NO. 1976 | 553-575[e] |
| 1981 | 5'-TGG ACA CCI SCA AGI GGK CYG | 401-405, 433, 435, 436, 438, 444, 445, 449, 453, 455, 457, 779, 781-783, 785, 786, 788-790, 897-903, 1267-1272, 1274-1280, 1282-1287, 1991-1998[a] | 281-301[d] |
| 1980[c] | 5'-TCR ATG GCI TCI AIR AGR GTY T | same as SEQ ID NO. 1981 | 488-509[d] |

[a]These sequences were aligned to derive the corresponding primer.
[b]The nucleotide positions refer to the *B. distasonis* tuf sequence fragment (SEQ ID NO. 8).
[c]These sequences are from the complementary DNA strand of the sequence of the originating fragment given in the Sequence Listing.
[d]The nucleotide positions refer to the *A. fumigatus* tuf (EF-1) sequence fragment (SEQ ID NO. 404).
[e]The nucleotide positions refer to the *C. albicans* tuf (EF-1) sequence fragment (SEQ ID NO. 407).

| | | | |
|---|---|---|---|
| 1982 | 5'-TGG ACA CYI SCA AGI GGK CYG | same as SEQ ID NO. 1981 | 281-301[a] |
| 1980[b] | 5'-TCR ATG GCI TCI AIR AGR GTY T | same as SEQ ID NO. 1981 | 488-509[a] |
| 1983 | 5'-CYG AYT GCG CYA TIC TCA TCA | same as SEQ ID NO. 1981 | 143-163[a] |

-continued

| | | | |
|---|---|---|---|
| 1980[b] | 5'-TCR ATG GCI TCI AIR AGR GTY T | same as SEQ ID NO. 1981 | 488-509[a] |
| 1984 | 5'-CYG AYT GYG CYA TYC TSA TCA | same as SEQ ID NO. 1981 | 143-163[a] |
| 1980[b] | 5'-TCR ATG GCI TCI AIR AGR GTY T | same as SEQ ID NO. 1981 | 488-509[a] |
| | Sequencing primers | | |
| 556 | 5'-CGG CGC NAT CYT SGT TGT TGC | 668[c] | 306-326 |
| 557[b] | 5'-CCM AGG CAT RAC CAT CTC GGT G | 668[c] | 1047-1068 |
| 694 | 5'-CGG CGC IAT CYT SGT TGT TGC | 668[c] | 306-326 |
| 557[b] | 5'-CCM AGG CAT RAC CAT CTC GGT G | 668[c] | 1047-1068 |
| 664 | 5'-AAY ATG ATI ACI GGI GCI GCI CAR ATG GA | 619[c] | 604-632 |
| 652[b] | 5'-CCW AYA GTI YKI CCI CCY TCY CTI ATA | 619[c] | 1482-1508 |
| 664 | 5'-AAY ATG ATI ACI GGI GCI GCI CAR ATG GA | 619[c] | 604-632 |
| 561[b] | 5'-ACI GTI CGG CCR CCC TCA CGG AT | 619[c] | 1483-1505 |
| 543 | 5'-ATC TTA GTA GTT TCT GCT GCT GA | 607 | 8-30 |
| 660[b] | 5'-GTA GAA TTG AGG ACG GTA GTT AG | 607 | 678-700 |
| 658 | 5'-GAT YTA GTC GAT GAT GAA GAA TT | 621 | 116-138 |
| 659[b] | 5'-GCT TTT TGI GTT TCW GGT TTR AT | 621 | 443-465 |
| 658 | 5'-GAT YTA GTC GAT GAT GAA GAA TT | 621 | 116-138 |
| 661[b] | 5'-GTA GAA YTG TGG WCG ATA RTT RT | 621 | 678-700 |
| 558 | 5'-TCI TTY AAR TAY GCI TGG GT | 665[c] | 157-176 |
| 559[b] | 5'-CCG ACR GCR AYI GTY TGI CKC AT | 665[c] | 1279-1301 |
| 813 | 5'-AAT CYG TYG AAA TGC AYC ACG A | 665[c] | 687-708 |
| 559[b] | 5'-CCG ACR GCR AYI GTY TGI CKC AT | 665[c] | 1279-1301 |

[a]The nucleotide positions refer to the *A. fumigatus* tuf (EF-1) sequence fragment (SEQ ID NO. 404).
[b]These sequences are from the complementary DNA strand of the sequence of the originating fragment given in the Sequence Listing.
[c]Sequences from databases.

| | | | |
|---|---|---|---|
| 558 | 5'-TCI TTY AAR TAY GCI TGG GT | 665[a] | 157-176 |
| 815[b] | 5'-TGG TGC ATY TCK ACR GAC TT | 665[a] | 686-705 |
| 560 | 5'-GAY TTC ATY AAR AAY ATG ATY AC | 665[a] | 289-311 |
| 559[b] | 5'-CCG ACR GCR AYI GTY TGI CKC AT | 665[a] | 1279-1301 |
| 653 | 5'-GAY TTC ATI AAR AAY ATG AT | 665[a] | 289-308 |
| 559[b] | 5'-CCG ACR GCR AYI GTY TGI CKC AT | 665[a] | 1279-1301 |
| 558 | 5'-TCI TTY AAR TAY GCI TGG GT | 665[a] | 157-176 |
| 655[b] | 5'-CCR ATA CCI CMR ATY TTG TA | 665[a] | 754-773 |
| 654 | 5'-TAC AAR ATY KGI GGT ATY GG | 665[a] | 754-773 |
| 559[b] | 5'-CCG ACR GCR AYI GTY TGI CKC AT | 665[a] | 1279-1301 |
| 696 | 5'-ATI GGI CAY RTI GAY CAY GGI AAR AC | 698[a] | 52-77 |
| 697[b] | 5'-CCI ACI GTI CKI CCR CCY TCR CG | 698[a] | 1132-1154 |
| 911 | 5'-GAC GGM KKC ATG CCG CAR AC | 853 | 22-41 |
| 914[b] | 5'-GAA RAG CTG CGG RCG RTA GTG | 853 | 700-720 |

-continued

| | | | |
|---|---|---|---|
| 912 | 5'-GAC GGC GKC ATG CCG CAR AC | 846 | 20-39 |
| 914[b] | 5'-GAA RAG CTG CGG RCG RTA GTG | 846 | 692-712 |
| 913 | 5'-GAC GGY SYC ATG CCK CAG AC | 843 | 251-270 |
| 915[b] | 5'-AAA CGC CTG AGG RCG GTA GTT | 843 | 905-925 |
| 916 | 5'-GCC GAG CTG GCC GGC TTC AG | 846 | 422-441 |
| 561[b] | 5'-ACI GTI CGG CCR CCC TCA CGG AT | 619[a] | 1483-1505 |
| 664 | 5'-AAY ATG ATI ACI GGI GCI GCI CAR ATG GA | 619[a] | 604-632 |
| 917[b] | 5'-TCG TGC TAC CCG TYG CCG CCA T | 846 | 593-614 |

[a]Sequences from databases.
[b]These sequences are from the complementary DNA strand of the sequence of the originating fragment given in the Sequence Listing.

| | | | |
|---|---|---|---|
| 1221 | 5'-GAY ACI CCI GGI CAY GTI GAY TT | 1230[a] | 292-314 |
| 1226[b] | 5'-GTI RMR TAI CCR AAC ATY TC | 1230[a] | 2014-2033 |
| 1222 | 5'-ATY GAY ACI CCI GGI CAY GTI GAY TT | 1230[a] | 289-314 |
| 1223[b] | 5'-AYI TCI ARR TGI ARY TCR CCC ATI CC | 1230[a] | 1408-1433 |
| 1224 | 5'-CCI GYI HTI YTI GAR CCI ATI ATG | 1230[a] | 1858-1881 |
| 1225[b] | 5'-TAI CCR AAC ATY TCI SMI ARI GGI AC | 1230[a] | 2002-2027 |
| 1227 | 5'-GTI CCI YTI KCI GAR ATG TTY GGI TA | 1230[a] | 2002-2027 |
| 1229[b] | 5'-TCC ATY TGI GCI GCI CCI GTI ATC AT | 698[a] | 4-29 |
| 1228 | 5'-GTI CCI YTI KCI GAR ATG TTY GGI TAY GC | 1230[a] | 2002-2030 |
| 1229[b] | 5'-TCC ATY TGI GCI GCI CCI GTI ATC AT | 698[a] | 4-29 |
| 1999 | 5'-CAT GTC AAY ATT GGT ACT ATT GGT CAT GT | 498-500, 502, 505, 506, 508, 619, 2004, 2005[c] | 25-53[d] |
| 2000[b] | 5'-CCA CCY TCI CTC AMG TTG AAR CGT T | same as SEQ ID NO. 1999 | 1133-1157[d] |
| 2001 | 5'-ACY ACI TTR ACI GCY GCY ATY AC | same as SEQ ID NO. 1999 | 67-89[d] |
| 2003[b] | 5'-CAT YTC RAI RTT GTC ACC TGG | same as SEQ ID NO. 1999 | 1072-1092[d] |
| 2002 | 5'-CCI GAR GAR AGA GCI MGW GGT | same as SEQ ID NO. 1999 | 151-171[d] |
| 2003[b] | 5'-CAT YTC RAI RTT GTC ACC TGG | same as SEQ ID NO. 1999 | 1072-1092[d] |

[a]Sequences from databases.
[b]These sequences are from the complementary DNA strand of the sequence of the originating fragment given in the Sequence Listing.
[c]These sequences were aligned to derive the corresponding primer.
[d]The nucleotide positions refer to the *C. albicans* tuf sequence fragment (SEQ ID NO. 2004).

Annex II: Specific and ubiquitous primers for nucleic acid amplification (atpD sequences).

| SEQ ID NO. | Nucleotide sequence | Originating DNA fragment SEQ ID NO. | Nucleotide position |
|---|---|---|---|
| | **Bacterial species: *Acinetobacter baumannii*** | | |
| 1690 | 5'-CAG GTC CTG TTG CGA CTG AAG AA | 243 | 186-208 |
| 1691[b] | 5'-CAC AGA TAA ACC TGA GTG TGC TTT C | 243 | 394-418 |
| | **Bacterial species: *Bacteroides fragilis*** | | |
| 2134 | 5'-CGC GTG AAG CTT CTG TG | 929 | 184-200 |
| 2135[b] | 5'-TCT CGC CGT TAT TCA GTT TC | 929 | 395-414 |
| | **Bacterial species: *Bordetella pertussis*** | | |
| 2180 | 5'-TTC GCC GGC GTG GGC | 1672[c] | 544-558 |
| 2181[b] | 5'-AGC GCC ACG CGC AGG | 1672[c] | 666-680 |
| | **Bacterial species: *Enterococcus faecium*** | | |
| 1698 | 5'-GGA ATC AAC AGA TGG TTT ACA AA | 292 | 131-153 |
| 1699[b] | 5'-GCA TCT TCT GGG AAA GGT GT | 292 | 258-277 |
| 1700 | 5'-AAG ATG CGG AAA GAA GCG AA | 292 | 271-290 |
| 1701[b] | 5'-ATT ATG GAT CAG TTC TTG GAT CA | 292 | 439-461 |
| | **Bacterial species: *Klebsiella pneumoniae*** | | |
| 1331 | 5'-GCC CTT GAG GTA CAG AAT GGT AAT GAA GTT | 317 | 88-118 |
| 1332[b] | 5'-GAC CGC GGC GCA GAC CAT CA | 317 | 183-203 |

[a]These sequences were aligned to derive the corresponding primer.
[b]These sequences are from the complementary DNA strand of the sequence of the originating fragment given in the Sequence Listing.
[c]Sequence from databases.

| | | | |
|---|---|---|---|
| | **Bacterial species: Streptococcus agalactiae** | | |
| 627 | 5'-ATT GTC TAT AAA AAT GGC GAT AAG TC | 379-383[a] | 42-67[b] |
| 625[c] | 5'-CGT TGA AGA CAC GAC CCA AAG TAT CC | 379-383[a] | 206-231[b] |
| 628 | 5'-AAA ATG GCG ATA AGT CAC AAA AAG TA | 379-383[a] | 52-77[b] |
| 625[c] | 5'-CGT TGA AGA CAC GAC CCA AAG TAT CC | 379-383[a] | 206-231[b] |
| 627 | 5'-ATT GTC TAT AAA AAT GGC GAT AAG TC | 379-383[a] | 42-67[b] |
| 626[c] | 5'-TAC CAC CTT TTA AGT AAG GTG CTA AT | 379-383[a] | 371-396[b] |
| 628 | 5'-AAA ATG GCG ATA AGT CAC AAA AAG TA | 379-383[a] | 52-77[b] |
| 626[c] | 5'-TAC CAC CTT TTA AGT AAG GTG CTA AT | 379-383[a] | 371-396[b] |
| | **Bacterial group: *Campylobacter jejuni* and *C. coli*** | | |
| 2131 | 5'-AAG CMA TTG TTG TAA ATT TTG AAA G | 1576, 1600, 1849, 1863, 2139[d,a] | 7-31[e] |
| 2132[c] | 5'-TCA TAT CCA TAG CAA TAG TTC TA | 1576, 1600, 1849, 1863, 2139[d,a] | 92-114[e] |
| | **Bacterial genus: *Bordetella* sp.** | | |
| 825 | 5'-ATG AGC ARC GSA ACC ATC GTT CAG TG | 1672[d] | 1-26 |
| 826[c] | 5'-TCG ATC GTG CCG ACC ATG TAG AAC GC | 1672[d] | 1342-1367 |

-continued

| Fungal genus: *Candida* sp. | | | |
|---|---|---|---|
| 634 | 5'-AAC ACY GTC AGR RCI ATT GCY ATG GA | 460-472, 474-478[a] | 101-126[f] |
| 635[c] | 5'-AAA CCR GTI ARR GCR ACT CTI GCT CT | 460-472, 474-478[a] | 617-642[f] |

[a]These sequences were aligned to derive the corresponding primer.
[b]The nucleotide positions refer to the *S. agalactiae* atpD sequence fragment (SEQ ID NO. 380).
[c]These sequences are from the complementary DNA strand of the sequence of the originating fragment given in the Sequence Listing.
[d]Sequence from databases.
[e]The nucleotide positions refer to the *C. jejuni* atpD sequence fragment (SEQ ID NO. 1576).
[f]The nucleotide positions refer to the *C. albicans* atpD sequence fragment (SEQ ID NO. 460).

| Universal primers | | | |
|---|---|---|---|
| 562 | 5'-CAR ATG RAY GAR CCI CCI GGI GYI MGI ATG | 243, 244, 262, 264, 280, 284, 291, 297, 309, 311, 315, 317, 324, 329, 332, 334-336, 339, 342, 343, 351, 356, 357, 364-366, 370, 375, 379, 393[a] | 528-557[b] |
| 563[c] | 5'-GGY TGR TAI CCI ACI GCI GAI GGC AT | 243, 244, 262, 264, 280, 284, 291, 297, 309, 311, 315, 317, 324, 329, 332, 334-336, 339, 342, 343, 351, 356, 357, 364-366, 370, 375, 379, 393[a] | 687-712[b] |
| 564 | 5'-TAY GGI CAR ATG AAY GAR CCI CCI GGI AA | 243, 244, 262, 264, 280, 284, 291, 297, 309, 311, 315, 317, 324, 329, 332, 334-336, 339, 342, 343, 351, 356, 357, 364-366, 370, 375, 379, 393[a] | 522-550[b] |
| 565[c] | 5'-GGY TGR TAI CCI ACI GCI GAT GGD AT | 243, 244, 262, 264, 280, 284, 291, 297, 309, 311, 315, 317, 324, 329, 332, 334-336, 339, 342, 343, 351, 356, 357, 364-366, 370, 375, 379, 393[a] | 687-712[b] |

[a]These sequences were aligned to derive the corresponding primer.
[b]The nucleotide positions refer to the *K. pneumoniae* atpD sequence fragment (SEQ ID NO. 317).
[c]These sequences are from the complementary DNA strand of the sequence of the originating fragment given in the Sequence Listing.

| | | | |
|---|---|---|---|
| 640 | 5'-TCC ATG GTI TWY GGI CAR ATG AA | 248, 284, 315, 317, 343, 357, 366, 370, 379, 393[a] | 513-535[b] |
| 641[c] | 5'-TGA TAA CCW ACI GCI GAI GGC ATA CG | 248, 284, 315, 317, 343, 357, 366, 370, 379, 393[a] | 684-709[b] |
| 642 | 5'-GGC GTI GGI GAR CGI ACI CGT GA | 248, 284, 315, 317, 343, 357, 366, 370, 379, 393[a] | 438-460[b] |

-continued

| | | | |
|---|---|---|---|
| 641[c] | 5'-TGA TAA CCW ACI GCI GAI GGC ATA CG | 248, 284, 315, 317, 343, 357, 366, 370, 379, 393[a] | 684-709[b] |
| | Sequencing primers | | |
| 566 | 5'-TTY GGI GGI GCI GGI GTI GGI AAR AC | 669[d] | 445-470 |
| 567[c] | 5'-TCR TCI GCI GGI ACR TAI AYI GCY TG | 669[d] | 883-908 |
| 566 | 5'-TTY GGI GGI GCI GGI GTI GGI AAR AC | 669[d] | 445-470 |
| 814 | 5'-GCI GGC ACG TAC ACI GCC TG | 666[d] | 901-920 |
| 568 | 5'-RTI ATI GGI GCI GTI RTI GAY GT | 669[d] | 25-47 |
| 567[c] | 5'-TCR TCI GCI GGI ACR TAI AYI GCY TG | 669[d] | 883-908 |
| 570 | 5'-RTI RYI GGI CCI GTI RTI GAY GT | 672[d] | 31-53 |
| 567[c] | 5'-TCR TCI GCI GGI ACR TAI AYI GCY TG | 669[d] | 883-908 |
| 572 | 5'-RTI RTI GGI SCI GTI RTI GA | 669[d] | 25-44 |
| 567[c] | 5'-TCR TCI GCI GGI ACR TAI AYI GCY TG | 669[d] | 883-908 |
| 569 | 5'-RTI RTI GGI SCI GTI RTI GAT AT | 671[d] | 31-53 |
| 567[c] | 5'-TCR TCI GCI GGI ACR TAI AYI GCY TG | 669[d] | 883-908 |
| 571 | 5'-RTI RTI GGI CCI GTI RTI GAT GT | 670[d] | 31-53 |
| 567[c] | 5'-TCR TCI GCI GGI ACR TAI AYI GCY TG | 669[d] | 883-908 |

[a]These sequences were aligned to derive the corresponding primer.
[b]The nucleotide positions refer to the *K. pneumoniae* atpD sequence fragment (SEQ ID NO. 317).
[c]These sequences are from the complementary DNA strand of the sequence of the originating fragment given in the Sequence Listing.
[d]Sequences from databases.

| | | | |
|---|---|---|---|
| 700 | 5'-TIR TIG AYG TCG ART TCC CTC ARG | 669[a] | 38-61 |
| 567[b] | 5'-TCR TCI GCI GGI ACR TAI AYI GCY TG | 669[a] | 883-908 |
| 568 | 5'-RTI ATI GGI GCI GTI RTI GAY GT | 669[a] | 25-47 |
| 573[b] | 5'-CCI CCI ACC ATR TAR AAI GC | 666[a] | 1465-1484 |
| 574 | 5'-ATI GCI ATG GAY GGI ACI GAR GG | 666[a] | 283-305 |
| 573[b] | 5'-CCI CCI ACC ATR TAR AAI GC | 666[a] | 1465-1484 |
| 574 | 5'-ATI GCI ATG GAY GGI ACI GAR GG | 666[a] | 283-305 |
| 708[b] | 5'-TCR TCC ATI CCI ARI ATI GCI ATI AT | 666[a] | 1258-1283 |
| 681 | 5'-GGI SSI TTY GGI ISI GGI AAR AC | 685 | 694-716 |
| 682[b] | 5'-GTI ACI GGY TCY TCR AAR TTI CCI CC | 686 | 1177-1202 |
| 681 | 5'-GGI SSI TTY GGI ISI GGI AAR AC | 685 | 694-716 |
| 683[b] | 5'-GTI ACI GGI TCI SWI AWR TCI CCI CC | 685 | 1180-1205 |
| 681 | 5'-GGI SSI TTY GGI ISI GGI AAR AC | 685 | 694-716 |
| 699 | 5'-GTI ACI GGY TCY TYR ARR TTI CCI CC | 686 | 1177-1202 |
| 681 | 5'-GGI SSI TTY GGI ISI GGI AAR AC | 685 | 694-716 |
| 812[b] | 5'-GTI ACI GGI TCY TYR ARR TTI CCI CC | 685 | 1180-1205 |
| 1213 | 5'-AAR GGI GGI ACI GCI GCI ATH CCI GG | 714[a] | 697-722 |
| 1212[b] | 5'-CCI CCI RGI GGI GAI ACI GCW CC | 714[a] | 1189-1211 |
| 1203 | 5'-GGI GAR MGI GGI AAY GAR ATG | 709[a] | 724-744 |
| 1207[b] | 5'-CCI TCI TCW CCI GGC ATY TC | 709[a] | 985-1004 |

-continued

| | | | |
|---|---|---|---|
| 1204 | 5'-GCI AAY AAC ITC IWM YAT GCC | 709[a] | 822-842 |
| 1206[b] | 5'-CKI SRI GTI GAR TCI GCC A | 709[a] | 926-944 |
| 1205 | 5'-AAY ACI TCI AWY ATG CCI GT | 709[a] | 826-845 |
| 1207[b] | 5'-CCI TCI TCW CCI GGC ATY TC | 709[a] | 985-1004 |
| 2282 | 5'-AGR RGC IMA RAT GTA TGA | 714[a] | 84-101 |
| 2284[b] | 5'-TCT GWG TRA CIG GYT CKG AGA | 714[a] | 1217-1237 |
| 2283 | 5'-ATI TAT GAY GGK ITT CAG AGG C | 714[a] | 271-292 |
| 2285[b] | 5'-CMC CIC CWG GTG GWG AWA C | 714[a] | 1195-1213 |

[a]Sequences from databases.

[b]These sequences are from the complementary DNA strand of the sequence of the originating fragment given in the Sequence Listing.

Annex III: Internal hybridization probes for specific detection of tuf sequences.

| SEQ ID NO. | Nucleotide sequence | Originating DNA fragment SEQ ID NO. | Nucleotide position |
|---|---|---|---|
| | Bacterial species: *Abiotrophia adiacens* | | |
| 2170 | 5'-ACG TGA CGT TGA CAA ACC A | 1715 | 313-331 |
| | Bacterial species: *Chlamydia pneumoniae* | | |
| 2089 | 5'-ATG CTG AAC TTA TTG ACC TT | 20 | 136-155 |
| 2090 | 5'-CGT TAC TGG AGT CGA AAT G | 20 | 467-485 |
| | Bacterial species: *Enterococcus faecalis* | | |
| 580 | 5'-GCT AAA CCA GCT ACA ATC ACT CCA C | 62-63, 607[a] | 584-608[b] |
| 603 | 5'-GGT ATT AAA GAC GAA ACA TC | 62-63, 607[a] | 440-459[b] |
| 1174 | 5'-GAA CGT GGT GAA GTT CGC | 62-63, 607[a] | 398-415[b] |
| | Bacterial species: *Enterococcus faecium* | | |
| 602 | 5'-AAG TTG AAG TTG TTG GTA TT | 64, 608[a] | 426-445[c] |
| | Bacterial species: *Enterococcus gallinarum* | | |
| 604 | 5'-GGT GAT GAA GTA GAA ATC GT | 66, 609[a] | 419-438[d] |
| | Bacterial species: *Escherichia coli* | | |
| 579 | 5'-GAA GGC CGT GCT GGT GAG AA | 78 | 503-522 |
| 2168 | 5'-CAT CAA AGT TGG TGA AGA AGT TG | 78 | 409-431 |
| | Bacterial species: *Neisseria gonorrhoeae* | | |
| 2166 | 5'-GAC AAA CCA TTC CTG CTG | 126 | 322-339[e] |
| | Fungal species: *Candida albicans* | | |
| 577 | 5'-CAT GAT TGA ACC ATC CAC CA | 407-411[a] | 406-425[f] |

-continued

| | | | |
|---|---|---|---|
| | Fungal species: *Candida dubliniensis* | | |
| 578 | 5'-CAT GAT TGA AGC TTC CAC CA | 412, 414-415[a] | 418-437[g] |

[a]These sequences were aligned to derive the corresponding primer.
[b]The nucleotide positions refer to the *E. faecalis* tuf sequence fragment (SEQ ID NO. 607).
[c]The nucleotide positions refer to the *E. faecium* tuf sequence fragment (SEQ ID NO. 608).
[d]The nucleotide positions refer to the *E. gallinarum* tuf sequence fragment (SEQ ID NO. 609).
[e]The nucleotide positions refer to the *N. gonorrhoeae* tuf sequence fragment (SEQ ID NO. 126).
[f]The nucleotide positions refer to the *C. albicans* tuf(EF-1) sequence fragment (SEQ ID NO. 408).
[g]The nucleotide positions refer to the *C. dubliniensis* tuf(EF-1) sequence fragment (SEQ ID NO. 414).

| | | | |
|---|---|---|---|
| | Bacterial species: *Haemophilus influenzae* | | |
| 581 | 5'-ACA TCG GTG CAT TAT TAC GTG G | 610[a] | 551-572 |
| | Bacterial species: *Mycoplasma pneumoniae* | | |
| 2095 | 5'-CGG TCG GGT TGA ACG TGG | 2097[a] | 687-704 |
| | Bacterial species: *Staphylococcus aureus* | | |
| 584 | 5'-ACA TGA CAC ATC TAA AAC AA | 176-180[b] | 369-388[c] |
| 585 | 5'-ACC ACA TAC TGA ATT CAA AG | 176-180[b] | 525-544[c] |
| 586 | 5'-CAG AAG TAT ACG TAT TAT CA | 176-180[b] | 545-564[c] |
| 587 | 5'-CGT ATT ATC AAA AGA CGA AG | 176-180[b] | 555-574[c] |
| 588 | 5'-TCT TCT CAA ACT ATC GTC CA | 176-180[b] | 593-612[c] |
| | Bacterial species: *Staphylococcus epidermidis* | | |
| 589 | 5'-GCA CGA AAC TTC TAA AAC AA | 185, 611[b] | 445-464[d] |
| 590 | 5'-TAT ACG TAT TAT CTA AAG AT | 185, 611[b] | 627-646[d] |
| 591 | 5'-TCC TGG TTC TAT TAC ACC AC | 185, 611[b] | 586-605[d] |
| 592 | 5'-CAA AGC TGA AGT ATA CGT AT | 185, 611[b] | 616-635[d] |
| 593 | 5'-TTC ACT AAC TAT CGC CCA CA | 185, 611[b] | 671-690[d] |
| | Bacterial species: *Staphylococcus haemolyticus* | | |
| 594 | 5'-ATT GGT ATC CAT GAC ACT TC | 186, 188-190[b] | 437-456[e] |
| 595 | 5'-TTA AAG CAG ACG TAT ACG TT | 186, 188-190[b] | 615-634[e] |
| | Bacterial species:*Staphylococcus hominis* | | |
| 596 | 5'-GAA ATT ATT GGT ATC AAA GA | 191, 193-196[b] | 431-450[f] |
| 597 | 5'-ATT GGT ATC AAA GAA ACT TC | 191, 193-196[b] | 437-456[f] |
| 598 | 5'-AAT TAC ACC TCA CAC AAA AT | 191, 193-196[b] | 595-614[f] |

[a]Sequences from databases.
[b]These sequences were aligned to derive the corresponding probe.
[c]The nucleotide positions refer to the *S. aureus* tuf sequence fragment (SEQ ID NO. 179).
[d]The nucleotide positions refer to the *S. epidermidis* tuf sequence fragment (SEQ ID NO. 611).
[e]The nucleotide positions refer to the *S. haemolyticus* tuf sequence fragment (SEQ ID NO. 186).
[f]The nucleotide positions refer to the *S. hominis* tuf sequence fragment (SEQ ID NO. 191).

| | | | |
|---|---|---|---|
| | Bacterial species: *Staphylococcus saprophyticus* | | |
| 599 | 5'-CGG TGA AGA AAT CGA AAT CA | 198-200[a] | 406-425[b] |
| 600 | 5'-ATG CAA GAA GAA TCA AGC AA | 198-200[a] | 431-450[b] |
| 601 | 5'-GTT TCA CGT GAT GAT GTA CA | 198-200[a] | 536-555[b] |
| 695 | 5'-GTT TCA CGT GAT GAC GTA CA | 198-200[a] | 563-582[b] |

-continued

| | | | |
|---|---|---|---|
| | Bacterial species: *Streptococcus agalactiae* | | |
| 582[c] | 5'-TTT CAA CTT CGT CGT TGA CAC GAA CAG T | 207-210[a] | 404-431[d] |
| 583[c] | 5'-CAA CTG CTT TTT GGA TAT CTT CTT TAA TAC CAA CG | 207-210[a] | 433-467[d] |
| 1199 | 5'-GTA TTA AAG AAG ATA TCC AAA AAG C | 207-210[a] | 438-462[d] |
| | Bacterial species: *Streptococcus pneumoniae* | | |
| 1201 | 5'-TCA AAG AAG AAA CTA AAA AAG CTG T | 971, 977, 979, 986[a] | 513-537[e] |
| | Bacterial species: *Streptococcus pyogenes* | | |
| 1200 | 5'-TCA AAG AAG AAA CTA AAA AAG CTG T | 1002 | 473-497 |
| | Bacterial group: *Enterococcus casseliflavus-flavescens-gallinarum* group | | |
| 620 | 5'-ATT GGT GCA TTG CTA CGT | 58, 65, 66[a] | 527-544[f] |
| 1122 | 5'-TGG TGC ATT GCT ACG TGG | 58, 65, 66[a] | 529-546[f] |
| | Bacterial group: *Enterococcus* sp., *Gemella* sp., *A. adiacens* | | |
| 2172 | 5'-GTG TTG AAA TGT TCC GTA AA | 58-62, 67-71, 87-88, 607-609, 727, 871 1715, 1722[a] | 477-496[g] |

[a]These sequences were aligned to derive the corresponding primer.
[b]The nucleotide positions refer to the *S. saprophyticus* tuf sequence fragment (SEQ ID NO. 198).
[c]These sequences are from the complementary DNA strand of the sequence of the originating fragment given in the Sequence Listing.
[d]The nucleotide positions refer to the *S. agalactiae tuf sequence fragment* (SEQ ID NO. 209).
[e]The nucleotide positions refer to the *S. pneumoniae tuf sequence fragment* (SEQ ID NO. 986).
[f]The nucleotide positions refer to the *E. flavescens tuf sequence fragment* (SEQ ID NO. 65).
[g]The nucleotide positions refer to the *E. faecium tuf sequence fragment (SEQ* ID NO. 608).

| | | | |
|---|---|---|---|
| | Bacterial genus: *Gemella* | | |
| 2171 | 5'-TCG TTG GAT TAA CTG AAG AA | 87, 88[a] | 430-449[b] |
| | Bacterial genus: *Staphylococcus* sp. | | |
| 605 | 5'-GAA ATG TTC CGT AAA TTA TT | 176-203[a] | 403-422[c] |
| 606 | 5'-ATT AGA CTA CGC TGA AGC TG | 176-203[a] | 420-439[c] |
| 1175 | 5'-GTT ACT GGT GTA GAA ATG TTC | 176-203[a] | 391-411[c] |
| 1176 | 5'-TAC TGG TGT AGA AAT GTT C | 176-203[a] | 393-411[c] |
| | Bacterial genus: *Streptococcus* sp. | | |
| 1202 | 5'-GTG TTG AAA TGT TCC GTA AAC A | 206-231, 971, 977, 979, 982-986[a] | 466-487[d] |
| | Fungal species: *Candida albicans* | | |
| 1156 | 5'-GTT GAA ATG CAT CAC GAA CAA TT | 407-412, 624[a] | 680-702[e] |
| | Fungal group: *Candida albicans* and *C. tropicalis* | | |
| 1160 | 5'-CGT TTC TGT TAA AGA AAT TAG AAG | 407-412, 429, 624[a] | 748-771[e] |
| | Fungal species: *Candida dubliniensis* | | |
| 1166 | 5'-ACG TTA AGA ATG TTT CTG TCA A | 414-415[a] | 750-771[f] |
| 1168 | 5'-GAA CAA TTG GTT GAA GGT GT | 414-415[a] | 707-726[f] |

-continued

| | | | |
|---|---|---|---|
| | Fungal species: *Candida glabrata* | | |
| 1158 | 5'-AAG AGG TAA TGT CTG TGG T | 417 | 781-799 |
| 1159 | 5'-TGA AGG TTT GCC AGG TGA | 417 | 718-735 |
| | Fungal species: *Candida krusei* | | |
| 1161 | 5'-TCC AGG TGA TAA CGT TGG | 422 | 720-737 |

[a]These sequences were aligned to derive the corresponding primer.
[b]The nucleotide positions refer to the *G. haemolysans* tuf sequence fragment (SEQ ID NO. 87).
[c]The nucleotide positions refer to the *S. aureus* tuf sequence fragment (SEQ ID NO. 179).
[d]The nucleotide positions refer to the *S. pneumoniae* tuf sequence fragment (SEQ ID NO. 986).
[e]The nucleotide positions refer to the *C. albicans tuf(EF-1) sequence fragment* (SEQ ID NO. 408).
[f]The nucleotide positions refer to the *C. dubliniensis* tuf(EF-1) sequence fragment (SEQ ID NO. 414).

| | | | |
|---|---|---|---|
| | Fungal group: *Candida lusitaniae and C. guillermondii* | | |
| 1162 | 5'-CAA GTC CGT GGA AAT GCA | 418, 424[a] | 682-699[b] |
| | Fungal species: *Candida parapsilosis* | | |
| 1157 | 5'-AAG AAC GTT TCA GTT AAG GAA AT | 426 | 749-771 |
| | Fungal species: *Candida zeylanoides* | | |
| 1165 | 5'-GGT TTC AAC GTG AAG AAC | 432 | 713-730 |
| | Fungal genus: *Candida* sp. | | |
| 1163 | 5'-GTT GGT TTC AAC GTT AAG AAC | 407-412, 414-415, 417, 418, 422, 429[a] | 728-748[c] |
| 1164 | 5'-GGT TTC AAC GTC AAG AAC | 413, 416, 420, 421, 424, 425, 426, 428, 431[a] | 740-757[b] |
| 1167 | 5'-GTT GGT TTC AAC GT | 406-426, 428-432, 624[a] | 728-741[c] |

[a]These sequences were aligned to derive the corresponding primer.
[b]The nucleotide positions refer to the *C. lusitaniae* tuf(EF-1) sequence fragment (SEQ ID NO. 424).
[c]The nucleotide positions refer to the *C. albicans* tuf(EF-1) sequence fragment (SEQ ID NO. 408).

Annex IV: Strategy for the selection of amplification/sequencing primers from atpD (F-type) sequences.

| | 23 49 443 472 881 910 | SEQ ID NO.: | Accession #: |
|---|---|---|---|
| *B. cepacia* | AGTgCAT CGGCGCCGTT ATCGACGTGG...TGTTCG GCGGTGCTGG CGTGGGCAAG ACCG...TCCA GGCCGTGT ACGTCCCTGC GGACGACT | — | X76877 |
| *B. pertussis* | AGTgCAT CGGCGCCGTG GTGGATATTC...TGTTCG GCGGCGCCGG CGTGGGCAAG ACCG...TCCA GGCCGTGT ACGTGCCTGC CGACGACT | — | Genome project |
| *P. aeruginosa* | AAATCAT CGGCGCCGTG ATCGACGTGG...TGTTCG GCGGCGCCGG CGTGGGCAAG ACCG...TCCA GGCCGTAT ACGTTCCCGC GGACGACC | — | Genome project |
| *E. coli* | AGGTAAT CGGCGCCGTA GTTGACGTCG...TGTTCG GTGGTGCGGG TGTAGGTAAA ACCG...TACA GGCAGTAT ACGTACCTGC GGATGACT | — | J01594 |
| *N. gonorrhoeae* | AAATTAT CGGTGCGGTT GTTGACGTGG...TGTTCG GCGGTGCCGG TGTGGGTAAA ACCG...TCCA AGCCGTAT ATGTACCTGC GGATGACT | — | Genome project |
| *M. thermoacetica* | AGGTTAT TGGCCCGGTG GTTGACGTCG...TCTTCG GCGGCGCCGG GGTCGGCAAG ACGG...TGCA AGCTATCT ATGTGCCGGC CGACGACC | — | U64318 |
| *S. aurantiaca* | AGGTTcT CGGTCCCGTG ATTGACGTGG...TGTTCG GCGGCGCCGG CGTGGGCAAG ACGG...TGCA GGCCATCT ACGTGCCCGC CGACGACC | — | X76879 |
| *M. tuberculosis* | GGGTCAC TGGGCCCGTC GTCGACGTCG...TGTTCG GCGGTGCCGG GGTGGGCAAG ACGG...TGCA AGCCGTCT ACGTGCCCGC CGACGACT | — | Z73419 |
| *B. fragilis* | AGGTAAT TGGCCCTGTG GTCGATGTGT...TGTTTG GCGGGGCCGG AGTGGGTAAA ACTG...TGCA GGCTGTTT ACGTACCGGC TGATGACT | — | M22247 |
| *C. lytica* | AAATTAT TGGCCCAGTT ATAGATGTGG...TATTTG GAGGTGCCGG AGTAGGTAAA ACAG...TACA GGCGGTTT ACGTACCTGC GGATGATT | 672 | M22535 |
| *A. woodii* | AGGTTAT TGGACCAGTA GTCGATGTTA...TTTTCG GTGGTGCCGG AGTTGGTAAA ACCG...TTCA GGCCGTTT ACGaTCCAGC CGATGACT | — | U10505 |
| *C. acetobutylicum* | AGGTAAT AGGACCTGTT GTGGATATTA...TGTTCG GTGGTGCCGG TGTTGGTAAA ACAG...TTCA GGCTGTAT ATGTTCCTGC TGATGACC | 671 | AF101055 |
| *M. pneumoniae* | AAGTGAT TGGCCCGGTA GTTGATGTCA...TATTTG GTGGTGCTGG TGTTGGTAAA ACGG...TGCA AGCGATCT ATGTGCCAGC TGATGACT | — | U43738 |
| *H. pylori* | AGGTTtT AGGCCCGGTG GTAGATGTGG...TGTTTG GTGGGGCTGG CGTAGGCAAA ACGG...TTCA AGCGGTGT ATGTGCCAGC AGACGACT | 670 | AF004014 |
| Selected sequences for universal primers | RTIAT IGGIGCIGTI RTIGAYGT | 568 | |
| | RTIRY IGGICCIGTI RTIGAYGT | 570 | |
| | RTIRT IGGISCIGTI RTIGA | 572 | |
| | RTIRT IGGISCIGTI RTIGATAT | 569 | |
| | RTIRT IGGICCIGTI RTIGATGT | 571 | |
| | TTYG GIGGIGCIGG IGTIGGIAAR AC | 566 | |
| Selected sequence for universal primer[a] | CA RGCIRTIT AYGTICCIGC IGAYGA | 567 | |

The sequence numbering refers to the *Escherichia coli* atpD gene fragment (SEQ ID NO. 669).

Nucleotides in capitals are identical to the selected sequences or match those sequences.

Mismatches are indicated by lower-case letters.

Dots indicate gaps in the sequences displayed.

"R" "Y" "M" "K" "W" and "S" designate nucleotide positions which are degenerated. "R" stands for A or G; "Y" stands for C or T; "M" stands for A or C; "K" stands for G or T; "W" stands for A or T; "S" stands for C or G. "I" stands for inosine which is a nucleotide analog that can bind to any of the four nucleotides A, C, G or T.

[a]This sequence is the reverse-complement of the selected primer.

Annex V: Strategy for the selection of universal amplification/sequencing primers from atpD (V-type) sequences.

| | 691 719 | 1177 1208 | SEQ ID NO.: |
|---|---|---|---|
| *E. hirae* | CC **AGGTCCGTTT GGTGCAGGGA AGAC**AGT... | TCT**GGTGGAg ATaTCtctGA ACCAGTGA**CT CA | 685 |
| *H. salinarum* | CC **GGGGCCGTTC GGGTCCGGGA AGAC**GGT... | CCC**GGCGGGg ACTTCtccGA GCCGGTCA**CC CA | 687 |
| *T. thermophilus* | CC **TGGGCCCTTC GGCAGCGGCA AGAC**CGT... | CCG**GGCGGCg ACaTgtccGA GCCCGTGA**CC CA | 693 |
| Human | CC **TGGGGCCTTC GGATGTGGCA AGAC**TGT... | CCC**GGTGGAg ACTTCtcAGA tCCCGTGA**CG AC | 688 |
| *T. congolense* | CC **TGGCGCGTTT GGATGCGGAA AGAC**GGT... | CCT**GGAGGTg ACTTTtctGA cCCAGTGA**CG TC | 692 |
| *P. falciparum* | CC **TGGTGCATTT GGTTGTGGAA AAAC**TTG... | CCA**GGTGGTg ATTTCtctGA cCCTGTAA**CT AC | 689 |
| *C. pneumoniae* | CC **AGGACCTTTT GGTGCAGGGA AAAC**AGT... | GCA**GGAGGAA ACTTTGAAGA ACCAGTCA**CT CA | 686 |
| Selected sequences for universal primers | **GGISSITTY GGIISIGGIA ARAC** | | 681 |
| Selected sequences for universal primers[a] | | **GGIGGIA AYTTYGARGA RCCIGTIAC**<br>**GGIGGIG AYWTIWSIGA ICCIGTIAC** | 682<br>683 |

The sequence numbering refers to the *Enterococcus hirae* atpD gene fragment (SEQ ID NO. 685).

Nucleotides in capitals are identical to the selected sequences or match those sequences.

Mismatches for SEQ ID NOs. 681 and 682 are indicated by lower-case letters.

Mismatches for SEQ ID NO. 683 are indicated by underlined nucleotides.

Dots indicate gaps in the sequences displayed.

"R" "Y" "M" "K" "W" and "S" designate nucleotide positions which are degenerated. "R" stands for A or G; "Y" stands for C or T; "M" stands for A or C; "K" stands for G or T; "W" stands for A or T; "S" stands for C or G. "I" stands for inosine which is a nucleotide analog that can bind to any of the four nucleotides A, C, G or T.

[a]These sequences are the reverse-complement of the selected primers.

Annex VI: Strategy for the selection of universal amplification/sequencing primers from tuf (M) sequences (organelle origin).

| | 601 635 | 1479 1511 | SEQ ID NO.: | Accession #: |
|---|---|---|---|---|
| *C. neoformans*[a] | AAG**AA CATGATCACC GGTaCCtCCC AGgctGA**CTG... | CGC**cgTCcGA GAcatGcGAC AGACcGTTGc** CGT | — | U81803 |
| *S. cerevisiae*[a] | AAG**AA CATGATTACT GGTaCTtCTC AAgctGA**CTG... | CGC**TgTCAGA GAcatGaGAC AAACTGTcGc** TGT | 665 | X00779 |
| *O. volvulus*[a] | AAG**AA TATGATCACA GGTaCTtCTC AGgctGA**CTG... | TGC**TgTGcGt GAtatGaGAC AAACaGTTGc** GGT | — | M64333 |
| *Human*[a] | AAA**AA CATGATTACA GGGaCAtCTC AGgctGA**CTG... | TGC**TgTTcGt GAtatGaGAC AGACaGTTGc** TGT | — | X03558 |
| *G. max* B1[b] | AAG**AA CATGATCACC GGCGCTGCCC AGATGGA**CGG... | TGC**TATTAGA GAAGGAGGCA AAACTGTTGG** AGC | — | Y15107 |
| *G. max* B2[b] | AAA**AA CATGATCACC GGCGCCGCCC AGATGGA**CGG... | TGC**TATTAGA GAAGGAGGCA AAACTGTTGG** AGC | — | Y15108 |
| *E. coli*[c] | AAA**AA CATGATCACC GGTGCTGCTC AGATGGA**CGG... | CGC**aATCcGt GAAGGGGCC GTACcGTTGG** CGC | 78 | — |
| *S. aureofaciens*[c] | AAG**AA CATGATCACC GGTGCCGCCC AGATGGA**CGG... | CGC**cATCcGt GAGGGTGGTC GTACcGTgGG** CGC | — | AF007125 |
| *E. tenella*[b] | AAA**AA TATGATTACA GGAGCAGCAC AAATGGA**TGG**...**TGC**TATAAGA GAAGGAGGAA AAACTATAGG** AGC | | — | AI755521 |
| *T. gondii*[b] | AAG**AA TATGATTACT GGAGCCGCAC AAATGGA**TGG**...** | TGC**TATTAGA GAAGGAGGTC GTACTATAGG** AGC | — | Y11431 |
| *S. cerevisiae*[b] | AAG**AA TATGATTACC GGTGCTGCTC AAATGGA**TGG**...** | CAA**TATCAGA GAGGGTGGAA GAACTGTTGG** TAC | 619 | K00428 |

-continued

Annex VI: Strategy for the selection of universal amplification/sequencing primers from tuf (M) sequences (organelle origin).

| | 601 … 635 | 1479 … 1511 | SEQ ID NO.: | Accession #: |
|---|---|---|---|---|
| *A. thaliana*[b] | AAAAA TATGATTACT GGAGCTGCGC AAATGGATGG... | TGCctTAAGG GAAGGAGGTA GAACaGTTGG AGC | — | X89227 |
| Selected sequence for universal primer | AA YATGATIACI GGIGCIGCIC ARATGGA | | 664 | |
| Selected sequences for universal primers | | TATIAGR GARGGIGGIM RIACTRTWGG[d] | 652 | |
| | | ATCCGT GAGGGYGGCC GITCIGT[d] | 561 | |

The sequence numbering refers to the *Saccharomyces cerevisiae* tuf (M) gene (SEQ ID NO. 619).

Nucleotides in capitals are identical to the selected sequences or match those sequences.

Mismatches for SEQ ID NOs. 652 and 664 are indicated by lower-case letters.

Mismatches for SEQ ID NO. 561 are indicated by underlined nucleotides.

Dots indicate gaps in the sequences displayed.

"R" "Y" "M" "K" "W" and "S" designate nucleotide positions which are degenerated. "R" stands for A or G; "Y" stands for C or T; "M" stands for A or C; "K" stands for G or T; "W" stands for A or T; "S" stands for C or G. "I" stands for inosine which is a nucleotide analog that can bind to any of the four nucleotides A, C, G or T.

[a]This sequence refers to tuf(EF-1) gene.

[b]This sequence refers to tuf (M) or organelle gene.

[c]This sequence refers to tuf gene from bacteria.

[d]These sequences are the reverse-complement of the selected primers.

Annex VII: Strategy for the selection of eukaryotic sequencing primers from tuf (EF-1) sequences.

| | 154 … 179 | 286 … 314 | SEQ ID NO.: | Accession #: |
|---|---|---|---|---|
| *S. cerevisiae* | GG TTCTTTCAAG TACGCTTGGG TTTT... | AGAGA TTTCATCAAG AACATGATTA CTGG... | 665 | X00779 |
| *B. hominis* | GG CTCCTTCAAG TACGCGTGGG TGCT... | CGTGA CTTCATaAAG AACATGATCA CGGG... | — | D64080 |
| *C. albicans* | GG TTCTTTCAAA TACGCTTGGG TCTT... | AGAGA TTTCATCAAG AATATGATCA CTGG... | — | M29934 |
| *C. neoformans* | TC TTCTTTCAAG TACGCTTGGG TTCT... | CGAGA CTTCATCAAG AACATGATCA CCGG... | — | U81803 |
| *E. histolytica* | GG ATCATTCAAA TATGCTTGGG TCTT... | AGAGA TTTCATTAAG AACATGATTA CTGG... | — | M92073 |
| *G. lamblia* | GG CTCCTTCAAG TACGCGTGGG TCCT... | CGCGA CTTCATCAAG AACATGATCA CGGG... | — | D14342 |
| *H. capsulatum* | AA ATCCTTCAAA TATGCGTGGG TCCT... | CGTGA CTTCATCAAG AACATGATCA CTGG... | — | U14100 |
| *Human* | GG CTCCTTCAAG TATGCCTGGG TCTT... | AGAGA CTTtATCAAA AACATGATTA CAGG... | — | X03558 |
| *L. braziliensis* | GC GTCCTTCAAG TACGCGTGGG TGCT... | CGCGA CTTCATCAAG AACATGATCA CCGG... | — | U72244 |
| *O. volvulus* | GG CTCATTTAAA TATGCTTGGG TATT... | CGTGA TTTCATTAAG AATATGATCA CAGG... | — | M64333 |
| *P. berghei* | GG TagTTTCAAA TATGCATGGG TTTT... | AAAcA TTTtATTAAA AATATGATTA CTGG... | — | AJ224150 |
| *P. knowlesi* | GG AagTTTTAAG TACGCATGGG TGTT... | AAGGA TTTCATTAAA AATATGATTA CCGG... | — | AJ224153 |
| *S. pombe* | GG TTCCTTCAAG TACGCCTGGG TTTT... | CGTGA TTTCATCAAG AACATGATTA CCGG... | — | U42189 |

-continued

Annex VII: Strategy for the selection of eukaryotic sequencing primers from tuf (EF-1) sequences.

| | | | |
|---|---|---|---|
| *T. cruzi* | TC **TTCTTTCAAG TACGCGTGGG T**CTT...CGC**GA CTTCATCAAG AACATGATCA C**GGG... | — | L76077 |
| *Y. lipolytica* | GG **TTCTTTCAAG TACGCTTGGG T**TCT...CGA**GA TTTCATCAAG AACATGATCA C**CGG... | — | AF054510 |
| Selected sequences for amplification primers | **TCITTYAAR TAYGCITGGG T**<br>**GA YTTCATYAAR AAYATGATYA C**<br>**GA YTTCATIAAR AAYATGAT** | 558<br>560<br>653 | |

The sequence numbering refers to the *Saccharomyces cerevisiae* tuf (EF-1) gene fragment (SEQ ID NO. 665).
Nucleotides in capitals are identical to the selected sequences SEQ ID NOs. 558, 560 or 653, or match-those sequences.
Mismatches for SEQ ID no. 558 and 560 are indicated by lower-case letters.
Mismatches for SEQ ID NO. 653 are indicated by underlined nucleotides.
Dots indicate gaps in the sequences displayed.
"R" "Y" "M" "K" "W" and "S" designate nucleotide positions which are degenerated. "R" stands for A or G; "Y" stands for C or T; "M" stands for A or C; "K" stands for G or T; "W" stands for A or T; "S" stands for C or G. "I" stands for inosine which is a nucleotide analog that can bind to any of the four nucleotides A, C, G or T.

| | 751 776 1276 1304 | SEQ ID NO.: | Accession #: |
|---|---|---|---|
| *S. cerevisiae* | ...GTT**TACAA GATCGGTGGT ATTGG**TAC...GAC**ATG AGACAAACTG TCGCTGTCGG** TGT | 665 | X00779 |
| *B. hominis* | ...GTG**TACAA GATTGGCGGT ATTGG**TAC...GAT**ATG AGACAGACTG TCGCTGTCGG** TAT | — | D64080 |
| *C. albicans* | ...GTT**TACAA GATCGGTGGT ATTGG**TAC...GAT**ATG AGACAAACCG TTGCTGTtGG** TGT | — | M29934 |
| *C. neoformans* | ...GTC**TACAA GATCGGTGGT ATCGG**CAC...GAC**ATG CGACAGACCG TTGCCGTtGG** TGT | — | U81803 |
| *E. histolytica* | ...GTT**TACAA GATTTcAGGT ATTGG**AAC...GAT**ATG AaACAAACCG TTGCTGTtGG** AGT | — | M92073 |
| *G. lamblia* | ...GTC**TACAA GATCTcGGGc gTCGG**GAC...~~~~~~ ~~~~~~~~~~ ~~~~~~~~~~ ~~~ | — | D14342 |
| *H. capsulatum* | ...GTG**TACAA AATCTcTGGT ATTGG**CAC...GAC**ATG AGACAAACCG TCGCTGTCGG** TGT | — | U14100 |
| *Human* | ...GTC**TACAA AATTGGTGGT ATTGG**TAC...GAT**ATG AGACAGACAG TTGCgGTgGG** TGT | — | X03558 |
| *L. braziliensis* | ...GTG**TACAA GATCGGC**GGT ATCGGCAC...GAC**ATG CGCagAACGG TCGCCGTCGG** CAT | — | U72244 |
| *O. volvulus* | ...GTT**TACAA AATTGGAGGT ATTGG**AAC...GAT**ATG AGACAAACAG TTGCTGTtGG** CGT | — | M64333 |
| *P. berghei* | ...GTA**TACAA AATTGGTGGT ATTGG**TAC...GAT**ATG AGACAAACAA TTGCTGTCGG** TAT | — | AJ224150 |
| *P. knowlesi* | ...GTA**TACAA AATCGGTGGT ATTGG**TAC...GAT**ATG AGACAAACCA TTGCTGTCGG** TAT | — | AJ224153 |
| *S. pombe* | ...GTT**TACAA GATCGGTGGT ATTGG**TAC...GAC**ATG CGTCAAACCG TCGCTGTCGG** TGT | — | U42189 |
| *T. cruzi* | ...GTG**TACAA GATCGGCGGT ATCGG**CAC...GAC**ATG CGCCAGACGG TCGCCGTCGG** CAT | — | L76077 |
| *Y. lipolytica* | ...GTC**TACAA GATCGGTGGT ATCGG**CAC...GAC**ATG CGACAGACCG TTGCTGTCGG** TGT | — | AF054510 |
| Selected sequence for amplification primer | **TACAA RATYKGIGGT ATYGG** | 654 | |
| Selected sequences for amplification primers[a] | **TACAA RATYKGIGGT ATYGG**<br>**ATG MGICARACIR TYGCYGTCGG** | 655<br>559 | |

The sequence numbering refers to the *Saccharomyces cerevisiae* tuf (EF-1) gene fragment (SEQ ID NO. 665).
Nucleotides in capitals are identical to the selected sequences or match those sequences.
Mismatches are indicated by lower-case letters.
"~" indicate incomplete sequence data.
Dots indicate gaps in the sequences displayed.
"R" "Y" "M" "K" "W" and "S" designate nucleotide positions which are degenerated. "R" stands for A or G; "Y" stands for C or T; "M" stands for A or C; "K" stands for G or T; "W" stands for A or T; "S" stands for C or G. "I" stands for inosine which is a nucleotide analog that can bind to any of the four nucleotides A, C, G or T.
[a]This sequences are the reverse-complement of the selected primers.

Annex VIII: Strategy for the selection of *Streptococcus agalactiae*-specific amplification primers from tuf sequences.

| | 305 334 517 542 | SEQ ID NO.: | Accession #: |
|---|---|---|---|
| *S. agalactiae* | CCAGAA CGTGATACTG ACAAACCTTT ACTT...GGAC AACGTTGGTG TTCTTCTTCG TG | 207 | — |
| *S. agalactiae* | CCAGAA CGTGATACTG ACAAACCTTT ACTT...GGAC AACGTTGGTG TTCTTCTTCG TG | 208 | — |
| *S. agalactiae* | CCAGAA CGTGATACTG ACAAACCTTT ACTT...GGAC AACGTTGGTG TTCTTCTTCG TG | 209 | — |
| *S. agalactiae* | CCAGAA CGTGATACTG ACAAACCTTT ACTT...GGAC AACGTTGGTG TTCTTCTTCG TG | 210 | — |
| *S. anginosus* | CCAGAA CGTGAcACTG ACAAACCaTT gCTT...AGAt AACGTaGGgG TTCTTCTTCG TG | 211 | — |
| *S. anginosus* | CCAGAA CGTGATACTG ACAAACCaTT gCTT...AGAt AACGTaGGgG TTCTTCTTCG TG | 221 | — |
| *S. bovis* | CCAaAA CGTGATACTG ACAAACCaTT gCTT...GGAt AACGTTGGTG TTCTTCTTCG TG | 212 | — |
| *S. gordonii* | CCAGAA CGTGAcACTG ACAAACCaTT gCTT...AGAt AAtGTaGGTG TcCTTCTTCG TG | 223 | — |
| *S. mutans* | CCAGAA CGTGATACTG ACAAgCCgcT cCTT...GGAt AAtGTTGGTG TTCTcCTTCG TG | 224 | — |
| *S. pneumoniae* | CCAGAA CGTGAcACTG ACAAACCaTT gCTT...AGAt AACGTaGGTG TcCTTCTTCG TG | 145[a] | |
| *S. sanguinis* | CCAGAA CGcGATACTG ACAAgCCaTT gCTT...GGAC AACGTaGGTG TgCTTCTcCG TG | 227 | — |
| *S. sobrinus* | CCAaAA CGcGATACTG AtAAgCCaTT gCTT...AGAt AACGTTGGTG TgCTTCTTCG TG | 228 | — |
| *B. cepacia* | CCGGAg CGTGcagtTG ACggcgCgTT cCTG...CGAC AACGTTGGTa TcCTgCTgCG cG | 16 | — |
| *B. fragilis* | CCTccg CGcGATgtTG AtAAACCTTT ctTG...TGAC AACGTaGGTc TgtTgCTTCG TG | — | P33165 |
| *B. subtilis* | CCAGAA CGcGAcACTG AaAAACCaTT caTG...TGAC AACaTTGGTG ccCTTCTTCG cG | — | Z99104 |
| *C. diphtheriae* | CCAGAg CGTGAgACcG ACAAgCCaTT cCTC...CGAC AACtgTGGTc TgCTTCTcCG TG | 662 | — |
| *C. trachomatis* | CCAGAA aGaGAaAtTG ACAAgCCTTT cTTA...AGAg AAtGTTGGat TgCTcCTcaG aG | 22 | — |
| *E. coli* | CCAGAg CGTGcgAtTG ACAAgCCgTT cCTg...TGAg AACGTaGGTG TTCTgCTgCG TG | 78 | — |
| *G. vaginalis* | CCAact CacGATctTG ACAAgCCaTT cTTg...CGAt RACacTGGTc TTCTTCTcCG cG | 135[a] | |
| *S. aureus* | CCAGAA CGTGATtCTG ACAAACCaTT cATg...TGAC AACaTTGGTG catTatTaCG TG | 179 | — |
| Selected sequence for species-specific primer | GAA CGTGATACTG ACAAACCTTT A | 549 | |
| Selected sequence for species-specific primer[b] | C AACGTTGGTG TTCTTCTTC | 550 | |

The sequence numbering refers to the *Streptococcus agalactiae* tuf gene fragment (SEQ ID NO. 209).

Nucleotides in capitals are identical to the selected sequences or match those sequences.

Mismatches are indicated by lower-case letters.

Dots indicate gaps in the sequences displayed.

"R" "Y" "M" "K" "W" and "S" designate nucleotide positions which are degenerated. "R" stands for A or G; "Y" stands for C or T; "M" stands for A or C; "K" stands for G or T; "W" stands for A or T; "S" stands for C or G. "I" stands for inosine which is a nucleotide analog that can bind to any of the four nucleotides A, C, G or T.

[a]The SEQ ID NO. refers to previous patent publication WO98/20157.

[b]This sequence is the reverse-complement of the selected primer.

Annex IX: Strategy for the selection of *Streptococcus agalactiae*-specific hybridization probes from tuf sequences.

| | 401 431 433 470 | SEQ ID NO.: | Accession #: |
|---|---|---|---|
| *S. acidominimus* | GGTACTGT TaaaGTtAAt GACGAAGTTG AAATCGTTGG TATcAAAGAc GAaATCtctA AAGCAGTTGT TA | 206 | |
| *S. agalactiae* | GGTACTGT TCGTGTCAAC GACGAAGTTG AAATCGTTGG TATTAAAGAA GATATCCAAA AAGCAGTTGT TA | 209 | |

-continued

Annex IX: Strategy for the selection of *Streptococcus agalactiae*-specific hybridization probes from tuf sequences.

| | 401 431 433 470 | SEQ ID NO.: | Accession #: |
|---|---|---|---|
| *S. agalactiae* | GGTACTGT TCGTGTCAAC GACGAAGTTG AAATCGTTGG TATTAAAGAA GATATCCAAA AAGCAGTTGT TA | 144[a] | |
| *S. agalactiae* | GGTACTGT TCGTGTCAAC GACGAAGTTG AAATCGTTGG TATTAAAGAA GATATCCAAA AAGCAGTTGT TA | 207 | |
| *S. agalactiae* | GGTACTGT TCGTGTCAAC GACGAAGTTG AAATCGTTGG TATTAAAGAA GATATCCAAA AAGCAGTTGT TA | 210 | |
| *S. agalactiae* | GGTACTGT TCGTGTCAAC GACGAAGTTG AAATCGTTGG TATTAAAGAA GATATCCAAA AAGCAGTTGT TA | 208 | |
| *S. anginosus* | GGTACTGT TaaaGTCAAC GACGAAGTTG AAATCGTTGG TATccgtGAt GAaATCCAAA AAGCAGTTGT TA | 211 | |
| *S. anginosus* | GGTACTGT TaaaGTCAAC GAtGAAGTTG AAATCGTTGG TATccgcGAg GAaATCCAAA AAGCAGTTGT TA | 221 | |
| *S. bovis* | GGTACTGT TaaaGTCAAC GACGAAGTTG AAATCGTTGG TATccgtGAc GAcATCCAAA AAGCtGTTGT TA | 212 | |
| *S. anginosus* | GGTACTGT TaaaGTCAAt GAtGAAGTTG AAATtGTTGG TATTcgtGAc GAaATCCAAA AAGCAGTTGT TA | 213 | |
| *S. cricetus* | GGTACTGT TaagGTCAAt GACGAAGTTG AAATCGTTGG TATcAAgGAc GAaATCCAAA AAGCgGTTGT TA | 214 | |
| *S. cristatus* | GGTACTGT TCGTGTCAAC GAtGAAaTcG AAATCGTTGG TATcAAAGAA GAaATCCAAA AAGCAGTTGT TA | 215 | |
| *S. downei* | GGTACTGT TaagGTCAAC GACGAAGTTG AAATCGTTGG TATcAAgGAc GAaATCCAAA AAGCAGTTGT TA | 216 | |
| *S. dysgalactiae* | GGTACTGT TCGTGTCAAC GACGAAaTcG AAATCGTTGG TATcAAAGAA GAaActaAAA AAGCtGTTGT TA | 217 | |
| *S. equi equi* | GGTACTGT TCGTGTtAAC GACGAAaTcG AAATCGTTGG TATcAgAGAc GAgATCaAAA AAGCAGTTGT TA | 218 | |
| *S. ferus* | GGTACTGT aaGaGTCAAC GAtGAAGTTG AAATCGTTGG TATcAAAGAc GAaATCactA AAGCAGTTGT TA | 219 | |
| *S. gordonii* | GGTAtcGT TaaaGTCAAt GACGAAaTcG AAATCGTTGG TATcAAAGAA GAaATCCAAA AAGCAGTTGT TA | 220 | |
| *S. macacae* | GGTACTGT TaagGTtAAt GAtGAAGTTG AAATCGTTGG TATTcgtGAc GATATtCAAA AAGCAGTTGT TA | 222 | |
| *S. gordonii* | GGTAtcGT TaaaGTCAAC GACGAAaTcG AAATCGTTGG TATcAAAGAA GAaActCAAA AAGCAGTTGT TA | 223 | |
| *S. mutans* | GGTACTGT TaaaGTtAAC GAtGAAGTTG AAATCGTTGG TATccgtGAt GAcATtCAAA AAGCtGTTGT TA | 224 | |
| *S. oralis* | GGTACTGT TCGTGTCAAC GACGAAaTcG AAATCGTTGG TATcAAAGAA GAaActCAAA AAGCAGTTGT TA | — | P33170 |
| *S. parasanguinis* | GGTgtTGT TCGTGTCAAt GAtGAAaTcG AAATCGTTGG TATcAAAGAA GAaATCCAAA AAGCAGTTGT TA | 225 | |
| *S. pneumoniae* | GGTAtcGT TaaaGTCAAC GACGAAaTcG AAATCGTTGG TATcAAAGAA GAaActCAAA AAGCAGTTGT TA | 145[a] | |
| *S. pyogenes* | GGTACTGT TCGTGTCAAC GACGAAaTcG AAATCGTTGG TATcAAAGAA GAaActaAAA AAGCtGTTGT TA | — | Genome project |
| *S. ratti* | GGTACTGT TaaaGTCAAt GACGAAGTTG AAATCGTTGG TATccgtGAt GAcATCCAAA AAGCtGTTGT TA | 226 | |
| *S. salivarius* | GGTgtTGT TCGTGTCAAt GACGAAGTTG AAATCGTTGG TcTTAAAGAA GAcATCCAAA AAGCAGTTGT TA | 146[a] | |
| *S. sanguinis* | GGTAtcGT TaaaGTCAAC GACGAAaTcG AAATCGTTGG TATcAAAGAA GAaATCCAAA AAGCAGTTGT TA | 227 | |
| *S. sobrinus* | GGTACTGT TaagGTtAAC GACGAAGTTG AAATCGTTGG TATccgtGAc GATATCCAAA AAGCAGTTGT TA | 228 | |
| *S. suis* | GGTACTGT TCGTGTCAAC GACGAAaTcG AAATCGTTGG TcTTcAAGAA GAaAaatctA AAGCAGTTGT TA | 229 | |
| *S. uberis* | GGTACTGT TCGTGTCAAC GACGAAaTTG AAATCGTTGG TATcAAAGAA GAaActaAAA AAGCAGTTGT TA | 230 | |

-continued

Annex IX: Strategy for the selection of *Streptococcus agalactiae*-specific hybridization probes from tuf sequences.

| | 401 431 433 470 | SEQ ID NO.: | Accession #: |
|---|---|---|---|
| *S. vestibularis* | GGT**gtTGT TCGTGTtAAt GACGAAGTTG AAA**T**CGTTGG TcTTAAAGAA GAaATCCAAA AAGCAGTTG**T TA | 231 | |
| Selected sequences for species-specific hybridization probes[b] | **ACTGT TCGTGTCAAC GACGAAGTTG AAA** | 582 | |
| | **CGTTGG TATTAAAGAA GATATCCAAA AAGCAGTTG** | 583 | |

The sequence numbering refers to the *Streptococcus agalactiae* tuf gene fragment (SEQ ID NO. 209).
Nucleotides in capitals are identical to the selected sequences or match those sequences.
Mismatches are indicated by lower-case letters.
Dots indicate gaps in the sequences displayed.
[a]The SEQ ID NO. refers to previous patent publication WO98/20157.
[b]These sequences are the reverse-complement of the selected probes.

Annex X: Strategy for the selection of *Streptococcus agalactiae*-specific amplification primers from atpD sequences.

| | 39 80 203 234 368 399 | SEQ ID NO.: |
|---|---|---|
| *S. agalactiae* | TT GATTGTCTAT AAAAATGGCG ATAAGTCACA AAAAGTAGTA...TAAGGATA CTTTGGGTCG TGTCTTCAAC GTTC...CTT ATTAGCACCT TACTTAAAAG GTGGTAAAG | 380 |
| *S. agalactiae* | TT GATTGTCTAT AAAAATGGCG ATAAGTCACA AAAAGTAGTA...TAAGGATA CTTTGGGTCG TGTCTTCAAC GTTC...CTT ATTAGCACCT TACTTAAAAG GTGGTAAAG | 379 |
| *S. agalactiae* | TT GATTGTCTAT AAAAATGGCG ATAAGTCACA AAAAGTAGTA...TAAGGATA CTTTGGGTCG TGTCTTCAAC GTTC...CTT ATTAGCACCT TACTTAAAAG GTGGTAAAG | 381 |
| *S. agalactiae* | TT GATTGTCTAT AAAAATGGCG ATAAGTCACA AAAAGTAGTA...TAAGGATA CTTTGGGTCG TGTCTTCAAC GTTC...CTT ATTAGCACCT TACTTAAAAG GTGGTAAAG | 382 |
| *S. agalactiae* | TT GATTGTCTAT AAAAATGGCG ATAAGTCACA AAAAGTAGTA...TAAGGATA CTTTGGGTCG TGTCTTCAAC GTTC...CTT ATTAGCACCT TACTTAAAAG GTGGTAAAG | 383 |
| *S. bovis* | TT GATTGTtTAT AAAgATGGCG ATAAGTCtCA AAAAaTcGTg...TAAaGAaA CTTTGGGTCG TGTgTTtAAt GTTC...CcT tcTtGCcCCT TACcTAAAAG GTGGTAAAG | —[a] |
| *S. salivarius* | TT GgTcGTtTAT ActgATGaac AaAAGTCtaA AcgtaTcGTg...TAAaGATA CccTtGGaCG TGTCTTtAAC GTTC...CTT gcTAGCcCCT TACcTtAAgG GTGGTAAAG | 387 |
| *S. pneumoniae* | cT tgTcGTCTAc AAAAATGaCG AaAgaaaAac AAAAaTcGTc...TAAaGAaA CTTTGGGaCG TGTCTTCAAC GTTt...CcT tcTtGCcCCT TACcTtAAAG GTGGTAAAG | —[b] |
| *S. pyogenes* | TT GATTGTtTAT AAAgATaGtG ATAAaaagCA AAAAaTcGTc...TAAaGAaA CTTTGGGaCG cGTCTTtAAt GTaC...CcT tcTtGCcCCT TACcTtAAAG GTGGTAAAG | —[c] |
| *S. anginosus* | cT tgTaGTCTAT AAAAATGaCG AaAAtaaAtc AAAAaTcGTc...gAAaGAaA CacTtGGTCG cGTCTTtAAC GTTt...CcT tTTAGCcCCc TACcTcAAAG GTGGgAAAG | 386 |
| *S. sanguinis* | cT tgTaGTCTAT AAAAATGatG AgAAaaaAtc AAAAaTcGTc...aAAGGAaA CTcTaGGcCG gGTgTTCAAt GTTt...CcT gcTAGCACCT TAtcTgAAAG GTGGgAAAG | —[d] |
| *S. mutans* | TT GgTcGTtTAT AAAgATGGCG AcAAGTCtCA AAgAaTtGTt...aAAaGAaA CacTaGGTCG TGTCTTtAAt GTTC...CcT tcTtGCcCCT TAtcTtAAAG GTGGTAAAG | —[e] |
| *B. anthracis* | gT aAaacagagc AAcgAaaaCG gaAcaagcat tAActTAacA...TgAtGcaA CacTtGGTCG TGTaTTtAAC GTat...CTT AcTtGCtCCT TACaTtAAgG GTGGTAAga | 247 |
| *B. cereus* | gT aAaacaaagc AAcgAaaaCG g...aagcat gAActTAacA...TgAtGcaA CacTtGGaCG TGTaTTCAAC GTat...CTT AcTtGCtCCT TACaTtAAgG GTGGTAAga | 248 |
| *E. faecium* | TT agTTGTtTAT AAAAATGaCG AaAAtaaAtc AAAAGTtGTt...TAAaGAaA CaTTaGGTCG cGTaTTCAAC GTaC...tTT gcTtGCcCCa TAtTTAAAAG GTGGgAAAG | 292 |
| *E. gallinarum* | TT GATcGTtTAc AAAAAaGaCG AgAAaaaAac AAAAGTAGTA...aAcaGATA CTcTaGGcCG aGTaTTtAAt GTaC...tTT ATTAGCtCCT TACTTAAAAG GTGGTAAAG | 293 |
| *E. faecalis* | TT agTcGTtTAT AAAAATGGCG AagcaaaACA AAAAGTAGTA...TAAaGATA CaTTaGGTCG TGTgTTtAAC GTTt...CTT ATTAGCACCT TAtcTAAAAG GTGGTAAAG | 291 |
| *E. coli* | Ta cgaTGctctT gAggtgcaaa ATggtaatgA gcgtcTgGTg...TAAaGcgA CTcTGGGcCG TaTCaTgAAC GTaC...CcT gaTgtgtCCg TtCgctAAgG GcGGTAAAG | —[f] |
| *L. monocytogenes* | Ta tAaatctgAT gcAgAaGaaG caccaaCtag ccAAcTtact...TAcaGtaA CTcTtGGTCG TGTaTTtAAt GTat...CTT gcTAGCtCCT TACTTAAAAG GTGGTAAAa | 324 |
| *S. aureus* | gT tATTGatgtg cctAAaGaaG AaggtaCAat AcAAcTAacA...TgAtGAaA CaTTaGGTCG TGTaTTtAAt GTaC...tTT AcTAGCACCT TAtaTtAAAG GTGGTAAAa | 366 |

-continued

Annex X: Strategy for the selection of *Streptococcus agalactiae*-specific amplification primers from atpD sequences.

| | 39 | 80 203 | 234 368 | 399 | SEQ ID NO.: |
|---|---|---|---|---|---|
| *S. epidermidis* | ca cATcGaagtT cctAAaGaaG ATggagCgCt tcAAtTAacA | ...TgAcGtaA CTcTaGGaaG aGTgTTtAAC GTaC | ...CTT ATTAGCACCT TACaTAAAAG GTGGTAAAa | | 370 |
| Selected sequences for species-specific primer | ATTGTCTAT AAAAATGGCG ATAAGTC | | | | 627 |
| | AAAATGGCG ATAAGTCACA AAAAGTA | | | | 628 |
| Selected sequences for species-specific primers[g] | | GGATA CTTTGGGTCG TGTCTTCAAC G | | | 625 |
| | | | ATTAGCACCT TACTTAAAAG GTGGTA | | 626 |

The sequence numbering refers to the *Streptococcus agalactiae* tuf gene fragment (SEQ ID NO. 380).
Nucleotides in capitals are identical to the selected sequences or match those sequences.
Mismatches are indicated by lower-case letters.
Dots indicate gaps in the sequences displayed.
[a,d,e,f]These sequences were obtained from Genbank and have accession #: a = AB009314, d = AF001955, e = U31170, and f = V00311.
[b,c]These sequences were obtained from genome sequencing projects.
[g]These sequences are the reverse-complement of the selected primers.

Annex XI: Strategy for the selection of *Candida albicans*/*dubliniensis*-specific amplification primers, *Candida albicans*-specific hybridization probe and *Candida dubliniensis*-specific hybridization probe from tuf sequences.

| | 337 — 368 403 — 428 460 — 491 | SEQ ID NO.: | Accession #: |
|---|---|---|---|
| *C. albicans* | CGTC AAGAAGGTTG GTTACAACCC AAAGACTG...CAACATGA TTGAACCATC CACCAACT...C AAATCCGGTA AAGTTACTGG TAAGACCTTG T | 624 | — |
| *C. albicans* | CGTC AAGAAGGTTG GTTACAACCC AAAGACTG...CAACATGA TTGAACCATC CACCAACT...C AAATCCGGTA AAGTTACTGG TAAGACCTTG T | 409 | — |
| *C. albicans* | CGTC AAGAAGGTTG GTTACAACCC AAAGACTG...CAACATGA TTGAACCATC CACCAACT...C AAATCCGGTA AAGTTACTGG TAAGACCTTG T | 410 | — |
| *C. albicans* | CGTC AAGAAGGTTG GTTACAACCC AAAGACTG...CAACATGA TTGAACCATC CACCAACT...C AAATCCGGTA AAGTTACTGG TAAGACCTTG T | 407 | — |
| *C. albicans* | CGTC AAGAAGGTTG GTTACAACCC AAAGACTG...CAACATGA TTGAACCATC CACCAACT...C AAATCCGGTA AAGTTACTGG TAAGACCTTG T | 408 | — |
| *C. dubliniensis* | CGTC AAGAAGGTTG GTTACAACCC AAAGACTG...CAACATGA TTGAAgCtTC CACCAACT...C AAATCCGGTA AgGTTACTGG TAAGACCTTG T | 412 | — |
| *C. dubliniensis* | CGTC AAGAAGGTTG GTTACAACCC AAAGACTG...CAACATGA TTGAAgCtTC CACCAACT...C AAATCCGGTA AgGTTACTGG TAAGACCTTG T | 414 | — |
| *C. dubliniensis* | CGTC AAGAAGGTTG GTTACAACCC AAAGACTG...CAACATGA TTGAAgCtTC CACCAACT...C AAATCCGGTA AgGTTACTGG TAAGACCTTG T | 415 | — |
| *C. glabrata* | CATC AAGAAGGTcG GTTACAACCC AAAGACTG...CAACATGA TTGAAgCcaC CACCAACG...C AAggCtGGTg tcGTcAagGG TAAGACCTTG T | 417 | — |
| *C. guilliermondii* | CGTC AAGAAGGTTG GTTACAACCC tAAGACTG...CAACATGA TTGAggCtTC tACCAACT...C AAggCtGGTA AgtccACcGG TAAGACtTTG T | 418 | — |
| *C. kefyr* | CATC AAGAAGGTcG GTTACAACCC AAAGAATG...CAACATGA TTGAAgCcaC CACCAACG...C AAggCtGGTA ccGTcAagGG TAAGACCTTG T | 421 | — |
| *C. krusei* | CATC AAGAAGGTTG GTTACAACCC AAAGACTG...CAACATGA TTGAAgCATC CACCAACT...C AAggCaGGTg ttGTTAagGG TAAGACCTTA T | 422 | — |
| *C. lusitaniae* | CGTC AAGAAGGTTG GTTACAACCC tAAGACTG...CAACATGA TTGAgCCATC YACCAACT...C AAgTCYGGTA AgtccACcGG TAAGACCTTG T | 424 | — |
| *C. neoformans* | CATC AAGAAGGTTG GTTACAACCC cAAGgCTG...CAACATGt TgGAggagaC CACCAAGT...C AAgTCtGGTg tttccAagGG TAAGACCcTC C | 623 | — |
| *C. parapsilosis* | CGTC AAGAAGGTTG GTTACAACCC tAAagCTG...CAAtATGA TTGAACCATC aACCAACT...T AAAgCtGGTA AgGTTACcGG TAAGACCTTG T | 426 | — |
| *C. tropicalis* | CGTC AAGAAGGTTG GTTACAACCC tAAGgCTG...CAACATGA TTGAAgCtTC tACCAACT...C AAggCtGGTA AgGTTACcGG TAAGACtTTG T | 429 | — |
| *A. fumigatus* | CATC AAGAAGGTcG GcTACAACCC cAAGgCCG...CAACATGc TTGAgCCcTC CtCCAACT...C AAggCCGGcA AgGTcACTGG TAAGACCcTC A | 404 | — |
| Human | CATt AAGAAaaTTG GcTACAACCC cgAcACAG...CAACATGc TgGAgCCAag tgCtAACA...T AAggatGGcA AtGccAgTGG aAccACgcTG C | — | X03558 |
| *P. anomala* | TATC AAGAAaGTTG GTTACAACCC AAAaACTG...TAACATGA TTGAACCATC aWCtAACT...C AAAgCtGGTg AAGcTAaaGG TAAaACtTTA T | 447 | — |

-continued

Annex XI: Strategy for the selection of *Candida albicans/dubliniensis*-specific amplification primers, *Candida albicans*-specific hybridization probe and *Candida dubliniensis*-specific hybridization probe from tuf sequences.

| | 337 368 403 428 460 491 | SEQ ID NO.: | Accession #: |
|---|---|---|---|
| *S. cerevisiae* | TATC AAGAAGGTTG GTTACAACCC AAAGACTG...CAACATGA TTGAAgCtaC CACCAACG...C AAggCCGGTg tcGTcAagGG TAAGACtTTG T | 622 | — |
| *S. pombe* | CATC AAGAAGGTcG GTTtCAACCC cAAGACCG...TAACATGA TTGAgCCcaC CACCAACA...C AAggCtGGTg tcGTcAagGG TAAGACtcTT T | — | U42189 |
| Selected sequence for species-specific amplification primer[a] | C AAGAAGGTTG GTTACAACCC AAAGA | | |
| Selected sequence for species-specific amplification primer[a,b] | ATCCGGTA AAGTTACTGG TAAGACCT | | |
| Selected sequences for species-specific hybridization probes | CATGA TTGAACCATC CACCA (*C. albicans*) | 577 | |
| | CATGA TTGAAGCTTC CACCA (*C. dubliniensis*) | 578 | |

The sequence numbering refers to the *Candida albicans* tuf gene fragment (SEQ ID NO. 408).

Nucleotides in capitals are identical to the selected sequences or match those sequences.

Mismatches for SEQ ID NO. 577 are indicated by lower-case letters.

Mismatches for SEQ ID NO. 578 are indicated by underlined nucleotides.

Dots indicate gaps in the sequences displayed.

"R" "Y" "M" "K" "W" and "S" designate nucleotide positions which are degenerated. "R" stands for A or G; "Y" stands for C or T; "M" stands for A or C; "K" stands for G or T; "W" stands for A or T; "S" stands for C or G. "I" stands for inosine which is a nucleotide analog that can bind to any of the four nucleotides A, C, G or T.

[a] *C. albicans* primers have been described in a previous patent (publication WO98/20157, SEQ ID NOs. 11-12)

[b] This sequence is the reverse-complement of the selected primer.

Annex XII: Strategy for the selection of *Staphylococcus*-specific amplification primers from tuf sequences.

| | 310 ... 340 652 ... 682 | SEQ ID NO.: | Ac-cession #: |
|---|---|---|---|
| *S. aureus* | A CAGGCCGTGT TGAACGTGGT CAAATCAAAG...CACTTACCA GAAGGTACTG AAATGGTAAT GC | 179 | — |
| *S. aureus* | A CAGGCCGTGT TGAACGTGGT CAAATCAAAG...CACTTACC~ ~~~~~~~~~~ ~~~~~~~~~~ GC | 176 | — |
| *S. aureus* | A CAGGCCGTGT TGAACGTGGT CAAATCAAAG...CACTTACCA GAAGGTMCTG AAATGGTAAT GC | 177 | — |
| *S. aureus aureus* | A CAGGCCGTGT TGAACGTGGT CAAATCAAAG...CACTTACCA GAAGGTACTG AAATGGTAAT GC | 180 | — |
| *S. auricularis* | A CAGGCCGTGT TGAACGTGGT CAAATCAAAG...ActTTACCA GAAGGTACaG AAATGGTAAT GC | 181 | — |
| *S. capitis capitis* | A CAGGCCGTGT TGAACGTGGT CAAATCAAAG...AACTTACCA GAAGGTACTG AAATGGTTAT GC | 182 | — |
| *M. caseolyticus* | A CTGGaCGTGT TGAgCGTGGa CAAgTtAAAG...AACTTACCA GAAGGTACTG AAATGGTAAT GC | 183 | — |
| *S. cohnii* | A CAGGgCGTGT TGAACGTGGT CAAATCAAAG...ActTTACCA GAAGGTACTG AAATGGTTAT GC | 184 | — |
| *S. epidermidis* | A CAGGCCGTGT TGAACGTGGT CAAATCAAAG...~~~~~~~~~ ~~~~~~~~~~ ~~~~~~~~~~ ~~ | 185 | — |
| *S. epidermidis* | A CAGGCCGTGT TGAACGTGGT CAAATCAAAG...AACTTACCA GAAGGTACaG AAATGGTTAT GC | 141[a] | — |
| *S. haemolyticus* | A CAGGCCGTGT TGAACGTGGg CAAATCAAAG...AACTTACCA GAAGGTACTG AAATGGTTAT GC | 186 | — |
| *S. haemolyticus* | A CAGGtCGTGT TGAACGTGGT CAAATCAAAG...AACTTACCA GAAG~~~~~~ ~~~~~~~~~~ ~~ | 188 | — |
| *S. haemolyticus* | A CAGGCCGTGT TGAACGTGGT CAAATCAAAG...AACTTACCA GAAGGTACTG AAATGG~~~~ ~~ | 189 | — |
| *S. hominis hominis* | A CAGGCCGTGT TGAACGTGGT CAAATCAAAG...AACTTACCA GAAGGTACTG AAATGGTAAT GC | 191 | — |
| *S. hominis* | A CAGGCCGTGT TGAACGTGGT CAAATCAAAG...AACTTACCA GAAGGTACTG AAATGGTAAT GC | 193 | — |
| *S. hominis* | A CAGGCCGTGT TGAACGTGGT CAAATCAAAG...AACTTACCA GAAGG~~~~~ ~~~~~~~~~~ ~~ | 194 | — |
| *S. hominis* | A CAGGCCGTGT TGAACGTGGT CAAATCAAAG...AACTTACCA GAAGGTACTG AAATGGTAAT GC | 195 | — |
| *S. hominis* | A CAGGCCGTGT TGAACGTGGT CAAATCAAAG...AACTTACCA GAAGGTACTG AAATGGTAAT GC | 196 | — |
| *S. lugdunensis* | A CAGGCCGTGT TGAACGTGGT CAAATCAAAG...AACTTACCA GAAGGTACaG AAATGGTTAT GC | 197 | — |
| *S. saprophyticus* | A CAGGCCGTGT TGAACGTGGT CAAATCAAAG...~~~~~~~~~ ~~~~~~~~~~ ~~~~~~~~~~ ~~ | 198 | — |
| *S. saprophyticus* | A CAGGCCGTGT TGAACGTGGT CAAATCAAAG...AACTTACCA GAAGGTACTG AAATGGTTAT GC | 199 | — |
| *S. saprophyticus* | A CAGGCCGTGT TGAACGTGGT CAAATCAAAG...AACTTACCA GAAGGTACTG AAATGGTTAT GC | 200 | — |
| *S. sciuri sciuri* | A CAGGCCGTGT TGAACGTGGT CAAATCACTG...AACTTACCA GAAGGTACTG AAATGGTTAT GC | 201 | — |
| *S. warneri* | A CAGGCCGTGT TGAACGTGGT CAAATCAAAG...CAaTTACCA GAAGGTACTG ~~~~~~~~~~ ~~ | 187 | — |
| *S. warneri* | A CAGGCCGTGT TGAACGTGGT CAAATCAAAG...~~~~~~~~~ ~~~~~~~~~~ ~~~~~~~~~~ ~~ | 192 | — |
| *S. warneri* | A CAGGCCGTGT TGAACGTGGT CAAATCAAAG...CAaTTACCA GAAGGTACTG AAATGGTTAT GC | 202 | — |
| *B. subtilis* | A CTGGCCGTGT aGAACGcGGa CAAgTtAAAG...CAtcTtCCA GAAGGcgtaG AAATGGTTAT GC | — | Z99104 |
| *E. coli* | A CCGGtCGTGT aGAACGcGGT atcATCAAAG...GAacTgCCg GAAGGcgtaG AgATGGTAAT GC | 78 | — |

-continued

| Annex XII: Strategy for the selection of *Staphylococcus*-specific amplification primers from tuf sequences. | | | | |
|---|---|---|---|---|
| | 310 340 652 682 | | SEQ ID NO.: | Accession #: |
| *L. monocytogenes* | A CTGGaCGTGT TGAACGTGGa CAAgTtAAAG...AcacTtCCA GAAGGTACTG AAATGGTAAY GC | | 138[a] | — |
| Selected sequence for genus-specific primer | GGCCGTGT TGAACGTGGT CAAATCA | | 553 | |
| Selected sequences for genus-specific primers[b] | TTACCA GAAGGTACTG AAATGGTIA | | 575 | |
| | TTACCA GAAGGTACTG AAATGGTWA | | 707 | |

The sequence numbering refers to the *Staphylococcus aureus* tuf gene fragment (SEQ ID NO. 179).
Nucleotides in capitals are identical to the selected sequences or match those sequences.
Mismatches are indicated by lower-case letters.
"-" indicate incomplete sequence data.
Dots indicate gaps in the sequences displayed.
"R" "Y" "M" "K" "W" and "S" designate nucleotide positions which are degenerated. "R" stands for A or G; "Y" stands for C or T; "M" stands for A or C; "K" stands for G or T; "W" stands for A or T; "S" stands for C or G. "I" stands for inosine which is a nucleotide analog that can bind to any of the four nucleotides A, C, G or T.
[a]The SEQ ID NO. refers to previous patent publication WO98/20157.
[b]These sequences are the reverse-complement of the selected primers.

| Annex XIII: Strategy for the selection of the *Staphylococcus*-specific hybridization probe from tuf sequences. | | | |
|---|---|---|---|
| | 400 425 | SEQ ID NO.: | Accession #: |
| *S. aureus* | G TTGAAATGTT CCGTAAATTA TTAGA | 179 | — |
| *S. aureus* | G TTGAAATGTT CCGTAAATTA TTAGA | 176 | — |
| *S. aureus* | G TTGAAATGTT CCGTAAATTA TTAGA | 177 | — |
| *S. aureus* | G TTGAAATGTT CCGTAAATTA TTAGA | 178 | — |
| *S. aureus aureus* | G TTGAAATGTT CCGTAAATTA TTAGA | 180 | — |
| *S. auricularis* | G TAGAAATGTT CCGTAAATTA TTAGA | 181 | — |
| *S. capitis capitis* | G TAGAAATGTT CCGTAAATTA TTAGA | 182 | — |
| *M. caseolyticus* | G TAGAAATGTT CCGTAAATTA TTAGA | 183 | — |
| *S. cohnii* | G TAGAAATGTT CCGTAAATTA TTAGA | 184 | — |
| *S. epidermidis* | G TAGAAATGTT CCGTAAATTA TTAGA | 185 | — |
| *S. haemolyticus* | G TAGAAATGTT CCGTAAATTA TTAGA | 186 | — |
| *S. haemolyticus* | G TAGAAATGTT CCGTAAATTA TTAGA | 189 | — |
| *S. haemolyticus* | G TAGAAATGTT CCGTAAATTA TTAGA | 190 | — |
| *S. haemolyticus* | G TAGAAATGTT CCGTAAATTA TTAGA | 188 | — |
| *S. hominis* | G TAGAAATGTT CCGTAAATTA TTAGA | 196 | — |
| *S. hominis* | G TAGAAATGTT CCGTAAATTA TTAGA | 194 | — |
| *S. hominis hominis* | G TAGAAATGTT CCGTAAATTA TTAGA | 191 | — |
| *S. hominis* | G TAGAAATGTT CCGTAAATTA TTAGA | 193 | — |
| *S. hominis* | G TAGAAATGTT CCGTAAATTA TTAGA | 195 | — |
| *S. lugdunensis* | G TAGAAATGTT CCGTAAATTA TTAGA | 197 | — |
| *S. saprophyticus* | G TAGAAATGTT CCGTAAATTA TTAGA | 198 | — |

-continued

Annex XIII: Strategy for the selection of the *Staphylococcus*-specific hybridization probe from tuf sequences.

| | 400 425 | SEQ ID NO.: | Accession #: |
|---|---|---|---|
| *S. saprophyticus* | G TAGAAATGTT CCGTAAATTA TTAGA | 200 | — |
| *S. saprophyticus* | G TAGAAATGTT CCGTAAATTA TTAGA | 199 | — |
| *S. sciuri sciuri* | G TTGAAATGTT CCGTAAATTA TTAGA | 201 | — |
| *S. warneri* | G TAGAAATGTT CCGTAAgTTA TTAGA | 187 | — |
| *S. warneri* | G TAGAAATGTT CCGTAAgTTA TTAGA | 192 | — |
| *S. warneri* | G TAGAAATGTT CCGTAAgTTA TTAGA | 202 | — |
| *S. warneri* | G TAGAAATGTT CCGTAAgTTA TTAGA | 203 | — |
| *B. subtilis* | G TTGAAATGTT CCGTAAgcTt cTTGA | — | Z99104 |
| *E. coli* | G TTGAAATGTT CCGcAAAcTg cTGGA | 78 | — |
| *L. monocytogenes* | G TAGAAATGTT CCGTAAATTA cTAGA | 138[a] | — |
| Selected sequence for genus-specific hybridization probe | GAAATGTT CCGTAAATTA TT | 605 | |

The sequence numbering refers to the *Staphylococcus aureus* tuf gene fragment (SEQ ID NO. 179).
Nucleotides in capitals are identical to the selected sequence or match that sequence.
Mismatches are indicated by lower-case letters.
[a]The SEQ ID NO. refers to previous patent publication WO98/20157.

Annex XIV: Strategy for the selection of *Staphylococcus saprophyticus*-specific and of *Staphylococcus haemolyticus*-specific hybridization probes from tuf sequences.

| | 339 383 | SEQ ID NO.: |
|---|---|---|
| *S. aureus* | AG TtGGTGAAGA AgTtGAAATC ATcGGTtTaC ATGACACaTC TAA | 179 |
| *S. aureus* | AG TtGGTGAAGA AgTtGAAATC ATcGGTtTaC ATGACACaTC TAA | 176 |
| *S. aureus* | AG TtGGTGAAGA AgTtGAAATC ATcGGTtTaC ATGACACaTC TAA | 177 |
| *S. aureus* | AG TtGGTGAAGA AgTtGAAATC ATcGGTtTaC ATGACACaTC TAA | 178 |
| *S. aureus aureus* | AG TtGGTGAAGA AgTtGAAATC ATcGGTtTaC ATGACACaTC TAA | 180 |
| *S. auricularis* | AG TCGGTGAAGA AgTtGAAATC ATcGGTATga AaGACggTTC AAA | 181 |
| *S. capitis capitis* | AG TtGGTGAAGA AgTtGAAATC ATcGGTATCC AcGAaACTTC TAA | 182 |
| *M. caseolyticus* | AG TtGGTGAAGA AgTtGAAATC ATTGGTtTaa cTGAagaacC AAA | 183 |
| *S. cohnii* | AG TCGGTGAAGA AgTtGAAATC ATcGGTATgC AaGAagaTTC CAA | 184 |
| *S. epidermidis* | AG TtGGTGAAGA AgTtGAAATC ATcGGTATgC AcGAaACTTC TAA | 185 |
| *S. haemolyticus* | AG TtGGTGAAGA AgTtGAAATC ATTGGTATCC ATGACACTTC TAA | 186 |
| *S. haemolyticus* | AG TtGGTGAAGA AgTtGAAATC ATTGGTATCC ATGACACTTC TAA | 189 |
| *S. haemolyticus* | AG TtGGTGAAGA AgTtGAAATC ATTGGTATCC ATGACACTTC TAA | 190 |
| *S. haemolyticus* | AG TtGGTGAAGA AgTtGAAATt ATTGGTATCa AaGAaACTTC TAA | 188 |
| *S. hominis* | AG TtGGTGAAGA AgTtGAAATt ATTGGTATCa AaGAaACTTC TAA | 194 |
| *S. hominis hominis* | AG TtGGTGAAGA AgTtGAAATt ATTGGTATCa AaGAaACTTC TAA | 191 |
| *S. hominis* | AG TtGGTGAAGA AgTtGAAATt ATTGGTATCa AaGAaACTTC TAA | 193 |
| *S. hominis* | AG TtGGTGAAGA AgTtGAAATt ATTGGTATCa AaGAaACTTC TAA | 195 |

-continued

Annex XIV: Strategy for the selection of *Staphylococcus saprophyticus*-specific and of *Staphylococcus haemolyticus*-specific hybridization probes from tuf sequences.

| | 339 383 | SEQ ID NO.: |
|---|---|---|
| *S. hominis* | AG **TtGGTGAAGA AgTtGAAATt ATTGGTATCa AaGAtACTTC** TAA | 196 |
| *S. lugdunensis* | AG **TCGGTGAAGA AgTtGAAATt ATTGGTATCC AcGAtACTaC** TAA | 197 |
| *S. saprophyticus* | AG **TCGGTGAAGA AATCGAAATC ATcGGTATgC AaGAagaaTC** CAA | 198 |
| *S. saprophyticus* | AG **TCGGTGAAGA AATCGAAATC ATcGGTATgC AaGAagaaTC** CAA | 200 |
| *S. saprophyticus* | AG **TCGGTGAAGA AATCGAAATC ATcGGTATgC AaGAagaaTC** CAA | 199 |
| *S. sciuri sciuri* | TG **TtGGTGAAGA AgTtGAAATC ATcGGTtTaa cTGAagaaTC** TAA | 201 |
| *S. warneri* | AG **TtGGTGAAGA AgTtGAAATC ATcGGTtTaC ATGACACTTC** TAA | 187 |
| *S. warneri* | AG **TtGGTGAAGA AgTtGAAATC ATcGGTtTaC ATGACACTTC** TAA | 192 |
| *S. warneri* | AG **TtGGTGAAGA AgTtGAAATC ATcGGTtTaC ATGACACTTC** TAA | 202 |
| *S. warneri* | AG **TtGGTGAAGA AgTtGAAATC ATcGGTtTaC ATGACACTTC** TAA | 203 |
| *B. subtilis* | AG **TCGGTGAcGA AgTtGAAATC ATcGGTcTtC AaGAagagag** AAA | —[a] |
| *E. coli* | AG **TtGGTGAAGA AgTtGAAATC gTTGGTATCa AaGAgACTca** GAA | 78 |
| *L. monocytogenes* | AG **TtGGTGAcGA AgTaGAAgTt ATcGGTATCg AaGAagaaag** AAA | 138[b] |
| Selected sequences for species-specific hybridization probes | **CGGTGAAGA AATCGAAATC A** (*S. saprophyticus*)<br>(*S. haemolyticus*) **ATTGGTATCC ATGACACTTC** | 599<br>594 |

The sequence numbering refers to the *Staphylococcus aureus* tuf gene fragment (SEQ ID NO. 179).
Nucleotides in capitals are identical to the selected sequences or match those sequences.
Mismatches are indicated by lower-case letters.
[a]This sequence was obtained from Genbank accession #Z99104.
[b]The SEQ ID NO. refers to previous patent publication WO98/20157.

Annex XV: Strategy for the selection of *Staphylococcus aureus*-specific and of *Staphylococcus epidermidis*-specific hybridization probes from tuf sequences.

| | 521 547 592 617 | SEQ ID NO.: |
|---|---|---|
| *S. aureus* | TAC**ACCACA TACTGAATTC AAAG**CAG...TTC**TTCtCa AACTATCGtC CACA**ATT | 179 |
| *S. aureus* | TAC**ACCACA TACTGAATTC AAAG**CAG...TTC**TTCtC~ ~~~~~~~~~~ ~~~~**~~~ | 178 |
| *S. aureus* | TAC**ACCACA TACTGAATTC AAAG**CAG...TTC**TTCtCa AACTATCGtC CACA**ATT | 176 |
| *S. aureus* | TAC**ACCACA TACTGAATTC AAAG**CAG...TTCTTCtCa AACTATCGtC CACAATT | 177 |
| *S. aureus aureus* | TAC**ACCACA TACTGAATTC AAAG**CAG...TTC**TTCtCa AACTATCGtC CACA**ATT | 180 |
| *S. auricularis* | TAC**ACCACA cACTaAATTC ActG**CAG...TTC**TTCtCT AACTAcCGtC CACA**ATT | 181 |
| *S. capitis capitis* | CAC**ACCACA cACTaAATTC AAAG**CGG...TTC**TTCAgT AACTAcCGCC CACA**ATT | 182 |
| *M. caseolyticus* | TAC**tCCACA TACTaAATTC AAAG**CTG...TTC**TTCACT AACTAcCGCC CtCA**GTT | 183 |
| *S. cohnii* | TAC**ACCACA cACaaAcTTt AAAG**CGG...TTC**TTCAgT AACTATCGCC CACA**ATT | 184 |
| *S. epidermidis* | TAC**ACCACA cACaaAATTC AAAG**CTG...TTC**TTCACT AACTATCGCC CACA**ATT | 185 |
| *S. haemolyticus* | CAC**ACCtCA cACaaAATTt AAAG**CAG...TTC**TTCACa AACTATCGtC CACA**ATT | 186 |
| *S. haemolyticus* | CAC**ACCtCA cACaaAATTt AAAG**CAG...TTC**TTCACa AACTATCGtC CACA**ATT | 189 |
| *S. haemolyticus* | CAC**ACCtCA cACaaAATTt AAAG**CAG...TTC**TTCACa AACTATCGtC CACA**ATT | 190 |

-continued

Annex XV: Strategy for the selection of *Staphylococcus aureus*-specific and of *Staphylococcus epidermidis*-specific hybridization probes from tuf sequences.

| | 521 547 | 592 617 | SEQ ID NO.: |
|---|---|---|---|
| *S. haemolyticus* | TACACCtCA cACaaAATTC AAAGCAG... | TTCTTCACT AACTATCGtC CACAATT | 188 |
| *S. hominis* | CACACCtCA cACaaAATTC AAAGCAG... | TTCTTCACT AACTATCGtC CACAATT | 195 |
| *S. hominis* | TACACCtCA cACaaAATTC AAAGCAG... | TTCTTCACT AACTATCGtC CACAATT | 196 |
| *S. hominis hominis* | TACACCtCA cACaaAATTC AAAGCAG... | TTCTTCtCT AACTATCGtC CACAATT | 191 |
| *S. hominis* | TACACCtCA cACaaAATTC AAAGCAG... | TTCTTCtCT AACTATCGtC CACAATT | 193 |
| *S. hominis* | TACACCtCA cACaaAATTC AAAGCAG... | TTCTTCtCT AACTATCGtC CACAATT | 194 |
| *S. lugdunensis* | TACACCtCA cACTaAATTt AAAGCTG... | TTCTTCtCa AACTAcCGCC CACAATT | 197 |
| *S. saprophyticus* | TACACCACA TACaaAATTC AAAGCGG... | TTCTTCACT AACTAcCGCC CACAATT | 198 |
| *S. saprophyticus* | TACACCACA TACaaAATTC AAAGCGG... | TTCTTCACT AACTAcCGCC CACAATT | 199 |
| *S. saprophyticus* | TACACCACA TACaaAATTC AAAGCGG... | TTCTTCACT AACTAcCGCC CACAATT | 200 |
| *S. sciuri sciuri* | CACACCtCA cACTaAATTC AAAGCTG... | TTCTTCACa AACTAcCGCC CACAATT | 201 |
| *S. warneri* | TACACCACA TACaaAATTC AAAGCGG... | ~~~~~~~~~ ~~~~~~~~~~ ~~~~~~~ | 192 |
| *S. warneri* | TACACCACA TACaaAATTC AAAGCGG... | TTCTTCAgT AACTAcCGCC CACAATT | 187 |
| *S. warneri* | TACACCACA TACaaAATTC AAAGCGG... | TTCTTCAgT AACTAcCGCC CACAATT | 202 |
| *S. warneri* | TACACCACA TACaaAATTC AAAGCGG... | TTCTTCAgT AACTAcCGCC CACAATT | 203 |
| *B. subtilis* | CACtCCACA cAgcaAATTC AAAGCTG... | TTCTTCtCT AACTAcCGtC CtCAGTT | —[a] |
| *E. coli* | CAAgCCgCA cACcaAgTTC gAAtCTG... | TTCTTCAaa ggCTAcCGtC CgCAGTT | 78 |
| *L. monocytogenes* | TACtCCACA cACTaAcTTC AAAGCTG... | TTCTTCAac AACTAcCGCC CACAATT | 138[b] |
| Selected sequences for species-specific hybridization probes | ACCACA TACTGAATTC AAAG (*S. aureus*) | | 585 |
| | (*S. epidermidis*) | TTCACT AACTATCGCC CACA | 593 |

The sequence numbering refers to the *Staphylococcus aureus* tuf gene fragment (SEQ ID NO. 179).
Nucleotides in capitals are identical to the selected sequences or match those sequences.
Mismatches are indicated by lower-case letters.
"~" indicate incomplete sequence data.
Dots indicate gaps in the sequences displayed.
[a]This sequence was obtained from Genbank accession #Z99104.
[b]The SEQ ID NO. refers to previous patent publication WO98/20157.

Annex XVI: Strategy for the selection of the *Staphylococcus hominis*-specific hybridization probe from tuf sequences.

| | 358 383 | SEQ ID NO.: |
|---|---|---|
| *S. aureus* | ATC ATcGGTtTac AtGAcACaTC TAA | 179 |
| *S. aureus* | ATC ATcGGTtTac AtGAcACaTC TAA | 176 |
| *S. aureus* | ATC ATcGGTtTac AtGAcACaTC TAA | 177 |
| *S. aureus* | ATC ATcGGTtTac AtGAcACaTC TAA | 178 |
| *S. aureus aureus* | ATC ATcGGTtTac AtGAcACaTC TAA | 180 |
| *S. auricularis* | ATC ATcGGTATgA AAGAcggTTC AAA | 181 |
| *S. capitis capitis* | ATC ATcGGTATCc AcGAAACTTC TAA | 182 |
| *M. caseolyticus* | ATC ATTGGTtTaA ctGAAgaacC AAA | 183 |

-continued

Annex XVI: Strategy for the selection of the *Staphylococcus hominis*-specific hybridization probe from tuf sequences.

| | 358 383 | SEQ ID NO.: |
|---|---|---|
| *S. cohnii* | ATC **ATcGGTATgc AAGAAgaTTC** CAA | 184 |
| *S. epidermidis* | ATC **ATcGGTATgc AcGAAACTTC** TAA | 185 |
| *S. haemolyticus* | ATC **ATTGGTATCc AtGAcACTTC** TAA | 186 |
| *S. haemolyticus* | ATC **ATTGGTATCc AtGAcACTTC** TAA | 189 |
| *S. haemolyticus* | ATC **ATTGGTATCc AtGAcACTTC** TAA | 190 |
| *S. haemolyticus* | ATT **ATTGGTATCA AAGAAACTTC** TAA | 188 |
| *S. hominis* | ATT **ATTGGTATCA AAGAtACTTC** TAA | 196 |
| *S. hominis* | ATT **ATTGGTATCA AAGAAACTTC** TAA | 194 |
| *S. hominis hominis* | ATT **ATTGGTATCA AAGAAACTTC** TAA | 191 |
| *S. hominis* | ATT **ATTGGTATCA AAGAAACTTC** TAA | 193 |
| *S. hominis* | ATT **ATTGGTATCA AAGAAACTTC** TAA | 195 |
| *S. lugdunensis* | ATT **ATTGGTATCc AcGAtACTaC** TAA | 197 |
| *S. saprophyticus* | ATC **ATcGGTATgc AAGAAgaaTC** CAA | 198 |
| *S. saprophyticus* | ATC **ATcGGTATgc AAGAAgaaTC** CAA | 200 |
| *S. saprophyticus* | ATC **ATcGGTATgc AAGAAgaaTC** CAA | 199 |
| *S. sciuri sciuri* | ATC **ATcGGTtTaA ctGAAgaaTC** TAA | 201 |
| *S. warneri* | ATC **ATcGGTtTac AtGAcACTTC** TAA | 187 |
| *S. warneri* | ATC **ATcGGTtTac AtGAcACTTC** TAA | 192 |
| *S. warneri* | ATC **ATcGGTtTac AtGAcACTTC** TAA | 202 |
| *S. warneri* | ATC **ATcGGTtTac AtGAcACTTC** TAA | 203 |
| *B. subtilis* | ATC **ATcGGTcTtc AAGAAgagag** AAA | —[a] |
| *E. coli* | ATC **gTTGGTATCA AAGAgACTca** GAA | 78 |
| *L. monocytogenes* | GTT **ATcGGTATCg AAGAAgaaag** AAA | 138[b] |
| Selected sequence for species-specific hybridization probe | **ATTGGTATCA AAGAAACTTC** | 597 |

The sequence numbering refers to the *Staphylococcus aureus* tuf gene fragment (SEQ ID NO. 179).
Nucleotides in capitals are identical to the selected sequences or match those sequences.
Mismatches are indicated by lower-case letters.
Dots indicate gaps in the sequences displayed.
[a]This sequence was obtained from Genbank accession #Z99104.
[b]The SEQ ID NO. refers to previous patent publication WO98/20157.

Annex XVII: Strategy for the selection of the *Enterococcus*-specific amplification primers from tuf sequences.

| | 270 298 556 582 | SEQ ID NO.: | Accession #: |
|---|---|---|---|
| *E. avium* | TAG**AATTAAT GGCTGCTGTT GACGAA**TAT...TGA**A GATATCCAAC GTGGACAAGT** ATT | 131[a] | — |
| *E. casseliflavus* | TGG**AATTAAT GGCTGCAGTT GACGAA**TAC...TGA**A GACATCCAAC GTGGACAAGT** ATT | 58 | — |
| *E. cecorum* | TAG**AATTAAT GGCTGCAGTT GACGAA**TAC...TGA**A GATATCCAAC GTGGtCAAGT** ATT | 59 | — |
| *E. dispar* | TAG**AATTAAT GGCTGCAGTT GACGAA**TAT...TGA**A GATATCCAAC GTGGtCAAGT** ATT | 60 | — |

-continued

Annex XVII: Strategy for the selection of the *Enterococcus*-specific amplification primers from tuf sequences.

| | 270 298 556 582 | SEQ ID NO.: | Accession #: |
|---|---|---|---|
| *E. durans* | TTGAATTAAT GGCTGCAGTT GACGAATAT...TGAA GACATCCAAC GTGGACAAGT TTT | 61 | — |
| *E. flavescens* | TGGAATTAAT GGCTGCAGTT GACGAATAC...TGAA GACATCCAAC GTGGACAAGT ATT | 65 | — |
| *E. faecium* | TTGAATTAAT GGCTGCAGTT GACGAATAC...TGAA GACATCCAAC GTGGACAAGT TTT | 608 | — |
| *E. faecalis* | TAGAATTAAT GGCTGCAGTT GACGAATAT...TGAA GATATCGAAC GTGGACAAGT ATT | 607 | — |
| *E. gallinarum* | TGGAATTgAT GGCTGCAGTT GACGAATAC...TGAA GACATCCAAC GTGGACAAGT ATT | 609 | — |
| *E. hirae* | TTGAATTgAT GGCTGCAGTT GACGAATAT...TGAA GACATCCAAC GTGGACAAGT TTT | 67 | — |
| *E. mundtii* | TTGAATTgAT GGCTGCAGTT GACGAATAT...TGAA GACATCCAAC GTGGtCAAGT TTT | 68 | — |
| *E. pseudoavium* | TAGAATTAAT GSCTGCTGTT GACGAATAC...TGAA GACATCCAAC GTGGACAAGT ATT | 69 | — |
| *E. raffinosus* | TAGAATTAAT GGCTGCTGTT GATGAATAC...TGAA GACATCCAAC GTGGACAAGT ATT | 70 | — |
| *E. saccharolyticus* | TCGAATTAAT GGCTGCAGTT GACGAATAT...TGAA GACATCCAAC GTGGACAAGT ATT | 71 | — |
| *E. solitarius* | TGGAcTTAAT GGaTGCAGTT GATGAcTAC...TGAt GATATCGAAC GTGGtCAAGT ATT | 72 | — |
| *E. coli* | TGGAAcTggc tGgcttccTg GATtctTAY...TGAA GAaATCGAAC GTGGtCAgGT ACT | 78 | — |
| *B. cepacia* | TGAgccTggc cGacGCgcTg GACacgTAC...TGAA GACgTgGAgC GTGGcCAgGT TCT | 16 | — |
| *B. fragilis* | TGGAAcTgAT GGaaGCTGTT GATactTGG...GAAc GAaATCaAAC GTGGtatgGT TCT | — | M22247 |
| *B. subtilis* | TCGAAcTtAT GGaTGCgGTT GATGAgTAC...TGAA GAaATCCAAC GTGGtCAAGT ACT | — | Z99104 |
| *C. diphtheriae* | TCGAccTcAT GcagGCTtgc KATGAtTCC...CGAA GACgTtGAgC GTGGcCAgGT TGT | 662 | — |
| *C. trachomatis* | GAGAgcTAAT GcaaGCcGTc GATGAtAAT...GAAc GATgTgGAAa GaGGAatgGT TGT | 22 | — |
| *G. vaginalis* | AGGAAcTcAT GaagGCTGTT GACGAgTAC...TACc GACgTtGAgC GTGGtCAgGT TGT | 135[a] | — |
| *S. aureus* | TAGAATTART GGaaGCTGTa GATactTAC...TGAA GACgTaCAAC GTGGtCAAGT ATT | 179 | — |
| *S. pneumoniae* | TGGAATTgAT GaacaCAGTT GATGAgTAT...TGAt GAaATCGAAC GTGGACAAGT TAT | 145[a] | — |
| *A. adiacens* | TAGAATTAAT GGCTGCTGTT GACGAATAC...TGAA aACATCGAAC GTGGACAAGT TCT | 118[a] | — |
| *G. haemolysans* | TCGAATTAAT GGaaaCAGTT GACGAATAC...TGAA GACATCGAAC GTGGACAAGT TTT | 87 | — |
| *G. morbillorum* | TCGAATTAAT GGaaaCAGTT GACGAgTAC...TGAA GATATCGAAC GTGGACAAGT TTT | 88 | — |
| Selected sequence for amplification primer | AATTAAT GGCTGCWGTT GAYGAA | 1137 | |
| Selected sequence for amplification primer[b] | A GAYATCSAAC GTGGACAAGT | 1136 | |

The sequence numbering refers to the *Enterococcus durans* tuf gene fragment (SEQ ID NO. 61).
Nucleotides in capitals are identical to the selected sequences or match those sequences.
Mismatches are indicated by lower-case letters.
Dots indicate gaps in the sequences displayed.
"Y" "W" and "S" designate nucleotide positions which are degenerate. "Y" stands for C or T; "W" stands for A or T; "S" stands for C or G. "I" stands for inosine which is a nucleotide analog that can bind to any of the four nucleotides A, C, G or T.
[a]The SEQ ID NO. refers to previous patent publication WO98/20157.
[b]This sequence is the reverse-complement of the selected primer.

Annex XVIII: Strategy for the selection of the *Enterococcus faecalis*-specific hybridization probe, of the *Enterococcus faecium*-specific hybridization probe and of the *Enterococcus casseliflavus-flavescens-gallinarum* group-specific hybridization probe from tuf sequences.

| | 395 448...526 549 | SEQ ID NO.: | Accession #: |
|---|---|---|---|
| *E. avium* | GTTGA ACGTGGacAA GTTCGCGTTG GTGACGAAGT TGAAaTcGTa GGTATcGCT...CATc GGTGCtTTGt TACGTGGTGT | 131[a] | — |
| *E. casseliflavus* | GTTGA ACGTGGacAA GTTCGCGTTG GTGACGAAGT TGAAaTcGTT GGTATTGCT...CATT GGTGCATTGC TACGTGGTGT | 58 | — |
| *E. cecorum* | GTTGA ACGTGGacAA GTaCGtGTTG GTGACGAAGT TGAAaTaGTT GGTATcCAT...CATc GGTGCATTat TACGTGGTGT | 59 | — |
| *E. dispar* | GTTGA ACGTGGacAA GTTCGCGTTG GTGACGAAGT TGAAaTcGTa GGTATcGCT...CATT GGTGCATTat TACGTGGTGT | 60 | — |
| *E. durans* | GTTGA ACGTGGacAA GTTCGCGTTG GTGACGttGT aGAtaTcGTT GGTATcGCA...CATT GGTGCtTTaC TACGTGGTGT | 61 | — |
| *E. faecalis* | GTTGA ACGTGGTGAA GTTCGCGTTG GTGACGAAGT TGAAaTcGTT GGTATTAAA...CTTc GGTGCtTTat TACGTGGTGT | 62 | — |
| *E. faecium* | GTTGA ACGTGGacAA GTTCGCGTTG GTGACGAAGT TGAAGTTGTT GGTATTGCT...CATT GGTGCtTTaC TACGTGGTGT | 608 | — |
| *E. flavescens* | GTTGA ACGTGGacAA GTTCGCGTTG GTGACGAAGT TGAAaTcGTT GGTATTGCT...CATT GGTGCATTGC TACGTGGGGT | 65 | — |
| *E. gallinarum* | GTTGA ACGTGGacAA GTTCGCGTTG GTGATGAAGT aGAAaTcGTT GGTATTGCT...CATT GGTGCATTGC TACGTGGGGT | 609 | — |
| *E. hirae* | GTTGA ACGTGGacAA GTTCGCGTTG GTGACGttGT aGAtaTcGTT GGTATcGCA...CATT GGTGCtTTaC TACGTGGTGT | 67 | — |
| *E. mundtii* | GTTGA ACGTGGacAA GYTCGtGTTG GTGACGttaT cGAtaTcGTT GGTATcGCA...CATT GGTGCgTTaC TACGTGGTGT | 68 | — |
| *E. pseudoavium* | GTTGA ACGTGGacAA GTTCGCGTTG GTGACGAAGT TGAAaTcGTa GGTATCGCT...CATc GGTGCATTat TACGTGGTGT | 69 | — |
| *E. raffinosus* | GTTGA ACGTGGacAA GTTCGCGTTG GTGACGAAGT TGAAaTcGTa GGTATTGCT...CATT GGTGCATTat TACGTGGTGT | 70 | — |
| *E. saccharolyticus* | GTTGA ACGTGGacAA GTTCGCGTTG GTGACGttGT aGAAaTcGTT GGTATcGAC...CATc GGTGCtTTat TACGTGGGGT | 71 | — |
| *E. solitarius* | GTTGA ACGcGGgact aTcaaaGTCG GCGATGAAGT TGAcaTTaTT GGTATTCAT...CATT GGTaCtTTGt TACGTGGTGT | 72 | — |
| *C. diphtheriae* | GTTGA gCGTGGctcc cTgaagGTCA ACGAGGAcGT cGAgaTcaTc GGTATcCGC...CTGT GGTctgcTtC TcCGTGGCGT | 662 | — |
| *G. vaginalis* | GTTGA gCGTGGTaAg cTcCcaATCA ACACCCcAGT TGAgaTcGTT GGTtTgCGC...CACT GGTcttcTtC TcCGcGGTAT | 135[a] | — |
| *B. cepacia* | GTCGA gCGcGGcatc GTgaagGTCG GCGAAGAAaT cGAAaTcGTc GGTATcAAG...CGTT GGTatccTGC TgCGcGGCAC | 16 | — |
| *S. aureus* | GTTGA ACGTGGTcAA aTcaaaGTTG GTGAAGAAGT TGAAaTcaTc GGTtTaCAT...CATT GGTGCATTat TACGTGGTGT | 179 | — |
| *B. subtilis* | GTAGA ACGcGGacAA GTTaaaGTCG GTGACGAAGT TGAAaTcaTc GGTcTTCAA...CATT GGTGCccTtC TtCGcGGTGT | — | Z99104 |

-continued

Annex XVIII: Strategy for the selection of the *Enterococcus faecalis*-specific hybridization probe, of the *Enterococcus faecium*-specific hybridization probe and of the *Enterococcus casseliflavus-flavescens-gallinarum* group-specific hybridization probe from tuf sequences.

| | 395     448...526     549 | SEQ ID NO.: | Accession #: |
|---|---|---|---|
| *S. pneumoniae* | ATCGA cCGTGGTatc GTTaaaGTCA ACGACGAAaT cGAAaTcGTT GGTATcAAA...CGTa GGTGtccTtC TtCGTGGTGT | 145[a] | — |
| *E. coli* | GTAGA ACGcGGTatc aTcaaaGTTG GTGAAGAAGT TGAAaTcGTT GGTATcAAA...CGTa GGTGttcTGC TgCGTGGTAT | 78 | — |
| *B. fragilis* | ATCGA AacTGGTGtt aTcCatGTAG GTGATGAAaT cGAAaTccTc GGTtTgGGT...CGTa GGTctgTTGC TtCGTGGTGT | — | M22247 |
| *C. trachomatis* | ATTGA gCGTGGaatt GTTaaaGTTT CCGATAAAGT TcAgtTgGTc GGTcTTAGA...CGTT GGattgcTcC TcaGaGGTAT | 22 | — |
| Selected sequences for species-specific or group-specific hybridization probes | GA ACGTGGTGAA GTTCGC (*E. faecalis*)<br>AAGT TGAAGTTGTT GGTATT (*E. faecium*)<br>T GGTGCATTGC TACGTGG | 1174<br>602<br>1122 | |

The sequence numbering refers to the *Enterococcus faecium* tuf gene fragments (SEQ ID NO. 608). Nucleotides in capitals are identical to the selected sequences or match those sequences. Mismatches are indicated by lower-case letters. Dots indicate gaps in the sequences displayed.

[a]The SEQ ID NO. refers to previous patent publication WO98/20157.

Annex XIX: Strategy for the selection of primers for the identification of platelets contaminants from tuf sequences.

| | 467 495 689 717 | SEQ ID NO.: | Accession #: |
|---|---|---|---|
| *B. cereus* | GTA **ACTGGTGTaG AGATGTTCCG TAA**ACT...C AG**TTCTACTT CCGTACAACT GACGT**AAC | 7 | — |
| *B. subtilis* | GTT **ACaGGTGTTG AAATGTTCCG TAA**GCT...C AG**TTCTACTT CCGTACAACT GACGT**AAC | — | Z99104 |
| *E. cloacae* | TGT **ACTGGCGTTG AAATGTTCCG CAA**ACT...C AG**TTCTACTT CCGTACAACT GACGT**GAC | 54 | — |
| *E. coli* | TGT **ACTGGCGTTG AAATGTTCCG CAA**ACT...C AG**TTCTACTT CCGTACTACT GACGT**GAC | 78 | — |
| *K. oxytoca* | TGT **ACTGGCGTTG AAATGTTCCG CAA**ACT...C AG**TTCTACTT CCGTACAACT GACGT**GAC | 100 | — |
| *K. pneumoniae* | TGT **ACTGGCGTTG AAATGTTCCG CAA**ACT...C AG**TTCTACTT CCGTACTACT GACGT**GAC | 103 | — |
| *P. aeruginosa* | TGC **ACcGGCGTTG AAATGTTCCG CAA**GCT...C AG**TTCTACTT CCGTACCACK GACGT**GAC | 153 | — |
| *S. agalactiae* | GTT **ACTGGTGTTG AAATGTTCCG TAA**ACA...C AA**TTCTACTT CCGTACAACT GACGT**AAC | 209 | — |
| *S. aureus* | GTT **ACaGGTGTTG AAATGTTCCG TAA**ATT...C AA**TTCTATTT CCGTACTACT GACGT**AAC | 140[a] | — |
| *S. choleraesuis* | TGT **ACTGGCGTTG AAATGTTCCG CAA**ACT...C AG**TTCTACTT CCGTACTACT GACGT**GAC | 159 | — |
| *S. epidermidis* | GTT **ACTGGTGTaG AAATGTTCCG TAA**ATT...C AA**TTCTATTT CCGTACTACT GACGT**AAC | 611 | — |
| *S. marcescens* | TGT **ACTGGCGTTG AAATGTTCCG CAA**ACT...C AG**TTCTACTT CCGTACCACT GACGT**GAC | 168 | — |
| *S. mutans* | GTT **ACTGGTGTTG AAATGTTCCG TAA**ACA...C AA**TTCTACTT CCGTACAACT GACGT**AAC | 224 | — |
| *S. pyogenes* | GTT **ACTGGTGTTG AAATGTTCCG TAA**ACA...C AA**TTCTACTT CCGTACAACT GACGT**AAC | — | U40453 |
| *S. salivarius* | GTT **ACTGGTGTTG AAATGTTCCG TAA**ACA...C AG**TTCTACTT CCGTACAACT GACGT**AAC | 146[a] | — |
| *S. sanguinis* | GTT **ACTGGTGTTG AAATGTTCCG TAA**ACA...C AG**TTCTACTT CCGTACAACT GACGT**TAC | 227 | — |
| *Y. enterocolitica* | TGT **ACTGGCGTTG AAATGTTCCG CAA**ACT...C AG**TTCTACTT CCGTACAACT GAtGT**AAC | 235 | — |
| Selected sequence for amplification primer | **ACTGGYGTTG AIATGTTCCG YAA** | 636 | |
| Selected sequence for amplification primer[b] | **TTCTAYTT CCGTACIACT GACGT** | 637 | |

The sequence numbering refers to the *E. coli* tuf gene fragment (SEQ ID NO. 78). Nucleotides in capitals are identical to the selected sequences or match those sequences. Mismatches are indicated by lower-case letters. Dots indicate gaps in the sequences displayed.

"R" "Y" "M" "K" "W" and "S" designate nucleotide positions which are degenerated. "R" stands for A or G; "Y" stands for C or T; "M" stands for A or C; "K" stands for G or T; "W" stands for A or T; "S" stands for C or G. "I" stands for inosine which is a nucleotide analog that can bind to any of the four nucleotides A, C, G or T.

[a]The SEQ ID NO. refers to previous patent publication WO98/20157.

[b]This sequence is the reverse-complement of the selected primer.

Annex XX: Strategy for the selection of the universal amplification primers from atpD sequences.

| | 616 657 781 812 | SEQ ID NO. | ACCESSION #: |
|---|---|---|---|
| *C. glutamicum* | GTGTTCGGTC AGATGGATGA GCCACCAGGA GTCCGTATG CGC...CGTATg CCTTCCGCCG TGGGTTACCA GCCAAC | — | X76875 |
| *M. tuberculosis* | GTATTCGGAC AGATGGACGA GCCGCCGGGC aCCCGTATG CGT...CGGATg CCGTCGGCCG TGGGATACCA GCCCAC | — | Z73419 |
| *E. faecalis* | GTGTTCGGAC AAATGAACGA ACCACCAGGT GCTCGGATG CGG...CGTATg CCTTCTGCCG TTGGTTACCA ACCAAC | 291 | — |
| *S. agalactiae* | GTCTTTGGTC AAATGAATGA ACCACCAGGA GCACGTATG CGT...CGTATg CCTTCAGCCG TTGGTTATCA ACCAAC | 380 | — |
| *B. subtilis* | GTATTCGGAC AAATGAACGA GCCGCCGGGC GCACGTATG CGT...CGTATg CCTTCAGCGG TTGGTTATCA GCCGAC | — | Z28592 |
| *L. monocytogenes* | GTATTCGGTC AAATGAACGA GCCACCAGGT GCGCGTATG CGT...CGTATg CCATCTGCGG TAGGTTACCA ACCAAC | 324 | — |
| *S. aureus* | GTATTCGGGC AAATGAATGA GCCACCTGGT GCACGTATG CGT...CGTATg CCTTCTGCAG TAGGTTACCA ACCAAC | 366 | — |
| *A. baumannii* | GTCTACGGTC AGATGAACGA GCCACCAGGT aaCCGTtTa CGC...CGTATg CCATCTGCGG TAGGTTACCA ACCTAC | 243 | — |
| *N. gonorrhoeae* | GTGTATGGCC AAATGAACGA ACCTCCAGGC aaCCGTcTG CGC...CGTATg CCTTCTGCAG TGGGTTACCA ACCGAC | — | Genome project |
| *C. freundii* | GTATATGGCC AGATGAACGA GCCGCCTGGA aaCCGTcTG CGT...CGTATg CCATCAGCGG TAGGCTACCA GCCGAC | 264 | — |
| *E. cloacae* | GTTTACGGCC AGATGAACGA GCCACCAGGA aaCCGTcTG CGC...CGTATg CCTTCAGCGG TAGGTTATCA GCCTAC | 284 | — |
| *E. coli* | GTGTATGGCC AGATGAACGA GCCGCCGGGA aaCCGTcTG CGC...CGTATg CCTTCAGCGG TAGGTTATCA GCCGAC | 669 | V00267 |
| *S. typhimurium* | GTGTATGGCC AGATGAACGA GCCGCCGGGA aaCCGTcTG CGC...CGTATg CCTTCCGCAG TAGGTTACCA GCCGAC | 351 | — |
| *K. pneumoniae* | GTGTACGGCC AGATGAACGA GCCGCCGGGA aaCCGTcTG CGC...CGTATg CCTTCAGCGG TAGGTTATCA GCCGAC | 317 | — |
| *S. marcescens* | GTTTACGGCC AGATGAACGA GCCACCAGGT aaCCGTcTG CGC...CGTATg CCATCCGCGG TAGGTTATCA GCCAAC | 357 | — |
| *Y. enterocolitica* | GTTTATGGCC AAATGAATGA GCCACCAGGT aaCCGTcTG CGC...CGTATg CCATCTGCCG TAGGTTACCA GCCAAC | 393 | — |
| *B. cepacia* | GTGTACGGCC AGATGAACGA GCCGCCGGGC aaCCGTcTG CGC...CGTATg CCGTCGGCAG TGGGCTATCA GCCGAC | — | X76877 |
| *H. influenzae* | GTTTATGGTC AAATGAACGA GCCACCAGGT aaCCGTtTa CGT...CGTATg CCATCCGCGG TAGGTTACCA ACCGAC | — | U32730 |
| *M. pneumoniae* | GTGTTTGGTC AGATGAACGA ACCCCCAGGA GCACGGATG CGG...CGGATg CCATCAGCCG TGGGTTACCA ACCAAC | — | U43738 |

-continued

Annex XX: Strategy for the selection of the universal amplification primers from atpD sequences.

| | 616 657 781 812 | SEQ ID NO. | ACCESSION #: |
|---|---|---|---|
| *H. pylori* | TGC**TATGGGC AAATGAATGA GCCACCAGGT GCAAGGAat** CGC...CGT**ATC CCTTCAGCGG TGGGGTATCA GCC**CAC | 670 | V00267 |
| *B. fragilis* | GTG**TTCGGAC AGATGAACGA ACCTCCTGGA GCACGTgct** TCA...CGT**ATg CCTTCTGCGG TAGGTTATCA ACC**TAC | — | M22247 |
| Selected sequences for universal primers | **C ARATGRAYGA RCCICCIGGI GYIMGIATG** | 562 | |
| | **TAYGGIC ARATGAAYGA RCCICCIGGI AA** | 564 | |
| Selected sequences for universal primers[a] | **ATH CCITCIGCIG TIGGITAYCA RCC** | 565 | |
| | **ATG CCITCIGCIG TIGGITAYCA RCC** | 563 | |

The sequence numbering refers to the *Escherichia coli* atpD gene fragment (SEQ ID NO. 669). Nucleotides in capitals are identical to the selected sequences or match those sequences. Mismatches for SEQ ID NOs. 562 and 565 are indicated by lower-case letters. Mismatches for SEQ ID NOs. 564 and 563 are indicated by underlined nucleotides. Dots indicate gaps in the sequences displayed.

"R" "Y" "M" "K" "W" and "S" letters designate nucleotide positions which are degenerated. "R" stands for A or G; "Y" stands for C or T; "M" stands for A or C; "K" stands for G or T; "W" stands for A or T; "H" stands for A, C or T; "S" stands for C or G. "I" stands for inosine which is a nucleotide analog that can bind to any of the four nucleotides A, C, G or T.

[a]These sequences are the reverse-complement of the selected primers.

Annex XXI: Specific and ubiquitous primers for nucleic acid amplification (recA sequences).

| SEQ ID NO. | Nucleotide sequence | Originating DNA fragment SEQ ID NO. | Nucleotide position |
|---|---|---|---|
| | **Universal primers (recA)** | | |
| 919 | 5'-GGI CCI GAR TCI TMI GGI AAR AC | 918[a] | 437-459 |
| 920[b] | 5'-TCI CCV ATI TCI CCI TCI AIY TC | 918[a] | 701-723 |
| 921 | 5'-TIY RTI GAY GCI GAR CAI GC | 918[a] | 515-534 |
| 922[b] | 5'-TAR AAY TTI ARI GCI YKI CCI CC | 918[a] | 872-894 |
| | **Sequencing primers (recA)** | | |
| 1605 | 5'-ATY ATY GAA RTI TAY GCI CC | 1704[a] | 220-239 |
| 1606 | 5'-CCR AAC ATI AYI CCI ACT TTT TC | 1704[a] | 628-650 |
| | **Universal primers (rad51)** | | |
| 935 | 5'-GGI AAR WSI CAR YTI TGY CAY AC | 939[a] | 568-590 |
| 936[b] | 5'-TCI SIY TCI GGI ARR CAI GG | 939[a] | 1126-1145 |
| | **Universal primers (dmc1)** | | |
| 937 | 5'-ATI ACI GAR GYI TTY GGI GAR TT | 940[a] | 1038-1060 |
| 938[b] | 5'-CYI GTI GYI SWI GCR TGI GC | 940[a] | 1554-1573 |

[a]Sequences from databases.
[b]These sequences are from the complementary DNA strand of the sequence of the originating fragment given in the Sequence Listing.

Annex XXII: Specific and ubiquitous primers for nucleic acid amplification (speA sequences).

| SEQ ID NO. | Nucleotide sequence | Originating DNA fragment SEQ ID NO. | Nucleotide position |
|---|---|---|---|
| | **Bacterial species: *Streptococcus pyogenes*** | | |
| 994 | 5'-TGG ACT AAC AAT CTC GCA AGA GG | 993[a] | 60-82 |
| 995[b] | 5'-ACA TTC TCG TGA GTA ACA GGG T | 993[a] | 173-194 |
| 996 | 5'-ACA AAT CAT GAA GGG AAT CAT TTA G | 993[a] | 400-424 |

-continued

Annex XXII: Specific and ubiquitous primers for nucleic acid amplification (speA sequences).

| SEQ ID NO. | Nucleotide sequence | Originating DNA fragment SEQ ID NO. | Nucleotide position |
|---|---|---|---|
| 997[b] | 5'-CTA ATT CTT GAG CAG TTA CCA TT | 993[a] | 504-526 |
| 998 | 5'-GGA GGG GTA ACA AAT CAT GAA GG | 993[a] | 391-413 |
| 997[b] | 5'-CTA ATT CTT GAG CAG TTA CCA TT | 993[a] | 504-526 |

[a]Sequence from databases.
[b]These sequences are from the complementary DNA strand of the sequence of the originating fragment given in the Sequence Listing.

Annex XXIII: First strategy for the selection of *Streptococcus pyogenes*-specific amplification primers from speA sequences.

| ACCESSION # | 57 85 170 197 | SEQ ID NO.: |
|---|---|---|
| speA X61573 | CCTT **GGgCTAACAA** cCTCa**CAAGA** **aG**TAT...GTG**AtCCT.GT** **cgtTCAtGAG** **AATGT**AAA | — |
| speA AF029051 | ~~~~ **GGgCTAACAA** cCTCa**CAAGA** **aG**TAT...GTG**AtCCT.GT** **cgtTCAtGAG** **AATGT**AAA | — |
| speA X61571 | TCTT **GGACTAACAA** TCTCG**CAAGA** **GG**TAT...GTG**ACCCT.GT** **TACTCACGAG** **AATGT**GAA | — |

-continued

Annex XXIII: First strategy for the selection of *Streptococcus pyogenes*-specific amplification primers from speA sequences.

| ACCESSION # | 57 85 170 197 | SEQ ID NO.: |
|---|---|---|
| speA X61570 | TCTT GGACTAACAA TCTCGCAAGA GGTAT...GTGACCCT.GT TACTCACGAG AATGTGAA | — |
| speA X61568 | TCTT GGACTAACAA TCTCGCAAGA GGTAT...GTGACCCT.GT TACTCACGAG AATGTGAA | — |
| speA X61569 | TCTT GGACTAACAA TCTCGCAAGA GGTAT...GTGACCCT.GT TACTCACGAG AATGTGAA | — |
| speA X61572 | TCTT GGACTAACAA TCTCGCAAGA GGTAT...GTGACCCT.GT TACTCACGAG AATGTGAA | — |
| speA X61560 | TCTT GGACTAACAA TCTCGCAAGA GGTAT...GTGACCCT.GT TACTCACGAG AATGTGAA | — |
| speA U40453 | TCTT GGACTAACAA TCTCGCAAGA GGTAT...GTGACCCT.GT TACTCACGAG AATGTGAA | 993 |
| speA X61554 | TCTT GGACTAACAA TCTCGCAAGA GGTAT...GTGACCCT.GT TACTCACGAG AATGTGAA | — |
| speA X61557 | TCTT GGACTAACAA TCTCGCAAGA GGTAT...GTGACCCT.GT TACTCACGAG AATGTGAA | — |
| speA X61559 | TCTT GGACTAACAA TCTCGCAAGA GGTAT...GTGACCCT.GT TACTCACGAG AATGTGAA | — |
| speA X61558 | TCTT GGACTAACAA TCTCGCAAGA GGTAT...GTGACCCT.GT TACTCACGAG AATGTGAA | — |
| speA X61556 | TCTT GGACTAACAA TCTCGCAAGA GGTAT...GTGACCCT.GT TACTCACGAG AATGTGAA | — |
| speA X61555 | TCTT GGACTAACAA TCTCGCAAGA GGTAT...GTGACCCT.GT TACTCACGAG AATGTGAA | — |
| speA X61560 | TCTT GGACTAACAA TCTCGCAAGA GGTAT...GTGACCCT.GT TACTCACGAG AATGTGAA | — |
| speA X61561 | TCTT GGACTAACAA TCTCGCAAGA GGTAT...GTGACCCT.GT TACTCACGAG AATGTGAA | — |
| speA X61566 | TCTT GGACTAACAA TCTCGCAAGA GGTAT...GTGACCCT.GT TACTCACGAG AATGTGAA | — |
| speA X61567 | TCTT GGACTAACAA TCTCGCAAGA GGTAT...GTGACCCT.GT TACTCACGAG AATGTGAA | — |
| speA X61562 | TCTT GGACTAACAA TCTCGCAAGA GGTAT...GTGACCCT.GT TACTCACGAG AATGTGAA | — |
| speA X61563 | TCTT GGACTAACAA TCTCGCAAGA GGTAT...GTGACCCT.GT TACTCACGAG AATGTGAA | — |
| speA X61564 | TCTT GGACTAACAA TCTCGCAAGA GGTAT...GTGACCCT.GT TACTCACGAG AATGTGAA | — |
| speA X61565 | TCTT GGACTAACAA TCTCGCAAGA GGTAT...GTGACCCT.GT TACTCACGAG AATGTGAA | — |
| speA AF055698 | ~~~~ GGACTAACAA TCTCGCAAGA GGTAT...GTGACCCT.GT TACTCACGAG AATGTGAA | — |
| speA X03929[a] | TCTT GGACTAACAA TCTtGCcAaA aGGTA...GTGACCCTGGT TACTCACGAG AATGTGAA | — |
| Selected sequence for species-specific primer | T GGACTAACAA TCTCGCAAGA GG | 994 |
| Selected sequence for species-specific primer[b] | ACCCT.GT TACTCACGAG AATGT | 995 |

The sequence numbering refers to the *Streptococcus pyogenes* speA gene fragment (SEQ ID NO. 993). Nucleotides in capitals are identical to the selected sequences or match those sequences. Mismatches are indicated by lower-case letters. "~" indicate incomplete sequence data. Dots indicate gaps in the sequences displayed.
[a]The extra G nucleotide introducing a gap in the sequence is probably a sequencing error.
[b]This sequence is the reverse-complement of the selected primer.

Annex XXIV: Second strategy for the selection of *Streptococcus pyogenes*-specific amplification primers from speA sequences.

| Accession # | 388 427 501 529 | SEQ ID NO.: |
|---|---|---|
| speA X61573 | TA TGGAGGGGTA ACAAATCATG AAGGGAATCA TTTAGAAA...AAAAATGGT AACTGCTCAA GAATTAGACT | — |
| speA AF029051 | TA TGGAGGGGTA ACAAATCATG AAGGGAATCA TTTAGAAA...AAAAATGGT AACTGCTCAA GAATTAGACT | — |
| speA X61571 | TA CGGAGGGGTA ACAAATCATG AAGGGAATCA TTTAGAAA...AAAAATGGT AACTGCTCAA GAATTAGACT | — |

-continued

Annex XXIV: Second strategy for the selection of *Streptococcus pyogenes*-specific amplification primers from speA sequences.

| Accession # | 388 427 501 529 | SEQ ID NO.: |
|---|---|---|
| speA X61570 | TA CGGAGGGGTA ACAAATCATG AAGGGAATCA TTTAGAAA...AAAAATGGT AACTGCTCAA GAATTAGACT | — |
| speA X61568 | TA CGGAGGGGTA ACAAATCATG AAGGGAATCA TTTAGAAA...AAAAATGGT AACTGCTCAA GAATTAGACT | — |
| speA X61569 | TA CGGAGGGGTA ACAAATCATG AAGGGAATCA TTTAGAAA...AAAAATGGT AACTGCTCAA GAATTAGACT | — |
| speA X61572 | TA CGGAGGGGTA ACAAATCATG AAGGGAATCA TTTAGAAA...AAAAATGGT AACTGCTCAA GAATTAGACT | — |
| speA X61560 | TA CGGAGGGGTA ACAAATCATG AAGGGAATCA TTTAGAAA...AAAAATGGT AACTGCTCAA GAATTAGACT | — |
| speA U40453 | TA CGGAGGGGTA ACAAATCATG AAGGGAATCA TTTAGAAA...AAAAATGGT AACTGCTCAA GAATTAGACT | 993 |
| speA X61554 | TA CGGAGGGGTA ACAAATCATG AAGGGAATCA TTTAGAAA...AAAAATGGT AACTGCTCAA GAATTAGACT | — |
| speA X61557 | TA CGGAGGGGTA ACAAATCATG AAGGGAATCA TTTAGAAA...AAAAATGGT AACTGCTCAA GAATTAGACT | — |
| speA X61559 | TA CGGAGGGGTA ACAAATCATG AAGGGAATCA TTTAGAAA...AAAAATGGT AACTGCTCAA GAATTAGACT | — |
| speA X61558 | TA CGGAGGGGTA ACAAATCATG AAGGGAATCA TTTAGAAA...AAAAATGGT AACTGCTCAA GAATTAGACT | — |
| speA X61556 | TA CGGAGGGGTA ACAAATCATG AAGGGAATCA TTTAGAAA...AAAAATGGT AACTGCTCAA GAATTAGACT | — |
| speA X61555 | TA CGGAGGGGTA ACAAATCATG AAGGGAATCA TTTAGAAA...AAAAATGGT AACTGCTCAA GAATTAGACT | — |
| speA X61560 | TA CGGAGGGGTA ACAAATCATG AAGGGAATCA TTTAGAAA...AAAAATGGT AACTGCTCAA GAATTAGACT | — |
| speA X61561 | TA CGGAGGGGTA ACAAATCATG AAGGGAATCA TTTAGAAA...AAAAATGGT AACTGCTCAA GAATTAGACT | — |
| speA X61566 | TA CGGAGGGGTA ACAAATCATG AAGGGAATCA TTTAGAAA...AAAAATGGT AACTGCTCAA GAATTAGACT | — |
| speA X61567 | TA CGGAGGGGTA ACAAATCATG AAGGGAATCA TTTAGAAA...AAAAATGGT AACTGCTCAA GAATTAGACT | — |
| speA X61562 | TA CGGAGGGGTA ACAAATCATG AAGGGAATCA TTTAGAAA...AAAAATGGT AACTGCTCAA GAATTAGACT | — |
| speA X61563 | TA CGGAGGGGTA ACAAATCATG AAGGGAATCA TTTAGAAA...AAAAATGGT AACTGCTCAA GAATTAGACT | — |
| speA X61564 | TA CGGAGGGGTA ACAAATCATG AAGGGAATCA TTTAGAAA...AAAAATGGT AACTGCTCAA GAATTAGACT | — |
| speA X61565 | TA CGGAGGGGTA ACAAATCATG AAGGGAATCA TTTAGAAA...AAAAATGGT AACTGCTCAA GAATTAGACT | — |
| speA AF055698 | TA CGGAGGGGTA ACAAATCATG AAGGGAATCA TTTAGAAA...AAAAATGGT AACTGCTCAA GAATTAGACT | — |
| speA X03929 | TA CGGAGGGGTA ACAAATCATG AAGGGAATCA TTTAGAAA...AAAAATGGT AACTGCTCAA GAATTAG.CT | — |
| Selected sequences for species-specific primers | GGAGGGGTA ACAAATCATG AAGG<br>ACAAATCATG AAGGGAATCA TTTAG | 998<br>996 |
| Selected sequence for species-specific primer[a] | AATGGT AACTGCTCAA GAATTAG | 997 |

The sequence numbering refers to the *Streptococcus pyogenes* speA gene fragment (SEQ ID NO. 993). Dots indicate gaps in the sequences displayed.

[a]This sequence is the reverse-complement of the selected primer.

Annex XXV: Strategy for the selection of *Streptococcus pyogenes*-specific amplification primers from tuf sequences.

| | 140 186 619 647 | SEQ ID NO.: |
|---|---|---|
| *S. anginosus* | A AGTTGACtTg GTTGACGAtG AAGAaTTGCT TGAATTgGTT GAaATG...CC AgGTTCAATt cAtCCACACA CTAAATT | 211 |
| *S. bovis* | A AGTTGACCTT GTTGATGACG AAGAaTTGCT TGAATTgGTT GAaATG...CC AgGTTCAATC cACCCACACA CTAAATT | 212 |
| *S. dysgalactiae* | A AATTGACCTT GTTGAcGAtG AAGAaTTGCT TGAATTgGTT GAaATG...CC AgGTTCAATC AACCCACACA CTAAATT | 217 |
| *S. pyogenes* | A AGTTGACCTT GTTGATGACG AAGAGTTGCT TGAATTAGTT GAGATG...CC AAGTTCAATC AACCCACACA CTAAATT | 1002 |
| *S. agalactiae* | A AGTTGACCTT GTTGATGAtG AAGAaTTGCT TGAATTgGTT GAaATG...CC AgGTTCAATC AACCCACACA CTAAATT | 144[a] |
| *S. oralis* | A AATTGACtTg GTAGAcGACG AAGAaTTGCT TGAATTgGTT GAaATG...CC AgGTTCAATC AACCCACACA CTAAATT | 985 |
| *S. pneumoniae* | A AGTTGACtTg GTTGAcGACG AAGAaTTGCT TGAATTgGTT GAaATG...CC AgGTTCAATC AACCCACACA CTAAATT | 145[a] |
| *S. cristatus* | A GATCGACtTg GTTGATGACG AAGAaTTGCT TGAATTgGTT GAaATG...CC AgGTTCAATC AACCCACACA CTAAATT | 215 |
| *S. mitis* | A GATCGACtTg GTTGATGACG AAGAaTTGCT TGAATTgGTT GAaATG...CC AgGTTCAATC AACCCACACA CTAAATT | 982 |
| *S. gordonii* | A AGTTGACtTg GTTGAcGAtG AAGAaTTGCT TGAGTTgGTT GAaATG...CC AgGTTCAATC AACCCACACA CTAAATT | 200 |
| *S. sanguinis* | A AGTTGACtTg GTTGAcGAtG AAGAaTTGCT TGAATTgGTT GAaATG...CC AgGTTCAATC AACCCACACA CTAAATT | 227 |
| *S. parasanguinis* | A AGTTGACtTg GTTGATGAtG AAGAaTTGCT TGAATTgGTT GAaATG...CC AgGTTCAATC AACCCACACA CTAAATT | 225 |
| *S. salivarius* | A AGTTGACtTg GTTGAcGAtG AAGAaTTGCT TGAATTgGTT GAaATG...CC TgGTTCAATC AACCCACACA CTAAATT | 146[a] |
| *S. vestibularis* | A AGTTGACtTg GTTGAcGAtG AAGAaTTGCT TGAATTgGTT GAaATG...CC TgGTTCAATC AACCCACACA CTAAATT | 231 |
| *S. suis* | A AGTTGACtTg GTTGAcGAtG AAGAaTTGCT TGAgTTgGTT GAaATG...CC AgGTTCtATC AACCCACACA CTAAATT | 229 |
| *S. mutans* | A AGTTGAttTg GTTGAcGAtG AAGAaTTGCT TGAATTgGTT GAaATG...CC AgGTTCAATt cACCCACACA CTAAATT | 224 |
| *S. ratti* | A GGTTGACtTg GTTGATGAtG AAGAaTTGCT TGAATTgGTT GAaATG...CC AgGTTCAATt cAtCCgCAcA CTAAATT | 226 |
| *S. macacae* | A AGTTGACtTa GTTGATGAtG AAGAaTTGCT TGAATTgGTT GAaATG...CC AgGATCAATt cAtCCACAcA CTAAATT | 222 |
| *S. cricetus* | A GGTTGACtTg GTTGAcGAtG AAGAaTTGCT TGAATTgGTT GAaATG...CC TgGTTCAATC cAtCCACACA CTAAATT | 214 |
| *E. faecalis* | A AATgGAtaTg GTTGATGACG AAGAaTTatT aGAATTAGTa GAaATG...CC AgcTaCAATC ActCCACACA CaAAATT | 607 |

-continued

Annex XXV: Strategy for the selection of *Streptococcus pyogenes*-specific amplification primers from tuf sequences.

| | 140 186 619 647 | SEQ ID NO.: |
|---|---|---|
| *S. aureus* | A AGTTGACaTg GTTGAcGAtG AAGAaTTatT aGAATTAGTa GAaATG...CC TgGTTCAATt AcaCCACACA CTgAATT | 176 |
| *B. cereus* | A ATgcGACaTg GTaGATGACG AAGAaTTatT aGAATTAGTa GAaATG...AG CgGTTCtgTa AAagCtCACg CTAAATT | 7 |
| *E. coli* | A ATgcGACaTg GTTGATGACG AAGAGcTGCT gGAAcTgGTT GAaATG...CC GgGCaCcATC AAgCCgCACA CcAAGTT | 78 |
| Selected sequences for species-specific primers | TTGACCTT GTTGATGACG AAGAG<br>AAGAGTTGCT TGAATTAGTT GAG | 999<br>1001 |
| Selected sequence for species-specific primer[b] | AGTTCAATC AACCCACACA CTAA | 1000 |

The sequence numbering refers to the *Streptococcus pyogenes* tuf gene fragment (SEQ ID NO. 1002). Nucleotides in capitals are identical to the selected sequences or match those sequences. Mismatches are indicated by lower-case letters. Dots indicate gaps in the sequences displayed.

[a]The SEQ ID NO. refers to previous patent publication WO98/20157.

[b]This sequence is the reverse-complement of the selected primer.

Annex XXVI: Strategy for the selection $stx_1$-specific amplification primers and hybridization probe.

| | Accession # | 230 263 343 375 391 421 | SEQ ID NO.: |
|---|---|---|---|
| $stx_1$ | M19473a | TTGATGTC AGAGGGATAG ATCCAGAGGA AGGGCG...TATCG CTTTGCTGAT TTTTCACATG TTACCTTT...GTTACAT TGTCTGGTGA CAGTAGCTAT ACCA | — |
| $stx_1$ | M16625 | TTGATGTC AGAGGGATAG ATCCAGAGGA AGGGCG...TATCG CTTTGCTGAT TTTTCACATG TTACCTTT...GTTACAT TGTCTGGTGA CAGTAGCTAT ACCA | — |
| $stx_1$ | M17358 | TTGATGTC AGAGGGATAG ATCCAGAGGA AGGGCG...TATCG CTTTGCTGAT TTTTCACATG TTACCTTT...GTTACAT TGTCTGGTGA CAGTAGCTAT ACCA | — |
| $stx_1$ | Z36900 | TTGATGTC AGAGGGATAG ATCCAGAGGA AGGGCG...TATCG CTTTGCTGAT TTTTCACATG TTACCTTT...GTTACAT TGTCTaGTGA CAGTAGCTAT ACCA | — |
| $stx_1$ | L04539 | TTGATGTC AGAGGGATAG ATCCAGAGGA AGGGCG...TATCG CTTTGCTGAT TTTTCACATG TTACCTTT...GTTACAT TGTCTGGTGA CAGTAGCTAT ACCA | — |
| $stx_1$ | M19437 | TTGATGTC AGAGGGATAG ATCCAGAGGA AGGGCG...TATCG CTTTGCTGAT TTTTCACATG TTACCTTT...GTTACAT TGTCTGGTGA CAGTAGCTAT ACCA | — |
| $stx_1$ | M24352 | TTGATGTC AGAGGGATAG ATCCAGAGGA AGGGCG...TATCG CTTTGCTGAT TTTTCACATG TTACCTTT...GTTACAT TGTCTGGTGA CAGTAGCTAT ACCA | — |
| $stx_1$ | X07903 | TTGATGTC AGAGGGATAG ATCCAGAGGA AGGGCG...TATCG CTTTGCTGAT TTTTCACATG TTACCTTT...GTTACAT TGTCTGGTGA CAGTAGCTAT ACCA | — |
| $stx_1$ | Z36899 | TTGATGTC AGAGGGATAG ATCCAGAGGA AGGGCG...TATCG CTTTGCTGAT TTTTCACATG TTACCTTT...GTTACAT TGTCTGGTGA CAGTAGCTAT ACCA | — |
| $stx_1$ | Z36901 | TTGATGTC AGAGGGATAG ATCCAGAGGA AGGGCG...TATCG CTTTGCTGAT TTTTCACATG TTACCTTT...GTTACAT TGTCTGGTGA CAGTAGCTAT ACCA | 1076 |
| $stx_2$ | X61283 | TGGATaTa cGAGGGcTtG ATgtctAtcA gGcGCG...TACCG tTTTtCaGAT TTTaCACATa TatCaGTG...GTTtCca TGaCaacgGA CAGcAGtTAT ACCA | — |
| $stx_2$ | L11079 | TGGATaTa cGAGGGcTtG ATgtctAtcA gGcGCG...TACCG tTTTtCaGAT TTTaCACATa TatCaGTG...GTTtCca TGaCaacgGA CAGcAGtTAT ACCA | — |
| $stx_2$ | M21534 | TAGgTaTa cGAGGGcTtG ATgtttAtcA gGaGCG...TACaG aTTTtCaGAT TTTgCACATa TatCaTTG...ATTtCca TGaCaacgGA CAGcAGtTAT ACCA | — |
| $stx_2$ | M36727 | TAGgTaTa cGAGGGcTtG ATgtttAtcA gGaGCG...TACaG aTTTtCaGAT TTTgCACATa TatCaTTG...ATTtCca TGaCaacgGA CAGcAGtTAT ACCA | — |
| $stx_2$ | X81415 | TAGgTaTa cGAGGGcTtG ATgtttAtcA gGaGCG...TACaG aTTTtCaGAT TTTgCACATa TatCaTTG...ATTtCca TGaCaacgGA CAGcAGtTAT ACCA | — |
| $stx_2$ | X81416 | TAGgTaTa cGAGGGcTtG ATgtttAtcA gGaGCG...TACaG aTTTtCaGAT TTTgCACATa TatCaTTG...ATTtCca TGaCaacgGA CAGcAGtTAT ACCA | — |
| $stx_2$ | X81417 | TAGgTaTa cGAGGGcTtG ATgtttAtcA gGaGCG...TACaG aTTTtCaGAT TTTgCACATa TatCaTTG...ATTtCca TGaCaacgGA CAGcAGtTAT ACCA | — |
| $stx_2$ | X81418 | TAGgTaTa cGAGGGcTtG ATgtttAtcA gGaGCG...TACaG aTTTtCaGAT TTTgCACATa TatCaTTG...ATTtCca TGaCaacgGA CAGcAGtTAT ACCA | — |
| $stx_2$ | E03962 | TGGATaTa cGAGGGcTtG ATgtctAtcA gGcGCG...TACCG tTTTtCaGAT TTTaCACATa TatCaGTG...GTTtCca TGaCaacgGA CAGcAGtTAT ACCA | — |
| $stx_2$ | E03959 | TGGATaTa cGAGGGcTtG ATgtctAtcA gGcGCG...TACCG tTTTtCaGAT TTTaCACATa TatCaGTG...GTTtCca TGaCaacgGA CAGcAGtTAT ACCA | — |
| $stx_2$ | X07865 | TGGATaTa cGAGGGcTtG ATgtctAtcA gGcGCG...TACCG tTTTtCaGAT TTTaCACATa TatCaGTG...GTTtCca TGaCaacgGA CAGcAGtTAT ACCA | — |
| $stx_2$ | Y10775 | TGGATaTa cGAGGGcTtG ATgtctAtcA gGcGCG...TACCG tTTTtCaGAT TTTaCACATa TatCaGTG...GTTtCca TGaCaacgGA CAGcAGtTAT ACCA | — |
| $stx_2$ | Z37725 | TGGATaTa cGAGGGcTtG ATgtctAtcA gGcGCG...TACCG tTTTtCaGAT TTTaCACATa TatCaGTG...GTTtCca TGaCaacgGA CAGcAGtTAT ACCA | 1077 |

-continued

Annex XXVI: Strategy for the selection $stx_1$-specific amplification primers and hybridization probe.

| Accession # | 230 263 343 375 391 421 | SEQ ID NO.: |
|---|---|---|
| $stx_2$ Z50754 | TGGATaTa cGAGGGcTtG ATgtctAtcA gGcGCG...TACCG tTTTtCaGAT TTTaCACATa TatCaGTG...GTTtCca TGaCaacgGA CAGcAGtTAT ACCA | — |
| $stx_2$ X67514 | TGGATaTa cGAGGGcTtG ATgtctAtcA gGcGCG...TACCG tTTTtCaGAT TTTaCACATa TatCaGTG...GTTtCca TGaCaacgGA CAGcAGtTAT ACCA | — |
| $stx_2$ L11078 | TGGATaTa cGAGGGcTtG ATgtctAtcA gGcGCG...TACCG tTTTtCaGAT TTTaCACATa TatCaGTG...GTTtCca TGaCaacgGA CAGcAGtTAT ACCA | — |
| $stx_2$ X65949 | TGGATaTa cGAGGGcTtG ATgtctAtcA gGcGCG...TACCG tTTTtCaGAT TTTaCACATa TatCaGTG...GTTtCca TGaCaacgGA CAGcAGtTAT ACCA | — |
| $stx_2$ AF043627 | TGGATaTa cGAGGGcTtG ATgtctAtcA gGcGCG...TACaG aTTTtCaGAT TTTgCACATa TatCaGTG...GTTtCca TGaCaacgGA CAGcAGtTAT ACCA | — |
| Selected sequence for amplification primer | ATGTC AGAGGGATAG ATCCAGAGGA AGG | 1081 |
| Selected sequence for hybridization probe | CG CTTTGCTGAT TTTTCACATG TTACC | 1084 |
| Selected sequence for amplification primer[a] | ACAT TGTCTGGTGA CAGTAGCTAT A | 1080 |

The sequence numbering refers to the *Escherichia coli* $stx_1$ gene fragment (SEQ ID NO. 1076). Nucleotides in capitals are identical to the selected sequences or match those sequences. Mismatches are indicated by lower-case letters. Dots indicate gaps in the sequences displayed.
[a]This sequence is the reverse-complement of the selected primer.

Annex XXVII: Strategy for the selection of $stx_2$-specific amplification primers and hybridization probe.

| | Accession # | 543 … 570 614 … 641 684 … 708 | SEQ ID NO.: |
|---|---|---|---|
| $stx_1$ | M19473 | AGCga TgtTaCGgTT TGTtACTGTG ACA...CAAC ACTGgaTGAt ctcAgTGggC gTtcTTA...A AGgtTgAGtA gCGTcCTgCC tGAC | — |
| $stx_1$ | M16625 | AGCga TgtTaCGgTT TGTtACTGTG ACA...CAAC ACTGgaTGAt ctcAgTGggC gTtcTTA...A AGgtTgAGtA gCGTcCTgCC tGAC | — |
| $stx_1$ | M17358 | AGCga TgtTaCGgTT TGTtACTGTG ACA...CAAC ACTGgaTGAt ctcAgTGggC gTtcTTA...A AGgtTgAGtA gCGTcCTgCC tGAC | — |
| $stx_1$ | Z36900 | AGCga TgtTaCGgTT TGTtACTGTG ACA...CAAC ACTGgaTGAt ctcAgTGggC gTtcTTA...A AGgtTgAGtA gTGTcCTgCC tGAT | — |
| $stx_1$ | L04539 | AGCga TgtTaCGgTT TGTtACTGTG ACA...CAAC ACTGgaTGAt ctcAgTGggC gTtcTTA...A AGgtTgAGtA gTGTcCTgCC tGAT | — |
| $stx_1$ | M19437 | AGCga TgtTaCGgTT TGTtACTGTG ACA...CAAC ACTGgaTGAt ctcAgTGggC gTtcTTA...A AGgtTgAGtA gTGTcCTgCC tGAC | — |
| $stx_1$ | M24352 | AGCga TgtTaCGgTT TGTtACTGTG ACA...CAAC ACTGgaTGAt ctcAgTGggC gTtcTTA...A AGgtTgAGtA gTGTcCTgCC tGAC | — |
| $stx_1$ | X07903 | AGCga TgtTaCGgTT TGTtACTGTG ACA...CAAC ACTGgaTGAt ctcAgTGggC gTtcTTA...A AGgtTgAGtA gTGTcCTgCC tGAC | — |
| $stx_1$ | Z36899 | AGCga TgtTaCGgTT TGTtACTGTG ACA...CAAC ACTGgaTGAt ctcAgTGggC gTtcTTA...A AGgtTgAGtA gTGTcCTgCC tGAC | — |
| $stx_1$ | Z36901 | AGCga TgtTaCGgTT TGTtACTGTG ACA...CAAC ACTtgaTGAt ctcAgTGggC gTtcTTA...A AGgtTgAGtA gTGTcCTgCC tGAC | 1076 |
| $stx_2$ | X61283 | AGCAG TTCTGCGTTT TGTCACTGTC ACA...AGGC ACTGTCTGA. ..AACTGCTC CTGTGTA...G CGAATCAGCA ATGTGCTTCC GGAG | — |
| $stx_2$ | L11079 | AGCAG TTCTGCGTTT TGTCACTGTC ACA...AGGC ACTGTCTGA. ..AACTGCTC CTGTGTA...G CGAATCAGCA ATGTGCTTCC GGAG | — |
| $stx_2$ | M21534 | AGCAG TTCTGCGTTT TGTCACTGTC ACA...TGGC ACTGTCTGA. ..AACTGCTC CTGTTTA...G AGAATCAGCA ATGTGCTTCC GGAG | — |
| $stx_2$ | M36727 | AGCAG TTCTGCGTTT TGTCACTGTC ACA...TGGC ACTGTCTGA. ..AACTGCTC CTGTTTA...G AGAATCAGCA ATGTGCTTCC GGAG | — |
| $stx_2$ | U72191 | AGCAG TTCTGCGTTT TGTCACTGTC ACA...TGGC ACTGTCTGA. ..AACTGCTC CTGTTTA...G AGAATCAGCA ATGTGCTTCC GGAG | — |
| $stx_2$ | X81415 | AGCAG TTCTGCGTTT TGTCACTGTC ACA...TGGC ACTGTCTGA. ..AACTGCTC CTGTTTA...G AGAATCAGCA ATGTGCTTCC GGAG | — |
| $stx_2$ | X81416 | AGCAG TTCTGCGTTT TGTCACTGTC ACA...TGGC ACTGTCTGA. ..AACTGCTC CTGTTTA...G AGAATCAGCA ATGTGCTTCC GGAG | — |
| $stx_2$ | X81417 | AGCAG TTCTGCGTTT TGTCACTGTC ACA...TGGC ACTGTCTGA. ..AACTGCTC CTGTTTA...G AGAATCAGCA ATGTGCTTCC GGAG | — |
| $stx_2$ | X81418 | AGCAG TTCTGCGTTT TGTCACTGTC ACA...TGGC ACTGTCTGA. ..AACTGCTC CTGTTTA...G AGAATCAGCA ATGTGCTTCC GGAG | — |
| $stx_2$ | E03962 | AGCAG TTCTGCGTTT TGTCACTGTC ACA...AGGC ACTGTCTGA. ..AACTGCTC CTGTGTA...G CGAATCAGCA ATGTGCTTCC GGAG | — |
| $stx_2$ | E03959 | AGCAG TTCTGCGTTT TGTCACTGTC ACA...AGGC ACTGTCTGA. ..AACTGCTC CTGTGTA...G CGAATCAGCA ATGTGCTTCC GGAG | — |
| $stx_2$ | X07865 | AGCAG TTCTGCGTTT TGTCACTGTC ACA...AGGC ACTGTCTGA. ..AACTGCTC CTGTGTA...G CGAATCAGCA ATGTGCTTCC GGAG | — |
| $stx_2$ | Y10775 | AGCAG TTCTGCGTTT TGTCACTGTC ACA...AGGC ACTGTCTGA. ..AACTGCTC CTGTGTA...G CGAATCAGCA ATGTGCTTCC GGAG | — |
| $stx_2$ | Z37725 | AGCAG TTCTGCGTTT TGTCACTGTC ACA...AGGC ACTGTCTGA. ..AACTGCTC CTGTGTA...G CGAATCAGCA ATGTGCTTCC GGAG | 1077 |

-continued

Annex XXVII: Strategy for the selection of $stx_2$-specific amplification primers and hybridization probe.

| Accession # | 543 570 614 641 684 708 | SEQ ID NO.: |
|---|---|---|
| $stx_2$ Z50754 | AGC**AG TTCTGCGTTT TGTCACTGTC** ACA...AGG**C ACTGTCTGA**. ..**AACTGCTC CTGT**GTA...G CG**AATCAGCA ATGTGCTTCC G**GAG | — |
| $stx_2$ X67514 | AGC**AG TTCTGCGTTT TGTCACTGTC** ACA...AGG**C ACTGTCTGA**. ..**AACTGCTC CTGT**GTA...G CG**AATCAGCA ATGTGCTTCC G**GAG | — |
| $stx_2$ L11078 | AGC**AG TTCTGCGTTT TGTCACTGTC** ACA...AGG**C ACTGTCTGA**. ..**AACTGCTC CTGT**GTA...G AG**AATCAGCA ATGTGCTTCC G**GAG | — |
| $stx_2$ X65949 | AGC**AG TTCTGCGTTT TGTCACTGTC** ACA...AGG**C ACTGTCTGA**. ..**AACTGCTC CTGT**GTA...G AG**AATCAGCA ATGTGCTTCC G**GAG | — |
| $stx_2$ AF043627 | AGC**AG TTCTGCGTTT TGTCACTGTC** ACA...TGG**C ACTGTCTGA**. ..**AACTGCTC CTGT**TTA...G AG**AATCAGCA ATGTGCTTCC G**GAG | — |
| Selected sequence for amplification primer | **AG TTCTGCGTTT TGTCACTGTC** | 1078 |
| Selected sequence for hybridization probe | **C ACTGTCTGA**. ..**AACTGCTC CTGT** | 1085 |
| Selected sequence for amplification primer[a] | **AATCAGCA ATGTGCTTCC G** | 1079 |

The sequence numbering refers to the *Escherichia coli* $stx_2$ gene fragment (SEQ ID NO. 1077). Nucleotides in capitals are identical to the selected sequences or match those sequences. Mismatches are indicated by lower-case letters. Dots indicate gaps in the sequences displayed.

[a]This sequence is the reverse-complement of the selected primer.

Annex XXVIII: Strategy for the selection of vanA-specific amplification primers from van sequences.

| Accession # | 926 952 1230 1255 | SEQ ID NO.: |
|---|---|---|
| vanA X56895 | GTC**AAT AGCGCGGACG AATTGGAC**TA C...GT A**GAGGTCTAG CCCGTGTGGA T**ATG | 1139 |
| vanA M97297 | GTC**AAT AGCGCGGACG AATTGGAC**TA C...GT A**GAGGTCTAG CCCGTGTGGA T**ATG | 1141 |
| vanA — | GTC**AAT AGCGCGGACG AATTGGAC**TA C...GT A**GAGGTCTAG CCCGTGTGGA T**ATG | 1051 |
| vanA — | GTC**AAT AGCGCGGACG AATTGGAC**TA C...GT A**GAGGTCTAG CCCGTGTGGA T**ATG | 1052 |
| vanA — | GTC**AAT AGCGCGGACG AATTGGAC**TA C...GT A**GAGGTCTAG CCCGTGTGGA T**ATG | 1053 |
| vanA — | GTC**AAT AGCGCGGACG AATTGGAC**TA C...GT A**GAGGTCTAG CCCGTGTGGA T**ATG | 1054 |
| vanA — | GTC**AAT AGCGCGGACG AATTGGAC**TA C...GT A**GAGGTCTAG CCCGTGTGGA T**ATG | 1055 |
| vanA — | GTC**AAT AGCGCGGACG AATTGGAC**TA C...GT A**GAGGTCTAG CCCGTGTGGA T**ATG | 1056 |
| vanA — | GTC**AAT AGCGCGGACG AATTGGAC**TA C...GT A**GAGGTCTAG CCCGTGTGGA T**ATG | 1057 |
| vanA — | GTC**AAT AGCGCGGACG AATTGGAC**TA C...GT A**GAGGTCTAG CCCGTGTGGA T**ATG | 1049 |
| vanA — | GTC**AAT AGCGCGGACG AATTGGAC**TA C...GT A**GAGGTCTAG CCCGTGTGGA T**ATG | 1050 |
| vanB U94526 | GTA**AAc gGtaCGGAaG AAcTtaAC**GC T...GC A**GAGGgCTtG CCCGTGTtGA T**CTT | 1117 |
| vanB U94527 | GTA**AAc AGtaCGGAaG AAcTaaAC**GC T...GC A**GAGGgCTtG CtCGTGTtGA T**CTT | — |
| vanB U94528 | GTA**AAc gGtaCGGAaG AAcTtaAC**GC T...GC A**GAGGgCTtG CCCGTGTtGA T**CTT | — |
| vanB U94529 | GTA**AAc gGtaCGGAaG AAcTtaAC**GC T...GC A**GAGGgCTtG CCCGTGTtGA T**CTT | — |
| vanB U94530 | GTA**AAc gGtaCGGAaG AAcTtaAC**GC T...GC A**GAGGgCTtG CCCGTGTtGA T**CTT | — |
| vanB Z83305 | GTA**AAc gGtaCGGAaG AAcTtaAC**GC T...GC A**GAGGgCTtG CCCGTGTtGA T**CTT | — |
| vanB U81452 | GTA**AAc gGtaCGGAaG AAcTtaAC**GC T...GC A**GAGGgCTtG CCCGTGTtGA T**CTT | — |
| vanB U35369 | GTA**AAc AGtaCGGAaG AAcTaaAC**GC T...GC A**GAGGgCTtG CtCGTGTtGA T**CTT | — |
| vanB U72704 | GTA**AAc gGtaCGGAaG AAcTtaAC**GC T...GC A**GAGGgCTtG CCCGTGTtGA T**CTT | — |
| vanB L06138 | GTA**AAc AGtaCGGAaG AAcTaaAC**GC T...GC A**GAGGgCTtG CtCGTGTtGA T**CTT | — |
| vanB L15304 | GTA**AAc gGtaCGGAaG AAcTtaAC**GC T...GC A**GAGGgCTtG CCCGTGTtGA T**CTT | — |
| vanB U00456 | GTA**AAc AGtaCGGAaG AAcTaaAC**GC T...GC A**GAGGgCTtG CtCGTGTtGA T**CTT | — |
| vanD AF130997 | GTA**tgc AagGCaGAaG AAcTGcAg**GC A...GC A**GAGGatTgG CCCGcaTtGA c**CTG | — |
| vanE AF136925 | GTA**gAa caaaaaagtG AtTTatAt**AA A...GC A**aAGGatTAG CgaGaaTcGA c**TTT | — |
| Selected sequence for amplification primer | **AAT AGCGCGGACG AATTGGAC** | 1090 |
| Selected sequence for amplification primer[a] | **GAGGTCTAG CCCGTGTGGA T** | 1089 |

The sequence numbering refers to the *Enterococcus faecium* vanA gene fragment (SEQ ID NO. 1139). Nucleotides in capitals are identical to the selected sequences or match those sequences. Mismatches are indicated by lower-case letters. Dots indicate gaps in the sequences displayed.
[a]This sequence is the reverse-complement of the above selected primer.

Annex XXIX: Strategy for the selection of vanB-specific amplification primers from van sequences.

| Accession # | 470 495 608 633 | SEQ ID NO.: |
|---|---|---|
| vanA X56895 | A CG**CaATtGAA tCgGCAaGAC AA**TAT...ACG **GaATCTTtCG tATtCATCAG** GAA | 1139 |
| vanA M97297 | A CG**CaATtGAA tCgGCAaGAC AA**TAT...ACG **GaATCTTtCG tATtCATCAG** GAA | 1141 |
| vanA — | A CG**CaATtGAA tCgGCAaGAC AA**TAT...ACG **GaATCTTtCG tATtCATCAG** GAA | 1051 |

-continued

Annex XXIX: Strategy for the selection of vanB-specific amplification primers from van sequences.

| Accession # | 470 495 608 633 | SEQ ID NO.: |
|---|---|---|
| vanA — | A CGCaATtGAA tCgGCAaGAC AATAT...ACG GaATCTTtCG tATtCATCAG GAA | 1052 |
| vanA — | A CGCaATtGAA tCgGCAaGAC AATAT...ACG GaATCTTtCG tATtCATCAG GAA | 1053 |
| vanA — | A CGCaATtGAA tCgGCAaGAC AATAT...ACG GaATCTTtCG tATtCATCAG GAA | 1054 |
| vanA — | A CGCaATtGAA tCgGCAaGAC AATAT...ACG GaATCTTtCG tATtCATCAG GAA | 1055 |
| vanA — | A CGCaATtGAA tCgGCAaGAC AATAT...ACG GaATCTTtCG tATtCATCAG GAA | 1056 |
| vanA — | A CGCaATtGAA tCgGCAaGAC AATAT...ACG GaATCTTtCG tATtCATCAG GAA | 1057 |
| vanA — | A CGCaATtGAA tCgGCAaGAC AATAT...ACG GaATCTTtCG tATtCATCAG GAA | 1049 |
| vanA — | A CGCaATtGAA tCgGCAaGAC AATAT...ACG GaATCTTtCG tATtCATCAG GAA | 1050 |
| vanB U94526 | C TGCGATAGAA GCgGCAGGAC AATAT...ACG GTATCTTCCG CATCCATCAG GAA | 1117 |
| vanB U94527 | C TGCGATAGAA GCAGCAGGAC AATAT...ACG GTATCTTCCG CATCCATCAG GAA | — |
| vanB U94528 | C TGCGATAGAA GCgGCAGGAC AATAT...ACG GTATCTTCCG CATCCATCAG GAA | — |
| vanB U94529 | C TGCGATAGAA GCgGCAGGAC AATAT...ACG GTATCTTCCG CATCCATCAG GAA | — |
| vanB U94530 | C TGCGATAGAA GCgGCAGGAC AATAT...ACG GTATCTTCCG CATCCATCAG GAA | — |
| vanB Z83305 | C TGCGATAGAA GCgGCAGGAC AATAT...ACG GTATCTTCCG CATCCATCAG GAA | — |
| vanB U81452 | C TGCGATAGAA GCgGCAGGAC AATAT...ACG GTATCTTCCG CATCCATCAG GAA | — |
| vanB U35369 | C TGCGATAGAA GCAGCAGGAC AATAT...ACG GTATCTTCCG CATCCATCAG GAA | — |
| vanB U72704 | C TGCGATAGAA GCgGCAGGAC AATAT...ATG GTATCTTCCG CATCCATCAG GAA | — |
| vanB L06138 | C TGCGATAGAA GCAGCAGGAC AATAT...ACG GTATCTTCCG CATCCATCAG GAA | — |
| vanB L15304 | C TGCGATAGAA GCgGCAGGAC AATAT...ACG GTATCTTCCG CATCCATCAG GAA | — |
| vanB U00456 | C TGCGATAGAA GCAGCAGGAC AATAT...ACG GTATCTTCCG CATCCATCAG GAA | — |
| vanD AF130997 | C AGCaATcGAA GaAGCAaGAa AATAT...ACG GctTtTTtaa gATtCATCAG GAA | — |
| vanE AF136925 | A AGCaATAGAc GaAGCttcAa AATAT...ATG GctTtTTCga CtatgAagAG AAA | — |
| Selected sequence for amplification primer | CGATAGAA GCAGCAGGAC AA | 1095 |
| Selected sequence for amplification primer[a] | GTATCTTCCG CATCCATCAG | 1096 |

The sequence numbering refers to the *Enterococcus faecium* vanB gene fragment (SEQ ID NO. 1117). Nucleotides in capitals are identical to the selected sequences or match those sequences. Mismatches are indicated by lower-case letters. Dots indicate gaps in the sequences displayed.

[a]This sequence is the reverse-complement of the above vanB sequence.

Annex XXX: Strategy for the selection of vanC-specific amplification primers from vanC sequences.

| Accession # | 929 957 1064 1092 | SEQ ID NO.: |
|---|---|---|
| vanC1 — | GT CGACGGTTTT TTTGATTTTG AAGAGAA...ACGGGTC TGGCTCGAAT CGATTTTTTC GT | 1058 |
| vanC1 — | GT CGACGGTTTT TTTGATTTTG AAGAGAA...ACGGGTC TGGCTCGAAT CGATTTTTTC GT | 1059 |
| vanC1 M75132 | GT CGACGGTTTT TTTGATTTTG AAGAGAA...ACGGGTC TGGCTCGAAT CGATTTTTTC GT | 1138 |
| vanC2 — | GT AGACGGCTTT TTCGATTTTG AAGAAAA...AAAGGTC TTGCTCGCAT CGACTTTTTT GT | 1060 |
| vanC2 — | GT AGACGGCTTT TTCGATTTTG AAGAAAA...AAAGGTC TTGCTCGCAT CGACTTTTTT GT | 1061 |
| vanC2 — | GT AGACGGCTTT TTCGATTTTG AAGAAAA...AAAGGTC TTGCTCGCAT CGACTTTTTT GT | 1062 |
| vanC2 — | GT AGACGGCTTT TTCGATTTTG AAGAAAA...AAAGGTC TTGCTCGCAT CGACTTTTTT GT | 1063 |

| | Accession # | 929 | 957 | 1064 | 1092 | SEQ ID NO.: |
|---|---|---|---|---|---|---|
| Annex XXX: Strategy for the selection of vanC-specific amplification primers from vanC sequences. | | | | | | |
| vanC2 | L29638 | GT AGACGGCTTT TTCGATTTTG AAGAAAA...AAAGGTC TTGCTCGCAT CGACTTTTTT GT | | | | — |
| vanC2 | L29638 | GT AGACGGCTTT TTCGATTTTG AAGAAAA...AAAGGTC TTGCTCGCAT CGACTTTTTT GT | | | | — |
| vanC3 | — | GT AGACGGCTTT TTCGATTTTG AAGAAAA...AAAGGTC TTGCTCGCAT CGACTTTTTT GT | | | | 1064 |
| vanC3 | — | GT AGACGGCTTT TTCGATTTTG AAGAAAA...AAAGGTC TTGCTCGCAT CGACTTTTTT GT | | | | 1065 |
| vanC3 | — | GT AGACGGCTTT TTCGATTTTG AAGAAAA...AAAGGaC TTGCTCGCAT CGACTTTTTT GT | | | | 1066 |
| vanC3 | L29639 | GT AGACGGCTTT TTCGATTTTG AAGAAAA...AAAGGTC TTGCTCGCAT CGACTTTTTT GT | | | | — |
| Selected sequence for resistance primer | | GACGGYTTT TTYGATTTTG AAGA | | | | 1101 |
| Selected sequence for resistance primer[a] | | | | GGTC TKGCTCGMAT CGAYTTTTT | | 1102 |

The sequence numbering refers to the vanC1 gene fragment (SEQ ID NO. 1138). Nucleotides in capitals are identical to the selected sequences or match those sequences. Mismatches are indicated by lower-case letters. Dots indicate gaps in the sequence displayed. "R" "Y" "M" "K" "W" and "S" designate nucleotide positions which are degenerated. "R" stands for A or G; "Y" stands for C or T; "M" stands for A or C; "K" stands for G or T; "W" stands for A or T; "S" stands for C or G. "I" stands for inosine which is a nucleotide analog that can bind to any of the four nucleotides A, C, G or T.
[a]This sequence is the reverse-complement of the selected sequence.

Annex XXXI: Strategy for the selection of *Streptococcus pneumoniae*-specific amplification primers and hybridization probes from pbp1a sequences.

| | Accession # | 453 505 678 706 | SEQ ID NO.: |
|---|---|---|---|
| pbp1a | M90528 | A TTGACTAcCC AAGCATaCAc TATGCtAAtG CtATTTCAAG TAATACAACC GA...TATATG ATGACaGAtA TGATGAAAAC CGT... | — |
| pbp1a | X67873 | A TCGACTAcCC AAGtATtCAc TActCAAAtG CCATTTCAAG TAAcACAACC GA...TATATG ATGACCGAAA TGATGAAAAC AGT... | — |
| pbp1a | AB006868 | A TCGACTAcCC AAGtATtCAc TActCAAAtG CCATTTCAAG TAAcACAACC GA...TATATG ATGACCGACA TGATGAAAAC AGT... | — |
| pbp1a | AF046234 | A TCGACTAcCC AAGtATtCAc TActCAAAtG CCATTTCAAG TAAcACAACC GA...TATATG ATGACCGAAA TGATGAAAAC TGT... | — |
| pbp1a | | A TCGACTAcCC AAGtATtCAc TActCAAAtG CCATTTCAAG TAAcACAACC GA...TATATG ATGACCGACA TGATGAAAAC TGT... | 1014 |
| pbp1a | | A TCGACTAcCC AAGtATtCAc TActCAAAtG CCATTTCAAG TAAcACAACC GA...TACATG ATGACCGAAA TGATGAAAAC TGT... | 1017 |
| pbp1a | AB006873 | A TCGACTAcCC AAGtcTtCAc TActCAAAtG CCATTTCAAG TAAcACAACC GA...TATATG ATGACCGACA TGATGAAAAC AGT... | — |
| pbp1a | AF139883 | A TCGACTATCC AAGCATGCAT TATGCAAACG CCATTTCAAG TAATACAACA GA...TATATG ATGACCGACA TGATGAAAAC AGT... | 1169 |
| pbp1a | | A TCGACTATCC AAGCATGCAT TATGCAAACG CCATTTCAAG TAATACAACA GA...TATATG ATGACCGACA TGATGAAAAC AGT... | 1004 |
| pbp1a | | A TCGACTATCC AAGCATGCAT TATGCAAACG CCATTTCAAG TAATACAACA GA...TATATG ATGACCGACA TGATGAAAAC AGT... | 1007 |
| pbp1a | | A TCGACTATCC AAGCATGCAT TATGCAAACG CCATTTCAAG TAATACAACA GA...TATATG ATGACCGACA TGATGAAAAC AGT... | 1008 |
| pbp1a | | A TCGACTATCC AAGCATGCAT TATGCAAACG CCATTTCAAG TAATACAACA GA...TATATG ATGACCGACA TGATGAAAAC AGT... | 1009 |
| pbp1a | | A TCGACTATCC AAGCATGCAT TATGCAAACG CCATTTCAAG TAATACAACA GA...TATATG ATGACCGACA TGATGAAAAC AGT... | 1011 |
| pbp1a | AF159448 | A TCGACTATCC AAGCATGCAT TATGCAAACG CCATTTCAAG TAATACAACA GA...TATATG ATGACCGACA TGATGAAAAC AGT... | — |
| pbp1a | | A TCGACTATCC AAGCATGCAT TATGCAAACG CCATTTCAAG TAATACAACA GA...TACATG ATGACCGAAA TGATGAAAAC TGT... | 1005 |
| pbp1a | | A TCGACTATCC AAGCATGCAT TATGCAAACG CCATTTCAAG TAATACAACA GA...TACATG ATGACCGAAA TGATGAAAAC TGT... | 1015 |
| pbp1a | | A TCGACTATCC AAGCATGCAT TATGCAAACG CCATTTCAAG TAATACAACA GA...TACATG ATGACCGAAA TGATGAAAAC TGT... | 1006 |
| pbp1a | | A TCGACTATCC AAGCATGCAT TATGCAAACG CCATTTCAAG TAATACAACA GA...TACATG ATGACCGAAA TGATGAAAAC TGT... | 1012 |
| pbp1a | X67867 | A TCGACTATCC AAGCATGCAT TATGCAAACG CCATTTCAAG TAATACAACA GA...TACATG ATGACCGAAA TGATGAAAAC TGT... | — |
| pbp1a | | A TCGACTATCC AAGCATGCAT TATGCAAACG CCATTTCAAG TAAcACAACT GA...TATATG ATGACtGAAA TGATGAAAAC TGT... | 1010 |
| pbp1a | Z49094 | A TCGACTATCC AAGCATGCAT TATGCAAACG CCATTTCAAG TAAcACAACT GA...TATATG ATGACtGAAA TGATGAAAAC TGT... | — |
| pbp1a | | A TCGACTATCC AAGCATGCAT TATGCAAACG CCATTTCAAG TAAcACAACT GA...TATATG ATGACtGAAA TGATGAAAAC TGT... | 1013 |
| pbp1a | | A TCGACTATCC AAGCATGCAT TATGCAAACG CCATTTCAAG TAAcACAACT GA...TATATG ATGACtGAAA TGATGAAAAC TGT... | 1016 |

-continued

| | | |
|---|---|---|
| pbp1a X67870 | A TCGACTATCC AAGtATGCAT TAcGCAAACG CCATTTCAAG TAAcACAACT GA...TATATG ATGACCGAAA TGATGAAAAC TGT... | — |
| pbp1a | A TTGACTATCC AAGtATtCAc TActCAAAtG CtATTTCAAG TAATACAACT GA...TATATG ATGACtGAAA TGATGAAAAC TGT... | 1018 |
| pbp1a AJ002290 | A TTGAtTAcCC AActATGgtc TATGCtAACG CtATTTCAAG TAATACAACT GA...TACATG ATGACtGAAA TGATGAAAAC AGT... | — |
| pbp1a X67871 | A TCGACTAcCC AAGtcTtCAc TActCAAAtG CCATTTCAAG TAAcACAACC GA...TACATG ATGACaGAAA TGATGAAAAC AGT... | — |
| Selected sequences for amplification primers | GACTATCC AAGCATGCAT TATG<br>ATG ATGACHGAMA TGATGAAAAC | 1130<br>1129 |
| Selected sequence for hybridization probe | CAAACG CCATTTCAAG TAATACAAC | 1197 |

The sequence numbering refers to the *Streptococcus pneumoniae* pbp1a gene fragment (SEQ ID NO. 1004). Nucleotides in capitals are identical to the selected sequences or match those sequences. Mismatches are indicated by lower-case letters. Dotes indicate gaps in the sequences displayed.
"R" "Y" "M" "K" "W" and "S" designate nucleotide positions which are degenerated. "R" stands for A or G; "Y" stands for C or T; "M" stands for A or C; "K" stands for G or T; "W" stands for A or T; "H" stands for A, C or T; "S" stands for C or G. "I" stands for inosine which is a nucleotide analog that can bind to any of the four nucleotides A, C, G or T.

| Accession # | 756 783 813 840 | SEQ ID NO.: |
|---|---|---|
| pbp1a M90528 | ...GCTGGTAA aACtGGTACg TCTaACTATA...A ATACgGGTTA TGTAGCTCCG GAcGAAA | — |
| pbp1a X67873 | ...GCTGGTAA aACAGGaACc TCTAACTATA...A CCtCTcaaTt TGTAGCaCCt GATGAAC | — |
| pbp1a AB006868 | ...GCTGGTAA aACAGGaACc TCTAACTATA...A CCtCTcaaTt TGTAGCaCCt GAcGAAC | — |
| pbp1a AF046234 | ...GCAGGTAA aACAGGTACT TCTAACTATA...A ACACTGGTTA CGTAGCTCCA GATGAAA | — |
| pbp1a | ...GCAGGTAA aACAGGTACT TCTAACTATA...A ACACTGGTTA CGTAGCTCCA GATGAAA | 1014 |
| pbp1a | ...GCTGGTAA GACAGGTACT TCTAACTACA...A ACACTGGCTA TGTAGCTCCA GATGAAA | 1017 |
| pbp1a AB006873 | ...GCAGGTAA GACAGGTACT TCTAACTATA...A ACACTGGCTA CGTAGCTCCA GATGAAA | — |
| pbp1a AF139883 | ...GCTGGTAA aACAGGaACc TCTAACTATA...A ACACTGGCTA TGTAGCTCCA GATGAAA | 1169 |
| pbp1a | ...GCTGGTAA aACAGGaACc TCTAACTATA...A ACACTGGCTA TGTAGCTCCA GATGAAA | 1004 |
| pbp1a | ...GCTGGTAA aACAGGaACc TCTAACTATA...A ACACTGGCTA TGTAGCTCCA GATGAAA | 1007 |
| pbp1a | ...GCTGGTAA aACAGGaACc TCTAACTATA...A ACACTGGCTA TGTAGCTCCA GATGAAA | 1008 |
| pbp1a | ...GCTGGTAA aACAGGaACc TCTAACTATA...A ACACTGGCTA TGTAGCTCCA GATGAAA | 1009 |
| pbp1a | ...GCTGGTAA aACAGGaACc TCTAACTATA...A ACACTGGCTA TGTAGCTCCA GATGAAA | 1011 |
| pbp1a AF159448 | ...GCTGGTAA aACAGGaACc TCTAACTATA...A ACACTGGCTA TGTAGCTCCA GATGAAA | — |
| pbp1a | ...GCTGGTAA GACAGGTACT TCTAACTACA...A ACACTGGCTA TGTAGCTCCA GATGAAA | 1005 |
| pbp1a | ...GCTGGTAA GACAGGTACT TCTAACTACA...A ACACTGGCTA TGTAGCTCCA GATGAAA | 1015 |

-continued

| | | | |
|---|---|---|---|
| pbp1a | | ...GCTGGTAA GACAGGTACT TCTAACTACA...A ACACTGGCTA TGTAGCTCCA GATGAAA | 1006 |
| pbp1a | | ...GCTGGTAA GACAGGTACT TCTAACTACA...A ACACTGGCTA TGTAGCTCCA GATGAAA | 1012 |
| pbp1a | X67867 | ...GCTGGTAA GACAGGTACT TCTAACTACA...A ACACTGGCTA TGTAGCTCCA GATGAAA | — |
| pbp1a | | ...GCAGGTAA GACAGGTACT TCTAACTATA...A ACACTGGTTA CGTAGCTCCA GATGAAA | 1010 |
| pbp1a | Z49094 | ...GCAGGTAA GACAGGTACT TCTAACTATA...A ACACTGGTTA CGTAGCTCCA GATGAAA | — |
| pbp1a | | ...GCAGGTAA GACAGGTACT TCTAACTATA...A ACACTGGCTA CGTAGCTCCA GATGAAA | 1013 |
| pbp1a | | ...GCAGGTAA GACAGGTACT TCTAACTATA...A ACACTGGCTA CGTAGCTCCA GATGAAA | 1016 |
| pbp1a | X67870 | ...GCAGGTAA GACAGGTACT TCTAACTATA...A ACACTGGCTA CGTAGCTCCA GATGAAA | — |
| pbp1a | | ...GCAGGTAA GACAGGTACT TCTAACTATA...A ACACTGGCTA CGTAGCTCCA GATGAAA | 1018 |
| pbp1a | AJ002290 | ...GCAGGTAA GACgGGTACa TCTAACTACA...A ACACTGGCTA C~~~~~~~~~ ~~~~~~~ | — |
| pbp1a | X67871 | ...GCTGGTAA aACAGGTACc TCTAACTATA...A ACACTGGTTA CGTAGCTCCA GATGAAA | — |
| Selected sequence for hybridization probe | | GGTAA GACAGGTACT TCTAACT | 1193 |
| Selected sequence for amplification primer[a] | | ACTGGYTA YGTAGCTCCA GATG | 1131 |

The sequence numbering refers to the *Streptococcus pneumoniae* pbp1a gene fragment (SEQ ID NO. 1004). Nucleotides in capitals are identical to the selected sequences or match those sequences. Mismatches are indicated by lower-case letters. Dots indicate gaps in the sequences displayed.

"~" indicates incomplete sequence data.

"R" "Y" "W" and "S" designate nucleotide positions which are degenerated. "R" stands for A or G; "Y" stands for C or T; "W" stands for A or T; "S" stands for C or G. "I" stands for inosine which is a nucleotide analog that can bind to any of the four nucleotides A, C, G or T.

[a]This sequence is the reverse-complement of the selected primer.

Annex XXXII: Specific and ubiquitous primers for nucleic acid amplification (toxin sequences).

| SEQ ID NO. | Nucleotide sequence | Originating DNA fragment SEQ ID NO. | Originating DNA fragment Nucleotide position |
|---|---|---|---|
| | Toxin gene: cdtA | | |
| 2123 | 5'-TCT ACC ACT GAA GCA TTA C | 2129[a] | 442-460 |
| 2124[b] | 5'-TAG GTA CTG TAG GTT TAT TG | 2129[a] | 580-599 |
| | Toxin gene: cdtB | | |
| 2126 | 5'-ATA TCA GAG ACT GAT GAG | 2130[a] | 2665-2682 |
| 2127[b] | 5'-TAG CAT ATT CAG AGA ATA TTG T | 2130[a] | 2746-2767 |
| | Toxin gene: $stx_1$ | | |
| 1081 | 5'-ATG TCA GAG GGA TAG ATC CA | 1076[a] | 233-252 |
| 1080[b] | 5'-TAT AGC TAC TGT CAC CAG ACA ATG T | 1076[a] | 394-418 |
| | Toxin gene: $stx_2$ | | |
| 1078 | 5'-AGT TCT GCG TTT TGT CAC TGT C | 1077[a] | 546-567 |
| 1079[b] | 5'-CGG AAG CAC ATT GCT GAT T | 1077[a] | 687-705 |
| | Toxin genes: $stx_1$ and $stx_2$ | | |
| 1082 | 5'-TTG ARC RAA ATA ATT TAT ATG TG | 1076[a] | 278-300 |
| 1083[b] | 5'-TGA TGA TGR CAA TTC AGT AT | 1076[a] | 781-800 |

[a]Sequences from databases.

[b]These sequences are from the complementary DNA strand of the sequence of the originating fragment given in the Sequence Listing.

Annex XXXIII: Molecular beacon internal hybridization probes for specific detection of toxin sequences.

| SEQ ID NO. | Nucleotide sequence[a] | Originating DNA fragment SEQ ID NO. | Originating DNA fragment Nucleotide position |
|---|---|---|---|
| | Toxin gene: cdtA | | |
| 2125[b] | 5'-CAC GCG GAT TTT GAA TCT CTT CCT CTA GTA GCG CGT G | 2129[c] | 462-488 |
| | Toxin gene: cdtB | | |
| 2128 | 5'-CAA CGC TGG AGA ATC TAT ATT TGT AGA AAC TGC GTT G | 2130[c] | 2714-2740 |
| | Toxin gene: $stx_1$ | | |
| 1084 | 5'-CCA CGC CGC TTT GCT GAT TTT TCA CAT GTT ACC GCG TGG | 1076[c] | 337-363 |
| 2012[d] | 5'-CCG CGG ATT ATT AAA CCG CCC TTC CGC GG-MR-HEG-ATG TCA GAG GGA TAG ATC CA | 1076[c] | 248-264 |

-continued

| Annex XXXIII: Molecular beacon internal hybridization probes for specific detection of toxin sequences. | | | |
|---|---|---|---|
| | | Originating DNA fragment | |
| SEQ ID NO. | Nucleotide sequence[a] | SEQ ID NO. | Nucleotide position |
| | Toxin gene: $stx_2$ | | |
| 1085 | 5'-CCA CGC CAC TGT CTG AAA CTG CTC CTG TG CGT GG | 1077[c] | 617-638 |

[a]Underlined nucleotides indicate the molecular beacon's stem.

[b]These sequences are from the complementary DNA strand of the sequence of the originating fragment given in the Sequence Listing.

[c]Sequences from databases.

[d]Scorpion primer.

| Annex XXXIV: Specific and ubiquitous primers for nucleic acid amplification (van sequences). | | | |
|---|---|---|---|
| | | Originating DNA fragment | |
| SEQ ID NO. | Nucleotide sequence | SEQ ID NO. | Nucleotide position |
| | Resistance gene: vanA | | |
| 1086 | 5'-CTA CTC CCG CCT TTT GGG TT | 1049-1057[a] | 513-532[b] |
| 1087[c] | 5'-CTC ACA GCC CGA AAC AGC CT | 1049-1057[a] | 699-718[b] |
| 1086 | 5'-CTA CTC CCG CCT TTT GGG TT | 1049-1057[a] | 513-532[b] |
| 1088[c] | 5'-TGC CGT TTC CTG TAT CCG TC | 1049-1057[a] | 885-904[b] |
| 1086 | 5'-CTA CTC CCG CCT TTT GGG TT | 1049-1057[a] | 513-532[b] |
| 1089[c] | 5'-ATC CAC ACG GGC TAG ACC TC | 1049-1057[a] | 933-952[b] |
| 1090 | 5'-AAT AGC GCG GAC GAA TTG GAC | 1049-1057[a] | 629-649[b] |
| 1091[c] | 5'-AAC GCG GCA CTG TTT CCC AA | 1049-1057[a] | 734-753[b] |
| 1090 | 5'-AAT AGC GCG GAC GAA TTG GAC | 1049-1057[a] | 629-649[b] |
| 1089[c] | 5'-ATC CAC ACG GGC TAG ACC TC | 1049-1057[a] | 933-952[b] |
| 1092 | 5'-TCG GCA AGA CAA TAT GAC AGC | 1049-1057[a] | 662-682[b] |
| 1088[c] | 5'-TGC CGT TTC CTG TAT CCG TC | 1049-1057[a] | 885-904[b] |
| | Resistance gene: vanB | | |
| 1095 | 5'-CGA TAG AAG CAG CAG GAC AA | 1117[d] | 473-492 |
| 1096[c] | 5'-CTG ATG GAT GCG GAA GAT AC | 1117[d] | 611-630 |
| | Resistance genes: vanA, vanB | | |
| 1112 | 5'-GGC TGY GAT ATT CAA AGC TC | 1049-1057, 1117[a] | 437-456[b] |
| 1113[c] | 5'-ACC GAC CTC ACA GCC CGA AA | 1049-1057, 1117[a] | 705-724[b] |
| 1112 | 5'-GGC TGY GAT ATT CAA AGC TC | 1049-1057, 1117[a] | 437-456[b] |
| 1114[c] | 5'-TCW GAG CCT TTT TCC GGC TCG | 1049-1057, 1117[a] | 817-837[b] |
| 1115 | 5'-TTT CGG GCT GTG AGG TCG GBT GHG CG | 1049-1057, 1117[a] | 705-730[b] |
| 1114[c] | 5'-TCW GAG CCT TTT TCC GGC TCG | 1049-1057, 1117[a] | 817-837[b] |
| 1116 | 5'-TTT CGG GCT GTG AGG TCG GBT GHG CGG | 1049-1057, 1117[a] | 705-731[b] |
| 1114[c] | 5'-TCW GAG CCT TTT TCC GGC TCG | 1049-1057, 1117[a] | 817-837[b] |

-continued

| | | | |
|---|---|---|---|
| 1112 | 5'-GGC TGY GAT ATT CAA AGC TC | 1049-1057, 1117[a] | 437-456[b] |
| 1118[c] | 5'-TTT TCW GAG CCT TTT TCC GGC TCG | 1049-1057, 1117[a] | 817-840[b] |

[a]These sequences were aligned to derive the corresponding primer.
[b]The nucleotide positions refer to the vanA sequence fragment (SEQ ID NO. 1051).
[c]These sequences are from the complementary DNA strand of the sequence of the originating fragment given in the Sequence Listing.
[d]Sequences from databases.

| | | | |
|---|---|---|---|
| 1115 | 5'-TTT CGG GCT GTG AGG TCG GBT GHG CG | 1049-1057, 1117[a] | 705-730[b] |
| 1118[c] | 5'-TTT TCW GAG CCT TTT TCC GGC TCG | 1049-1057, 1117[a] | 817-840[b] |
| 1116 | 5'-TTT CGG GCT GTG AGG TCG GBT GHG CGG | 1049-1057, 1117[a] | 705-731[b] |
| 1118[c] | 5'-TTT TCW GAG CCT TTT TCC GGC TCG | 1049-1057, 1117[a] | 817-840[b] |
| 1119 | 5'-TTT CGG GCT GTG AGG TCG GBT GHG C | 1049-1057, 1117[a] | 705-729[b] |
| 1118[c] | 5'-TTT TCW GAG CCT TTT TCC GGC TCG | 1049-1057, 1117[a] | 817-840[b] |
| 1120 | 5'-TTT CGG GCT GTG AGG TCG GBT GHG | 1049-1057, 1117[a] | 705-728[b] |
| 1118[c] | 5'-TTT TCW GAG CCT TTT TCC GGC TCG | 1049-1057, 1117[a] | 817-840[b] |
| 1121 | 5'-TGT TTG WAT TGT CYG GYA TCC C | 1049-1057, 1117[a] | 408-429[b] |
| 1111[c] | 5'-CTT TTT CCG GCT CGW YTT CCT GAT G | 1049-1057, 1117[a] | 806-830[b] |
| 1112 | 5'-GGC TGY GAT ATT CAA AGC TC | 1049-1057, 1117[a] | 437-456[b] |
| 1111[c] | 5'-CTT TTT CCG GCT CGW YTT CCT GAT G | 1049-1057, 1117[a] | 806-830[b] |
| 1123 | 5'-TTT CGG GCT GTG AGG TCG GBT G | 1049-1057, 1117[a] | 705-726[b] |
| 1111[c] | 5'-CTT TTT CCG GCT CGW YTT CCT GAT G | 1049-1057, 1117[a] | 806-830[b] |
| 1112 | 5'-GGC TGY GAT ATT CAA AGC TC | 1049-1057, 1117[a] | 437-456[b] |
| 1124[c] | 5'-GAT TTG RTC CAC YTC GCC RAC A | 1049-1057, 1117[a] | 757-778[b] |

Resistance gene: vanC1

| | | | |
|---|---|---|---|
| 1103 | 5'-ATC CCG CTA TGA AAA CGA TC | 1058-1059[a] | 519-538[d] |
| 1104[c] | 5'-GGA TCA ACA CAG TAG AAC CG | 1058-1059[a] | 678-697[d] |

Resistance genes: vanC1, vanC2, vanC3

| | | | |
|---|---|---|---|
| 1097 | 5'-TCY TCA AAA GGG ATC ACW AAA GTM AC | 1058-1066[a] | 607-632[d] |
| 1098[c] | 5'-TCT TCA AAA TCG AAA AAG CCG TC | 1058-1066[a] | 787-809[d] |
| 1099 | 5'-TCA AAA GGG ATC ACW AAA GTM AC | 1058-1066[a] | 610-632[d] |
| 1100[c] | 5'-GTA AAK CCC GGC ATR GTR TTG ATT TC | 1058-1066[a] | 976-1001[d] |
| 1101 | 5'-GAC GGY TTT TTY GAT TTT GAA GA | 1058-1066[a] | 787-809[d] |
| 1102[c] | 5'-AAA AAR TCG ATK CGA GCM AGA CC | 1058-1066[a] | 922-944[d] |

Resistance genes: vanC2, vanC3

| | | | |
|---|---|---|---|
| 1105 | 5'-CTC CTA CGA TTC TCT TGA YAA ATC A | 1060-1066, 1140[a] | 487-511[e] |
| 1106[c] | 5'-CAA CCG ATC TCA ACA CCG GCA AT | 1060-1066, 1140[a] | 690-712[e] |

[a]These sequences were aligned to derive the corresponding primer.
[b]The nucleotide positions refer to the vanA sequence fragment (SEQ ID NO. 1051).
[c]These sequences are from the complementary DNA strand of the sequence of the originating fragment given in the Sequence Listing.
[d]The nucleotide positions refer to the vanC1 sequence fragment (SEQ ID NO. 1058).
[e]The nucleotide positions refer to the vanC2 sequence fragment (SEQ ID NO. 1140).

-continued

| | | | |
|---|---|---|---|
| | Resistance gene: vanD | | |
| 1591 | 5'-ATG AGG TAA TAG AAC GGA TT | 1594 | 797-837 |
| 1592[b] | 5'-CAG TAT TTC AGT AAG CGT AAA | 1594 | 979-999 |
| | Resistance gene: vanE | | |
| 1595 | 5'-AAA TAA TGC TCC ATC AAT TTG CTG A | 1599[a] | 74-98 |
| 1596[b] | 5'-ATA GTC GAA AAA GCC ATC CAC AAG | 1599[a] | 394-417 |
| 1597 | 5'-GAT GAA TTT GCG AAA ATA CAT GGA | 1599[a] | 163-186 |
| 1598[b] | 5'-CAG CCA ATT TCT ACC CCT TTC AC | 1599[a] | 319-341 |
| | Sequencing primers (vanAB) | | |
| 1112 | 5'-GGC TGY GAT ATT CAA AGC TC | 1139[a] | 737-756 |
| 1111[b] | 5'-CTT TTT CCG GCT CGW YTT CCT GAT G | 1139[a] | 1106-1130 |
| | Sequencing primers (vanA, vanX, vanY) | | |
| 1150 | 5'-TGA TAA TCA CAC CGC ATA CG | 1141[a] | 860-879 |
| 1151[b] | 5'-TGC TGT CAT ATT GTC TTG CC | 1141[a] | 1549-1568 |
| 1152 | 5'-ATA AAG ATG ATA GGC CGG TG | 1141[a] | 1422-1441 |
| 1153[b] | 5'-CTC GTA TGT CCC TAC AAT GC | 1141[a] | 2114-2133 |
| 1154 | 5'-GTT TGA AGC ATA TAG CCT CG | 1141[a] | 2520-2539 |
| 1155[b] | 5'-CAG TGC TTC ATT AAC GTA GTC | 1141[a] | 3089-3109 |
| | Sequencing primers (vanC1) | | |
| 1110 | 5'-ACG AGA AAG ACA ACA GGA AGA CC | 1138[a] | 122-144 |
| 1109[b] | 5'-ACA TCG TGA TCG CTA AAA GGA GC | 1138[a] | 1315-1337 |
| | Sequencing primers (vanC2, vanC3) | | |
| 1108 | 5'-GTA AGA ATC GGA AAA GCG GAA GG | 1140[a] | 1-23 |
| 1107[b] | 5'-CTC ATT TGA CTT CCT CCT TTG CT | 1140[a] | 1064-1086 |

[a]Sequences from databases.
[b]These sequences are from the complementary DNA strand of the sequence of the originating fragment given in the Sequence Listing.

Annex XXXV: Internal hybridization probes for specific detection of van sequences.

| | | Originating DNA fragment | |
|---|---|---|---|
| SEQ ID NO. | Nucleotide sequence | SEQ ID NO. | Nucleotide position |
| | Resistance gene: vanA | | |
| 1170 | 5'-ACG AAT TGG ACT ACG CAA TT | 1049-1057[a] | 639-658[b] |
| 2292 | 5'-GAA TCG GCA AGA CAA TAT G | 2293[c] | 583-601 |
| | Resistance gene: vanB | | |
| 1171 | 5'-ACG AGG ATG ATT TGA TTG TC | 1117[c] | 560-579 |
| 2294 | 5'-AAA CGA GGA TGA TTT GAT TG | 2296[a] | 660-679 |
| 2295 | 5'-TTG AGC AAG CGA TTT CGG | 2296[a] | 614-631 |

-continued

Annex XXXV: Internal hybridization probes for specific detection of van sequences.

| SEQ ID NO. | Nucleotide sequence | Originating DNA fragment SEQ ID NO. | Originating DNA fragment Nucleotide position |
|---|---|---|---|
| | Resistance gene: vanD | | |
| 2297 | 5'-TTC AGG AGG GGG ATC GC | 1594[c] | 458-474 |

[a]These sequences were aligned to derive the corresponding primer.
[b]The nucleotide positions refer to the vanA sequence fragment (SEQ ID NO. 1051).
[c]Sequences from databases.

Annex XXXVI: Specific and ubiquitous primers for nucleic acid amplification (pbp sequences).

| SEQ ID NO. | Nucleotide sequence | Originating DNA fragment SEQ ID NO. | Originating DNA fragment Nucleotide position |
|---|---|---|---|
| | Resistance gene: pbp1a | | |
| 1129 | 5'-ATG ATG ACH GAM ATG ATG AAA AC | 1004-1018[a] | 681-703[b] |
| 1131[c] | 5'-CAT CTG GAG CTA CRT ARC CAG T | 1004-1018[a] | 816-837[b] |
| 1130 | 5'-GAC TAT CCA AGC ATG CAT TAT G | 1004-1018[a] | 456-477[b] |
| 1131 | 5'-CAT CTG GAG CTA CRT ARC CAG T | 1004-1018[a] | 816-837[b] |
| 2015 | 5'-CCA AGA AGC TCA AAA ACA TCT G | 2047[d] | 909-930 |
| 2016[c] | 5'-TAD CCT GTC CAW ACA GCC AT | 2047[d] | 1777-1796 |
| | Sequencing primers (pbp1a) | | |
| 1125 | 5'-ACT CAC AAC TGG GAT GGA TG | 1169[d] | 873-892 |
| 1126[c] | 5'-TTA TGG TTG TGC TGG TTG AGG | 1169[d] | 2140-2160 |
| 1125 | 5'-ACT CAC AAC TGG GAT GGA TG | 1169[d] | 873-892 |
| 1128[c] | 5'-GAC GAC YTT ATK GAT ATA CA | 1169[d] | 1499-1518 |
| 1127 | 5'-KCA AAY GCC ATT TCA AGT AA | 1169[d] | 1384-1403 |
| 1126[c] | 5'-TTA TGG TTG TGC TGG TTG AGG | 1169[d] | 2140-2160 |
| | Sequencing primers (pbp2b) | | |
| 1142 | 5'-GAT CCT CTA AAT GAT TCT CAG GTG G | 1172[d] | 1-25 |
| 1143[c] | 5'-CAA TTA GCT TAG CAA TAG GTG TTG G | 1172[d] | 1481-1505 |
| 1142 | 5'-GAT CCT CTA AAT GAT TCT CAG GTG G | 1172[d] | 1-25 |
| 1145[c] | 5'-AAC ATA TTK GGT TGA TAG GT | 1172[d] | 793-812 |
| 1144 | 5'-TGT YTT CCA AGG TTC AGC TC | 1172[d] | 657-676 |
| 1143[c] | 5'-CAA TTA GCT TAG CAA TAG GTG TTG G | 1172[d] | 1481-1505 |
| | Sequencing primers (pbp2x) | | |
| 1146 | 5'-GGG ATT ACC TAT GCC AAT ATG AT | 1173[d] | 219-241 |
| 1147[c] | 5'-AGC TGT GTT AGC VCG AAC ATC TTG | 1173[d] | 1938-1961 |
| 1146 | 5'-GGG ATT ACC TAT GCC AAT ATG AT | 1173[d] | 219-241 |

-continued

Annex XXXVI: Specific and ubiquitous primers for nucleic acid amplification (pbp sequences).

| SEQ ID NO. | Nucleotide sequence | Originating DNA fragment SEQ ID NO. | Nucleotide position |
|---|---|---|---|
| 1149[c] | 5'-TCC YAC WAT TTC TTT TTG WG | 1173[d] | 1231-1250 |
| 1148 | 5'-GAC TTT GTT TGG CGT GAT AT | 1173[d] | 711-730 |
| 1147[c] | 5'-AGC TGT GTT AGC VCG AAC ATC TTG | 1173[d] | 1938-1961 |

[a]These sequences were aligned to derive the corresponding primer.
[b]The nucleotide positions refer to the pbp1a sequence fragment (SEQ ID NO. 1004).
[c]These sequences are from the complementary DNA strand of the sequence of the originating fragment given in the Sequence Listing.
[d]Sequences from databases.

Annex XXXVII: Internal hybridization probes for specific detection of pbp sequences.

| SEQ ID NO. | Nucleotide sequence | Originating DNA fragment SEQ ID NO. | Nucleotide position |
|---|---|---|---|
| Resistance gene: pbp1a | | | |
| 1132 | 5'-AGT GAA AAR ATG GCT GCT GC | 1004-1018[a] | 531-550[b] |
| 1133 | 5'-CAT CAA GAA CAC TGG CTA YGT AG | 1004-1018[a] | 806-828[b] |
| 1134 | 5'-CTA GAT AGA GCT AAA ACC TTC CT | 1004-1018[a] | 417-439[b] |
| 1135 | 5'-CAT TAT GCA AAC GCC ATT TCA AG | 1004-1018[a] | 471-493[b] |
| 1192 | 5'-GGT AAA ACA GGA ACC TCT AAC T | 1004-1018[a] | 759-780[b] |
| 1193 | 5'-GGT AAG ACA GGT ACT TCT AAC T | 1004-1018[a] | 759-780[b] |
| 1194 | 5'-CAT TTC AAG TAA TAC AAC AGA ATC | 1004-1018[a] | 485-508[b] |
| 1195 | 5'-CAT TTC AAG TAA CAC AAC TGA ATC | 1004-1018[a] | 485-508[b] |
| 1196 | 5'-GCC ATT TCA AGT AAT ACA ACA GAA | 1004-1018[a] | 483-506[b] |
| 1197 | 5'-CAA ACG CCA TTT CAA GTA ATA CAA C | 1004-1018[a] | 478-502[b] |
| 1094 | 5'-GGT AAA ACA GGT ACT TCT AAC TA | 1004-1018[a] | 759-781[b] |
| 1214 | 5'-GGT AAA ACA GGT ACC TCT AAC TA | 1004-1018[a] | 759-781[b] |
| 1216 | 5'-GGT AAG ACT GGT ACA TCA AAC TA | 1004-1018[a] | 759-781[b] |
| 1217 | 5'-CAA ATG CCA TTT CAA GTA ACA CAA C | 1004-1018[a] | 478-502[b] |
| 1218 | 5'-CAA ACG CCA TTT CAA GTA ACA CAA C | 1004-1018[a] | 478-502[b] |
| 1219 | 5'-CAA ATG CTA TTT CAA GTA ATA CAA C | 1004-1018[a] | 478-502[b] |
| 1220 | 5'-CAA ACG CCA TTT CAA GTA ATA CGA C | 1004-1018[a] | 478-502[b] |
| 2017 | 5'-ACT TTG AAT AAG GTC GGT CTA G | 2047[c] | 1306-1327 |
| 2018 | 5'-ACA CTA AAC AAG GTT GGT TTA G | 2063 | 354-375 |
| 2019 | 5'-ACA CTA AAC AAG GTC GGT CTA G | 2064 | 346-367 |
| 2020 | 5'-GTA GCT CCA GAT GAA ATG TTT G | 2140[c] | 1732-1753 |
| 2021 | 5'-GTA GCT CCA GAC GAA ATG TTT G | 2057 | 831-852 |
| 2022 | 5'-GTA GCT CCA GAT GAA ACG TTT G | 2053[c] | 805-826 |

-continued

Annex XXXVII: Internal hybridization probes for specific detection of pbp sequences.

| SEQ ID NO. | Nucleotide sequence | Originating DNA fragment SEQ ID NO. | Originating DNA fragment Nucleotide position |
|---|---|---|---|
| 2023 | 5'-GTA ACT CCA GAT GAA ATG TTT G | 2056 | 819-840 |
| 2024 | 5'-AGT GAA AAG ATG GCT GCT GC | 2048[c] | 1438-1457 |
| 2025 | 5'-AGT GAG AAA ATG GCT GCT GC | 2047[c] | 1438-1457 |
| 2026 | 5'-TCC AAG CAT GCA TTA TGC AAA CG | 2047[c] | 1368-1390 |
| 2027 | 5'-TCG GTC TAG ATA GAG CTA AAA CG | 2047[c] | 1319-1341 |
| 2028 | 5'-TAT GCT CTT CAA CAA TCA CG | 2047[c] | 1267-1286 |
| 2029 | 5'-AGC CGT TGA GAC TTT GAA TAA G | 2047[c] | 1296-1317 |
| 2030 | 5'-CTT AAT GGT CTT GGT ATC G | 2047[c] | 1345-1366 |
| 2031 | 5'-CGT GAC TGG GGT TCT GCT ATG A | 2049[c] | 1096-1117 |
| 2032 | 5'-CGT GAC TGG GGA TCA TCA ATG A | 2047[c] | 1096-1117 |
| 2033 | 5'-CGT GAC TGG GGT TCT GCC ATG A | 2057 | 195-216 |
| 2034 | 5'-ATC AAG AAC ACT GGC TAT GTA G | 2050[c] | 787-808 |
| 2035 | 5'-ATC AAG AAC ACT GGC TAC GTA G | 2051[c] | 787-808 |
| 2036 | 5'-ATC AAG AAC ACT GGT TAC GTA G | 2047 | 1714-1735 |
| 2037 | 5'-ATC AAA AAT ACT GGT TAT GTA G | 2057 | 813-834 |
| 2038 | 5'-ATC AAG AAT ACT GGC TAC GTA G | 2052[c] | 757-778 |
| 2039 | 5'-ATC AAA AAC ACT GGC TAT GTA G | 2053[c] | 787-808 |

[a]These sequences were aligned to derive the corresponding primer.
[b]The nucleotide positions refer to the pbp1a sequence fragment (SEQ ID NO. 1004).
[c]Sequence from databases.

Annex XXXVIII: Strategy for the selection of vanAB-specific amplification primers and vanA- and vanB-specific hybridization probes from van sequences.

| | Accession # | 734 759 | 936 961 | SEQ ID NO.: |
|---|---|---|---|---|
| vanA | X56895 | GTA**GGCT GCGATATTCA AAGCTC**AGC... | CGG**ACGAATT GGACTACGCA ATT**GAA... | 1139 |
| vanA | M97297 | GTA**GGCT GCGATATTCA AAGCTC**AGC... | CGG**ACGAATT GGACTACGCA ATT**GAA... | 1141 |
| vanA | | GTA**GGCT GCGATATTCA AAGCTC**AGC... | CGG**ACGAATT GGACTACGCA ATT**GAA... | 1051 |
| vanA | | GTA**GGCT GCGATATTCA AAGCTC**AGC... | CGG**ACGAATT GGACTACGCA ATT**GAA... | 1052 |
| vanA | | GTA**GGCT GCGATATTCA AAGCTC**AGC... | CGG**ACGAATT GGACTACGCA ATT**GAA... | 1053 |
| vanA | | GTA**GGCT GCGATATTCA AAGCTC**AGC... | CGG**ACGAATT GGACTACGCA ATT**GAA... | 1054 |
| vanA | | GTA**GGCT GCGATATTCA AAGCTC**AGC... | CGG**ACGAATT GGACTACGCA ATT**GAA... | 1055 |
| vanA | | GTA**GGCT GCGATATTCA AAGCTC**AGC... | CGG**ACGAATT GGACTACGCA ATT**GAA... | 1056 |
| vanA | | GTA**GGCT GCGATATTCA AAGCTC**AGC... | CGG**ACGAATT GGACTACGCA ATT**GAA... | 1057 |
| vanA | | GTA**GGCT GCGATATTCA AAGCTC**AGC... | CGG**ACGAATT GGACTACGCA ATT**GAA... | 1049 |
| vanA | | GTA**GGCT GCGATATTCA AAGCTC**AGC... | CGG**ACGAATT GGACTACGCA ATT**GAA... | 1050 |

-continued

| | | | |
|---|---|---|---|
| vanB | U94526 | GTGGGCT GTGATATTCA AAGCTCCGC...CGGAaGAAcT taACgctGCg ATaGAA... | 1117 |
| vanB | U94527 | GTAGGCT GCGATATTCA AAGCTCCGC...CGGAaGAAcT aaACgctGCg ATaGAA... | — |
| vanB | U94528 | GTGGGCT GTGATATTCA AAGCTCCGC...CGGAaGAAcT taACgctGCg ATaGAA... | — |
| vanB | U94529 | GTGGGCT GTGATATTCA AAGCTCCGC...CGGAaGAAcT taACgctGCg ATaGAA... | — |
| vanB | U94530 | GTGGGCT GTGATATTCA AAGCTCCGC...CGGAaGAAcT taACgctGCg ATaGAA... | — |
| vanB | Z83305 | GTGGGCT GTGATATTCA AAGCTCCGC...CGGAaGAAcT taACgctGCg ATaGAA... | — |
| vanB | U81452 | GTGGGCT GTGATATTCA AAGCTCCGC...CGGAaGAAcT taACgctGCg ATaGAA... | — |
| vanB | U35369 | GTAGGCT GCGATATTCA AAGCTCCGC...CGGAaGAAcT aaACgctGCg ATaGAA... | — |
| vanB | U72704 | GTGGGCT GCGATATTCA AAGCTCCGC...CGGAaGAAcT taACgctGCg ATaGAA... | — |
| vanB | L06138 | GTAGGCT GCGATATTCA AAGCTCCGC...CGGAaGAAcT aaACgctGCg ATaGAA... | — |
| vanB | L15304 | GTGGGCT GTGATATTCA AAGCTCCGC...CGGAaGAAcT taACgctGCg ATaGAA... | — |
| vanB | U00456 | GTAGGCT GCGATATTCA AAGCTCCGC...CGGAaGAAcT aaACgctGCg ATaGAA... | — |
| vanD | AF130997 | GTGGGaT GCGATATTCA AAGCTCCGT...CAGAaGAAcT GcAggcaGCA ATcGAA... | — |
| vanE | AF136925 | GTAGGtT GTGgTATcgg AgctgCAGC...AAAgtGAtTT atAtaAaGCA ATaGAC... | — |
| Selected sequence for amplification primer | | GGCT GYGATATTCA AAGCTC | 1112 |
| Selected sequence for hybridization probe | | ACGAATT GGACTACGCA ATT (vanA) | 1170 |

The sequence numbering refers to the *Enterococcus faecium* vanA gene fragment (SEQ ID NO. 1139).
Nucleotides in capitals are identical to the selected sequences or match those sequences. Mismatches are indicated by lower-case letters. Dots indicate gaps in the sequences displayed.
"R" "Y" "M" "K" "W" and "S" designate nucleotide positions which are degenerated.
"R" stands for A or G; "Y" stands for C or T; "M" stands for A or C;
"K" stands for G or T; "W" stands for A or T; "S" stands for C or G.
"I" stands for inosine which is a nucleotide analog that can bind to any of the four nucleotides A, C, G or T.

| Accession # | 1038 1063 1103 1133 | SEQ ID NO.: |
|---|---|---|
| vanA X56895 | GAAACagt GccGcGTTag TTGTtGGC...ATT CATCAGGAAG TCGAGCCGGA AAAAGGCT | 1139 |
| vanA M97297 | GAAACagt GccGcgTTag TTGTtGGC...ATT CATCAGGAAG TCGAGCCGGA AAAAGGCT | 1141 |
| vanA | GAAACagt GccGcgTTag TTGTtGGC...ATT CATCAGGAAG TCGAGCCGGA AAAAGGCT | 1051 |
| vanA | GAAACagt GccGcgTTag cTGTtGGC...ATT CATCAGGAAG TCGAGCCGGA AAAAGGCT | 1052 |
| vanA | GAAACagt GccGcgTTag cTGTtGGC...ATT CATCAGGAAG TCGAGCCGGA AAAAGGCT | 1053 |
| vanA | GAAACagt GccGcgTTag TTGTtGGC...ATT CATCAGGAAG TCGAGCCGGA AAAAGGCT | 1054 |
| vanA | GAAACagt GccGcgTTag cTGTtGGC...ATT CATCAGGAAG TCGAGCCGGA AAAAGGCT | 1055 |
| vanA | GAAACagt GccGcgTTag cTGTtGGC...ATT CATCAGGAAG TCGAGCCGGA AAAAGGCT | 1056 |
| vanA | GAAACagt GccGcgTTag cTGTtGGC...ATT CATCAGGAAG TCGAGCCGGA AAAAGGCT | 1057 |
| vanA | GAAACagt GccGcgTTag cTGTtGGC...ATT CATCAGGAAG TCGAGCCGGA AAAAGGCT | 1049 |
| vanA | GAAACagt GccGcgTTag cTGTtGGC...ATT CATCAGGAAG TCGAGCCGGA AAAAGGCT | 1050 |
| vanB U94526 | GGAACGAG GATGATTTGA TTGTCGGC...ATC CATCAGGAAA ACGAGCCGGA AAAAGGCT | 1117 |
| vanB U94527 | GAAACGAG GATGATTTGA TTGTCGGC...ATC CATCAGGAAA ACGAGCCGGA AAAAGGCT | — |
| vanB U94528 | GGAACGAG GATGATTTGA TTGTCGGC...ATC CATCAGGAAA ACGAGCCGGA AAAAGGCT | — |
| vanB U94529 | GGAACGAG GATGATTTGA TTGTCGGC...ATC CATCAGGAAA ACGAGCCGGA AAAAGGCT | — |

-continued

| | | |
|---|---|---|
| vanB U94530 | GGA**ACGAG GATGATTTGA TTGTC**GGC...ATC **CATCAGGAAA ACGAGCCGGA AAAAG**GCT | — |
| vanB Z83305 | GGA**ACGAG GATGATTTGA TTGTC**GGC...ATC **CATCAGGAAA ACGAGCCGGA AAAAG**GCT | — |
| vanB U81452 | GGA**ACGAG GATGATTTGA TTGTC**GGC...ATC **CATCAGGAAA ACGAGCCGGA AAAAG**GCT | — |
| vanB U35369 | GAA**ACGAG GATGATTTGA TTGTC**GGC...ATC **CATCAGGAAA ACGAGCCGGA AAAAG**GCT | — |
| vanB U72704 | GGA**ACGAG GATGATTTGA TTGTC**GGC...ATC **CATCAGGAAA ACGAGCCGGA AAAAG**GAT | — |
| vanB L06138 | GAA**ACGAG GATGATTTGA TTGTC**GGC...ATC **CATCAGGAAA ACGAGCCGGA AAAAG**GCT | — |
| vanB L15304 | GGA**ACGAG GATGATTTGA TTGTC**GGC...ATC **CATCAGGAAA ACGAGCCGGA AAAAG**GCT | — |
| vanB U00456 | GAA**ACGAG GATGATTTGA TTGTC**GGC...ATC **CATCAGGAAA ACGAGCCGGA AAAAG**GCT | — |
| vanD AF130997 | GAA**ACGga aATGATcTcA TgGct**GGC...ATT **CATCAGGAAG cacAGCCGGA aAAGG**GAT | — |
| vanE AF136925 | GGA**A...t GAacAaTTGg TcGTt**GGA...TAT **gAagAGaAAt ACaA**...... ......TT | — |
| Selected sequence for hybridization probe | **ACGAG GATGATTTGA TTGTC** (vanB) | 1171 |
| Selected sequence for amplification primer[a] | **CATCAGGAAR WCGAGCCGGA AAAAG** | 1111 |

The sequence numbering refers to the *Enterococcus faecium* vanA gene fragment (SEQ ID NO. 1139).
Nucleotides in capitals are identical to the selected sequences or match those sequences.
Mismatches are indicated by lower-case letters. Dots indicate gaps in the sequences displayed.
"R" and "W" designate nucleotide positions which are degenerated.
"R" stands for A or G; "W" stands for A or T
[a]This sequence is the reverse-complement of the above selected primer.

Annex XXXIX: Internal hybridization probe for specific detection of mecA.

| SEQ ID NO. | Nucleotide sequence | Originating DNA fragment SEQ ID NO. | Originating DNA fragment Nucleotide position |
|---|---|---|---|
| | Resistance gene: mecA | | |
| 1177 | 5'-GCT CAA CAA GTT CCA GAT TA | 1178[a] | 1313-1332 |

[a]Sequence from databases.

Annex XL: Specific and ubiquitous primers for nucleic acid amplification (hexA sequences).

| SEQ ID NO. | Nucleotide sequence | Originating DNA fragment SEQ ID NO. | Originating DNA fragment Nucleotide position |
|---|---|---|---|
| | Bacterial species: *Streptococcus pneumoniae* | | |
| 1179 | 5'-ATT TGG TGA CGG GTG ACT TT | 1183[a] | 431-450 |
| 1181[b] | 5'-AGC AGC TTA CTA GAT GCC GT | 1183-1191[c] | 652-671[d] |

-continued

Annex XL: Specific and ubiquitous primers for nucleic acid amplification (hexA sequences).

| SEQ ID NO. | Nucleotide sequence | Originating DNA fragment SEQ ID NO. | Originating DNA fragment Nucleotide position |
|---|---|---|---|
| | Sequencing primers | | |
| 1179 | 5'-ATT TGG TGA CGG GTG ACT TT | 1183[a] | 431-450 |
| 1182[b] | 5'-AAC TGC AAG AGA TCC TTT GG | 1183[a] | 1045-1064 |

[a]Sequences from databases.

[b]These sequences are from the complementary DNA strand of the sequence of the originating fragment given in the Sequence Listing.

[c]These sequences were aligned to derive the corresponding primer.

[d]The nucleotide positions refer to the hexA sequence fragment (SEQ ID NO. 1183).

Annex XLI: Internal hybridization probe for specific detection of hexA sequences.

| SEQ ID NO. | Nucleotide sequence | Originating DNA fragment SEQ ID NO. | Nucleotide position |
|---|---|---|---|
| Bacterial species: *Streptococcus pneumoniae* | | | |
| 1180[a] | 5'-TCC ACC GTT GCC AAT CGC A | 1183-1191[b] | 629-647[c] |

[a]This sequences is from the complementary DNA strand of the sequence of the originating fragment given in the Sequence Listing.

[b]These sequences were aligned to derive the corresponding primer.

[c]The nucleotide positions refer to the hexA sequence fragment (SEQ ID NO. 1183).

Annex XLII: Strategy for the selection of *Streptococcus pneumoniae* species-specific amplification primers and hybridization probe from hexA sequences.

| | 428 453 626 674 1042 1067 | SEQ ID NO.: |
|---|---|---|
| *S. pneumoniae* | TGG ATTTGGTGAC GGGTGACTTT TAT...ATTTG CGATTGGCAA CGGTGGAGCA AACGGCATCT AGTAAGCTGC TCCA...AATCCAAAG GATCTCTTGC AGTTGGC | 1183 |
| *S. pneumoniae* | ~~~ ~~~~~~TGAC GGGTGACTTT TAT...ATTTG CGATTGGCAA CGGTGGAGCA AACGGCATCT AGTAAGCTGC TCCA...AATCCAAAG GATCTCTTG~ ~~~~~~~ | 1184 |
| *S. pneumoniae* | ~~~ ~~~~~~TGAC GGGTGACTTT TAT...ATTTG CGATTGGCAA CGGTGGAGCA AACGGCATCT AGTAAGCTGC TCCA...AATCCAAAG GATCTCT~~~ ~~~~~~~ | 1185 |
| *S. pneumoniae* | ~~~ ~~~~~~TGAC GGGTGACTTT TAT...ATTTG CGATTGGCAA CGGTGGAGCA AACGGCATCT AGTAAGCTGC TCCA...AATCCAAAG GATCTCTT~~ ~~~~~~~ | 1186 |
| *S. pneumoniae* | ~~~ ~~~~~~TGAC GGGTGACTTT TAT...ATTTG CGATTGGCAA CGGTGGAGCA AACGGCATCT AGTAAGCTGC TCCG...AATCCAAAG GATCTCTT~~ ~~~~~~~ | 1187 |
| *S. oralis* | ~~~ ~~~~~~~~~~GGGTGACTTT TAT...ATCca CGAcTGGCAg CtGTGGAGCA AgCGGCAgCT AGTAAGCTcC TCCA...~~~~~~~~~~ ~~~~~~~~~~ ~~~~~~~ | 1188 |
| *S. mitis* | ~~~ ~~~~GGTGAC GGGTGACTTT TAT...ATTca CGATTGGCAg CtGTGGAGCA AgCGGCATCT AGTAAaCTGC TTCA...AATCCAAAG GATCTCTT~~ ~~~~~~~ | 1189 |
| *S. mitis* | ~~~ *~~~~~~TGAC GGGTGACTTT CAG...GCGaG gagcTGtCtc CtaTGGAGCG TcaGGCAgCa gGgAAaCTGC T GGA*...~~~~~~~~~~ ~~~~~~~~~~ ~~~~~~~ | 1190 |
| *S. mitis* | ~~~ ~~~~~~TGAC GGGTGACTTT CAG...GCGaG gaAcTGtCtc CtaTGGAGCG TcaGGCAgCg gGgAAatTGC TAGA...AATCCAAAG GATCTCTT~~ ~~~~~~~ | 1191 |
| Selected sequence for amplification primer | ATTTGGTGAC GGGTGACTTT | 1179 |
| Selected sequences for amplification primers[a] | ACGGCATCT AGTAAGCTGC T<br>CCAAAG GATCTCTTGC AGTT | 1181<br>1182 |
| Selected sequence for hybridization probe[a] | TG CGATTGGCAA CGGTGGA | 1180 |

The sequence numbering refers to the *Streptococcus pneumoniae* hexA gene fragment (SEQ ID NO. 1183).
Nucleotides in capitals are identical to the selected sequences or match those sequences.
Mismatches are indicated by lower-case letters.
Dots indicate gaps in the sequences displayed.
"~" indicate incomplete sequence data.
[a]This sequence is the reverse-complement of the selected primer.

Annex XLIII: Specific and ubiquitous primers for nucleic acid amplification (pcp sequence).

| SEQ ID NO. | Nucleotide sequence | Originating DNA fragment SEQ ID NO. | Nucleotide position |
|---|---|---|---|
| Bacterial species: *Streptococcus pyogenes* | | | |
| 1211 | 5'-ATT CTT GTA ACA GGC TTT GAT CCC | 1215[a] | 291-314 |
| 1210[b] | 5'-ACC AGC TTG CCC AAT ACA AAG G | 1215[a] | 473-494 |

[a]Sequences from databases.

[b]These sequences are from the complementary DNA strand of the sequence of the originating fragment given in the Sequence Listing.

Annex XLIV: Specific and ubiquitous primers for nucleic acid amplification of *S. saprophyticus* sequences of unknown coding potential.

| SEQ ID NO. | Nucleotide sequence | Originating DNA fragment SEQ ID NO. | Nucleotide position |
|---|---|---|---|
| Bacterial species: Staphylococcus saprophyticus | | | |
| 1208 | 5'-TCA AAA AGT TTT CTA AAA AAT TTA C | 74, 1093, 1198[b] | 169-193[c] |
| 1209[a] | 5'-ACG GGC GTC CAC AAA ATC AAT AGG A | 74, 1093, 1198[b] | 355-379[c] |

[a]This sequence is from the complementary DNA strand of the sequence of the originating fragment given in the Sequence Listing.

[b]These sequences were aligned to derive the corresponding primer.

[c]The nucleotide positions refer to the *S. saprophyticus* unknown gene sequence fragment (SEQ ID NO. 1198).

Annex XLV: Molecular beacon internal hybridization probes for specific detection of antimicrobial agents resistance gene sequences.

| SEQ ID NO. | Nucleotide sequence[a] | Originating DNA fragment SEQ ID NO. | Nucleotide position |
|---|---|---|---|
| Resistance gene: gyrA | | | |
| 2250 | 5'-CCG TCG GAT GGT GTC GTA TAC CGC GGA GTC GCC GAC GG | 1954[b] | 218-243 |
| 2251 | 5'-CGG AGC CGT TCT CGC TGC GTT ACA TGC TGG TGG CTC CG | 1954[b] | 259-286 |
| Resistance gene: mecA | | | |
| 1231 | 5'-GCG AGC CCG AAG ATA AAA AAG AAC CTC TGC TGC TCG C | 1178[b] | 1291-1315 |
| Resistance gene: parC | | | |
| 1938[b] | 5'-CCG CGC ACC ATT GCT TCG TAC ACT GAG GAG TCT CCG CGC GG | 1321[c] | 232-260 |
| 1939 | 5'-CGA CCC GGA TGG TAG TAT CGA TAA TGA TCC GCC AGC GGC CGG GTC G | 1321[c] | 317-346 |
| 1955[b] | 5'-CGC GCA ACC ATT GCT TCG TAC ACT GAG GAG TCT GCG CG | 1321[c] | 235-260 |
| Resistance gene: vanA | | | |
| 1239 | 5'-GCG AGC GCA GAC CTT TCA GCA GAG GAG GCT CGC | 1051 | 860-880 |
| 1240 | 5'-GCG AGC CGG CAA GAC AAT ATG ACA GCA AAA TCG CTC GC | 1051 | 663-688 |
| Resistance gene: vanB | | | |
| 1241 | 5'-GCG AGC GGG GAA CGA GGA TGA TTT GAT TGG CTC GC | 1117 | 555-577 |

-continued

Annex XLV: Molecular beacon internal hybridization probes for specific detection of antimicrobial agents resistance gene sequences.

| SEQ ID NO. | Nucleotide sequence[a] | Originating DNA fragment SEQ ID NO. | Nucleotide position |
|---|---|---|---|
| | Resistance gene: vanD | | |
| 1593 | 5'-CCG AGC GAT TTA CCG GAT ACT TGG CTG ICG CTC GG | 1594 | 835-845 |

[a]Underlined nucleotides indicate the molecular beacon's stem.
[b]This sequence is from the complementary DNA strand of the sequence of the originating fragment given in the Sequence Listing.
[c]Sequence from databases.

Annex XLVI: Molecular beacon internal hybridization probe for specific detection of *S. aureus* gene sequences of unknown coding potential.

| SEQ ID NO. | Nucleotide sequence[a] | Originating DNA fragment SEQ ID NO. | Nucleotide position |
|---|---|---|---|
| | Bacterial species: *S. aureus* | | |
| 1232 | 5'-GGA GCC GCG CGA TTT TAT AAA TGA ATG TTG ATA ACC GGC TCC | 1244 | 53-80 |

[a]Underlined nucleotides indicate the molecular beacon's stem.

Annex XLVII: Molecular beacon internal hybridization probes for specific detection of tuf sequences.

| SEQ ID NO. | Nucleotide sequence[a] | Originating DNA fragment SEQ ID NO. | Nucleotide position |
|---|---|---|---|
| | Bacterial species: *Chlamydia pneumoniae* | | |
| 2091 | 5'-CGC GAC TTG AGA TGG AAC TTA GTG AGC TTC TTG GTC GCG | 20 | 157-183 |
| 2092 | 5'-CGC GAC GAA AGA ACT TCC TGA AGG TCG TGC AGG TCC AG | 20 | 491-516 |
| | Bacterial species: *Chlamydia trachomatis* | | |
| 2213 | 5'-CGT GCC ATT GAC ATG ATT TCC GAA GAA GAC GCT GAA GGC ACG | 1739[b] | 412-441 |
| | Bacterial species: *Enterococcus faecalis* | | |
| 1236 | 5'-GCG AGC CGT GGT GAA GTT CGC GTT GGT GGC TCG C | 883 | 370-391 |
| | Bacterial species: *Enterococcus faecium* | | |
| 1235 | 5'-GCG AGC CGA AGT TGA AGT TGT TGG TAT TGC TGG CTC GC | 64 | 412-437 |

| | | | |
|---|---|---|---|
| Bacterial species: *Legionella pneumophila* | | | |
| 2084[c] | 5'-<u>CAC</u> <u>GCG</u> TCA ACA CCC GTA CAA GTC GTC TTT TGC <u>GCG</u> <u>TG</u> | 112 | 461-486 |
| Bacterial species: *Mycoplasma pneumoniae* | | | |
| 2096[c] | 5'-<u>CGC</u> <u>GAC</u> CGG TAC CAC GGC CAG TAA TCG T<u>GT</u> <u>CGC</u> <u>G</u> | 2097[b] | 658-679 |
| Bacterial species: *Neisseria gonorrhoeae* | | | |
| 2177 | 5'-<u>GGC</u> <u>ACG</u> GAC AAA CCA TTC CTG CTG CCT ATC GAA ACG TGT TC<u>C</u> <u>CGT</u> <u>GCC</u> | 126 | 323-357 |
| 2178 | 5'-<u>GGC</u> <u>ACG</u> ACA AAC CAT TCC TGC TGC CTA TCG AA<u>C</u> <u>GTG</u> <u>CC</u> | 126 | 323-348 |
| 2179 | 5'-<u>GGC</u> <u>AGC</u> TCT ACT TCC GTA CCA CTG ACG TAA CCG <u>GCT</u> <u>GCC</u> | 126 | 692-718 |

[a]Underlined nucleotides indicate the molecular beacon's stem.
[b]Sequence from databases.
[c]This sequence is from the complementary DNA strand of the sequence of the originating
fragment given in the Sequence Listing.

| | | | |
|---|---|---|---|
| Bacterial species: *Pseudomonas aeruginosa* | | | |
| 2122 | 5'-<u>CCG</u> <u>AGC</u> GAA TGT AGG AGT CCA GGG TCT CT<u>G</u> <u>CTC</u> <u>GG</u> | 153, 880, 2138[b,c] | 280-302[d] |
| Bacterial species: *Staphylococcus aureus* | | | |
| 2186 | 5'-<u>ACG</u> <u>CGC</u> TCA AAG CAG AAG TAT ACG TAT TAT CAA AAG AC<u>G</u> <u>CGC</u> <u>GT</u> | 1728 | 615-646 |
| Bacterial group: *Staphylococcus* sp. other than *S. aureus* | | | |
| 1233 | 5'-<u>GCG</u> <u>AGC</u> GTT ACT GGT GTA GAA ATG TTC CG<u>G</u> <u>CTC</u> <u>GC</u> | 878 | 372-394 |
| Fungal species: *Candida albicans* | | | |
| 2073 | 5'-<u>CCGAGC</u> AAC ATG ATT GAA CCA TCC ACC AAC TG<u>G</u> <u>CTC</u> <u>GG</u> | 408 | 404-429 |
| Fungal species: *Candida dubliniensis* | | | |
| 2074 | 5'-<u>CCG</u> <u>AGC</u> AAC ATG ATT GAA GCT TCC ACC AAC TG<u>G</u> <u>CTC</u> <u>GG</u> | 414 | 416-441 |
| Fungal species: *Candida glabrata* | | | |
| 2110[b] | 5'-<u>GCG</u> <u>GGC</u> CCT TAA CGA TTT CAG CGA ATC TGG ATT <u>CAG</u> <u>CCC</u> <u>GC</u> | 417 | 307-335 |
| 2111 | 5'-GCG GGC ATG TTG AAG CCA CCA CCA ACG CTT CCT GGC CCG C | 417 | 419-447 |
| Fungal species: *Candida krusei* | | | |
| 2112[b] | 5'-<u>GCG</u> <u>GGC</u> TTG ATG AAG TTT GGG TTT CCT TGA CAA TT<u>G</u> <u>CCC</u> <u>GC</u> | 422 | 318-347 |
| 2113 | 5'-<u>GCG</u> <u>GGC</u> ACA AGG GTT GGA CTA AGG AAA CCA AGG CA<u>G</u> <u>CCC</u> <u>GC</u> | 422 | 419-447 |
| 2114 | 5'-<u>GCG</u> <u>GGC</u> ATC GAT GCT ATT GAA CCA CCT GTC AGA CC<u>G</u> <u>CCC</u> <u>GC</u> | 422 | 505-533 |

[a]Underlined nucleotides indicate the molecular beacon's stem.
[b]Sequence from databases.
[c]These sequences were aligned to derive the corresponding primer.
[d]The nucleotide positions refer to the *P. aeruginosa* tuf sequence fragment
(SEQ ID NO. 153).

-continued

| | | | |
|---|---|---|---|
| Fungal species: *Candida lusitaniae* | | | |
| 2115[b] | 5'-GCG GGC GGT AAG TCC ACC GGT AAG ACC TTG TTG GCC CGC | 424 | 304-330 |
| 2116 | 5'-GCG GGC GTA AGT CAC CGG TAA GAC CTT GTT GGC CCG C | 424 | 476-502 |
| 2117 | 5'-GCG GGC GAC GCC ATT GAG CCA CCT TCG AGA GCC CGC | 424 | 512-535 |
| Fungal species: *Candida parapsilosis* | | | |
| 2118[b] | 5'-GCG GGC TCC TTG ACA ATT TCT TCG TAT CTG TTC TTG GCC CGC | 426 | 301-330 |
| Fungal species: *Candida tropicalis* | | | |
| 2119 | 5'-GCG GGC TTA CAA CCC TAA GGC TGT TCC ATT CGT TGC CCG C | 429 | 357-384 |
| 2120 | 5'-GCG GGC AGA AAC CAA GGC TGG TAA GGT TAC CGG AGC CCG C | 429 | 459-487 |
| Fungal species: *Cryptococcus neoformans* | | | |
| 2106 | 5'-GCG AGC AGA GCA CGC CCT CCT CGC CGC TCG C | 623, 1985, 1986[c] | 226-244[d] |
| 2107 | 5'-GCG AGC TCC CCA TCT CTG GTT GGC ACG CTC GC | 623, 1985, 1986[c] | 390-408[d] |
| Bacterial genus: *Legionella* sp. | | | |
| 2083 | 5'-CCG CCG ATG TTC CGT AAA TTA CTT GAI GAA GGT CGA GCC GGC GG | 111-112[d] | 488-519[e] |

[a]Underlined nucleotides indicate the molecular beacon's stem.
[b]This sequence is from the complementary DNA strand of the sequence of the originating fragment given in the Sequence Listing.
[c]These sequences were aligned to derive the corresponding primer.
[d]The nucleotide positions refer to the *C. neoformans* tuf (EF-1) sequence fragment (SEQ ID NO. 623).
[e]The nucleotide positions refer to the *L. pneumophila* tuf (EF-1) sequence fragment (SEQ ID NO. 112).

| | | | |
|---|---|---|---|
| Fungal genus: *Candida* sp. | | | |
| 2108 | 5'-GCG GGC AAC TTC RTC AAG AAG GTT GGT TAC AAC CCG CCC GC | 414, 417, 422, 424, 426, 429, 624[b] | 52-80[c] |
| 2109 | 5'-GCG GGC CCA ATC TCT GGT TGG AAY GGT GAC AAG CCC GC | Same as SEQ ID NO. 2108 | 100-125[c] |
| Bacterial group: Pseudomonads | | | |
| 2121 | 5'-CGA CCG CIA GCC GCA CAC CAA GTT CCG GTC G | 153-155, 205, 880, 2137[d], 2138[d,b] | 598-616[e] |

[a]Underlined nucleotides indicate the molecular beacon's stem.
[b]These sequences were aligned to derive the corresponding primer.
[c]The nucleotide positions refer to the *C. albicans* tuf (EF-1) sequence fragment (SEQ ID NO. 624).
[d]Sequence from databases.
[e]The nucleotide positions refer to the *P. aeruginosa* tuf sequence fragment (SEQ ID NO. 153).

Annex XLVIII: Molecular beacon internal hybridization probes for specific detection of ddl and mtl gene sequences.

| SEQ ID NO. | Nucleotide sequence[a] | Originating DNA fragment SEQ ID NO. | Originating DNA fragment Nucleotide position |
|---|---|---|---|
| | Bacterial species: *E. faecium* (ddl) | | |
| 1237 | 5'-GCG AGC CGC GAA ATC GAA GTT GCT GTA TTA GGG CTC GC | 1242[b] | 334-359 |
| | Bacterial species: *E. faecalis* (mtl) | | |
| 1238 | 5'-GCG AGC GGC GTT AAT TTT GGC ACC GAA GAA GAG CTC GC | 1243[b] | 631-656 |

[a]Underlined nucleotides indicate the molecular beacon's stem.
[b]Sequence from databases.

Annex XLIX: Internal hybridization probe for specific detection of *S. aureus* sequences of unknown coding potential.

| SEQ ID NO. | Nucleotide sequence | Originating DNA fragment SEQ ID NO. | Originating DNA fragment Nucleotide position |
|---|---|---|---|
| | Bacterial species: *Staphylococcus aureus* | | |
| 1234 | 5'-ACT AAA TAA ACG CTC ATT CG | 1244 | 35-54 |

Annex L: Specific and ubiquitous primers for nucleic acid amplification (antimicrobial agents resistance genes sequences).

| SEQ ID NO. | Nucleotide sequence | Originating DNA fragment SEQ ID NO. | Originating DNA fragment Nucleotide position |
|---|---|---|---|
| | Resistance gene: aac(2')-Ia | | |
| 1344 | 5'-AGC AGC AAC GAT GTT ACG CAG CAG | 1348[a] | 163-186 |
| 1345[b] | 5'-CCC GCC GAG CAT TTC AAC TAT TG | 1348[a] | 392-414 |
| 1346 | 5'-GAT GTT ACG CAG CAG GGC AGT C | 1348[a] | 172-193 |
| 1347[b] | 5'-ACC AAG CAG GTT CGC AGT CAA GTA | 1348[a] | 467-490 |
| | Resistance gene: aac(3')-Ib | | |
| 1349 | 5'-CAG CCG ACC AAT GAG TAT CTT GCC | 1351[a] | 178-201 |
| 1350[b] | 5'-TAA TCA GGG CAG TTG CGA CTC CTA | 1351[a] | 356-379 |
| | Resistance gene: aac(3')-IIb | | |
| 1352 | 5'-CCA CGC TGA CAG AGC CGC ACC G | 1356[a] | 383-404 |
| 1353[b] | 5'-GGC CAG CTC CCA TCG GAC CCT G | 1356[a] | 585-606 |

-continued

Annex L: Specific and ubiquitous primers for nucleic acid amplification (antimicrobial agents resistance genes sequences).

| SEQ ID NO. | Nucleotide sequence | Originating DNA fragment SEQ ID NO. | Originating DNA fragment Nucleotide position |
|---|---|---|---|
| 1354 | 5'-CAC GCT GAC AGA GCC GCA CCG | 1356[a] | 384-404 |
| 1355[b] | 5'-ATG CCG TTG CTG TCG AAA TCC TCG | 1356[a] | 606-629 |
| | Resistance gene: aac(3')-IVa | | |
| 1357 | 5'-GCC CAT CCA TTT GCC TTT GC | 1361[a] | 295-314 |
| 1358[b] | 5'-GCG TAC CAA CTT GCC ATC CTG AAG | 1361[a] | 517-540 |
| 1359 | 5'-TGC CCC TGC CAC CTC ACT C | 1361[a] | 356-374 |
| 1360[b] | 5'-CGT ACC AAC TTG CCA TCC TGA AGA | 1361[a] | 516-539 |
| | Resistance gene: aac(3')-VIa | | |
| 1362 | 5'-CGC CGC CAT CGC CCA AAG CTG G | 1366[a] | 285-306 |
| 1363[b] | 5'-CGG CAT AAT GGA GCG CGG TGA CTG | 1366[a] | 551-574 |
| 1364 | 5'-TTT CTC GCC CAC GCA GGA AAA ATC | 1366[a] | 502-525 |
| 1365[b] | 5'-CAT CCT CGA CGA ATA TGC CGC G | 1366[a] | 681-702 |
| | Resistance gene: aac(6')-Ia | | |
| 1367 | 5'-CAA ATA TAC TAA CAG AAG CGT TCA | 1371[a] | 56-79 |
| 1368[b] | 5'-AGG ATC TTG CCA ATA CCT TTA T | 1371[a] | 269-290 |
| 1379 | 5'-AAA CCT TTG TTT CGG TCT GCT AAT | 1371[a] | 153-176 |
| 1380[b] | 5'-AAG CGA TTC CAA TAA TAC CTT GCT | 1371[a] | 320-343 |
| | Resistance gene: aac(6')-Ic | | |
| 1372 | 5'-GCT TTC GTT GCC TTT GCC GAG GTC | 1376[a] | 157-180 |
| 1373[b] | 5'-CAC CCC TGT TGC TTC GCC CAC TC | 1376[a] | 304-326 |
| 1374 | 5'-AGA TAT TGG CTT CGC CGC ACC ACA | 1376[a] | 104-127 |
| 1375[b] | 5'-CCC TGT TGC TTC GCC CAC TCC TG | 1376[a] | 301-323 |
| | Resistance gene: ant(3')-Ia | | |
| 1377 | 5'-GCC GTG GGT CGA TGT TTG ATG TTA | 1381[a] | 100-123 |
| 1378[b] | 5'-GCT CGA TGA CGC CAA CTA CCT CTG | 1381[a] | 221-244 |
| 1379 | 5'-AGC AGC AAC GAT GTT ACG CAG CAG | 1381[a] | 127-150 |
| 1380[b] | 5'-CGC TCG ATG ACG CCA ACT ACC TCT | 1381[a] | 222-245 |
| | Resistance gene: ant(4')-Ia | | |
| 1382 | 5'-TAG ATA TGA TAG GCG GTA AAA AGC | 1386[a] | 149-172 |
| 1383[b] | 5'-CCC AAA TTC GAG TAA GAG GTA TT | 1386[a] | 386-408 |
| 1384 | 5'-GAT ATG ATA GGC GGT AAA AAG C | 1386[a] | 151-172 |
| 1385[b] | 5'-TCC CAA ATT CGA GTA AGA GGT A | 1386[a] | 388-409 |
| | Resistance gene: aph(3')-Ia | | |
| 1387 | 5'-TTA TGC CTC TTC CGA CCA TCA AGC | 1391[a] | 233-256 |
| 1338[b] | 5'-TAC GCT CGT CAT CAA AAT CAC TCG | 1391[a] | 488-511 |

-continued

Annex L: Specific and ubiquitous primers for nucleic acid amplification (antimicrobial agents resistance genes sequences).

| SEQ ID NO. | Nucleotide sequence | Originating DNA fragment SEQ ID NO. | Nucleotide position |
|---|---|---|---|
| 1389 | 5'-GAA TAA CGG TTT GGT TGA TGC GAG | 1391[a] | 468-491 |
| 1390[b] | 5'-ATG GCA AGA TCC TGG TAT CGG TCT | 1391[a] | 669-692 |
| | Resistance gene: aph(3')-IIa | | |
| 1392 | 5'-TGG GTG GAG AGG CTA TTC GGC TAT | 1396[a] | 43-66 |
| 1393[b] | 5'-CAG TCC CTT CCC GCT TCA GTG AC | 1396[a] | 250-272 |
| 1394 | 5'-GAC GTT GTC ACT GAA GCG GGA AGG | 1396[a] | 244-267 |
| 1395[b] | 5'-CTT GGT GGT CGA ATG GGC AGG TAG | 1396[a] | 386-409 |
| | Resistance gene: aph(3')-IIIa | | |
| 1397 | 5'-GTG GGA GAA AAT GAA AAC CTA T | 1401[a] | 103-124 |
| 1398[b] | 5'-ATG GAG TGA AAG AGC CTG AT | 1401[a] | 355-374 |
| 1399 | 5'-ACC TAT GAT GTG GAA CGG GAA AAG | 1401[a] | 160-183 |
| 1400[b] | 5'-CGA TGG AGT GAA AGA GCC TGA TG | 1401[a] | 354-376 |
| | Resistance gene: aph(3')-VIa | | |
| 1402 | 5'-TAT TCA ACA ATT TAT CGG AAA CAG | 1406[a] | 18-41 |
| 1403[b] | 5'-TCA GAG AGC CAA CTC AAC ATT TT | 1406[a] | 175-197 |
| 1404 | 5'-AAA CAG CGT TTT AGA GCC AAA TAA | 1406[a] | 36-59 |
| 1405[b] | 5'-TTC TCA GAG AGC CAA CTC AAC ATT | 1406[a] | 177-200 |
| | Resistance gene: blaCARB | | |
| 1407 | 5'-CCC TGT AAT AGA AAA GCA AGT AGG | 1411[a] | 351-374 |
| 1408[b] | 5'-TTG TCG TAT CCC TCA AAT CAC C | 1411[a] | 556-577 |
| 1409 | 5'-TGG GAT TAC AAT GGC AAT CAG CG | 1411[a] | 205-227 |
| 1410[b] | 5'-GGG GAA TAG GTC ACA AGA TCT GCT T | 1411[a] | 329-353 |
| | Resistance gene: blaCMY-2 | | |
| 1412 | 5'-GAG AAA ACG CTC CAG CAG GGC | 1416[a] | 793-813 |
| 1413[b] | 5'-CAT GAG GCT TTC ACT GCG GGG | 1416[a] | 975-995 |
| 1414 | 5'-TAT CGT TAA TCG CAC CAT CAC | 1416[a] | 90-110 |
| 1415[b] | 5'-ATG CAG TAA TGC GGC TTT ATC | 1416[a] | 439-459 |
| | Resistance genes: blaCTX-M-1, blaCTX-M-2 | | |
| 1417 | 5'-TGG TTA ACT AYA ATC CSA TTG CGG A | 1423[a] | 314-338 |
| 1418[b] | 5'-ATG CTT TAC CCA GCG TCA GAT T | 1423[a] | 583-604 |
| | Resistance gene: blaCTX-M-1 | | |
| 1419 | 5'-CGA TGA ATA AGC TGA TTT CTC ACG | 1423[a] | 410-433 |
| 1420[b] | 5'-TGC TTT ACC CAG CGT CAG ATT ACG | 1423[a] | 580-603 |
| 1421 | 5'-AAT TAG AGC GGC AGT CGG GAG GAA | 1423[a] | 116-139 |
| 1422[b] | 5'-GAA ATC AGC TTA TTC ATC GCC ACG | 1423[a] | 405-428 |

-continued

Annex L: Specific and ubiquitous primers for nucleic acid amplification (antimicrobial agents resistance genes sequences).

| SEQ ID NO. | Nucleotide sequence | Originating DNA fragment SEQ ID NO. | Originating DNA fragment Nucleotide position |
|---|---|---|---|
| | Resistance gene: blaCTX-M-2 | | |
| 1424 | 5'-GTT AAC GGT GAT GGC GAC GCT AC | 1428[a] | 30-52 |
| 1425[b] | 5'-GAA TTA TCG GCG GTG TTA ATC AGC | 1428[a] | 153-176 |
| 1426 | 5'-CAC GCT CAA TAC CGC CAT TCC A | 1428[a] | 510-531 |
| 1427[b] | 5'-TTA TCG CCC ACT ACC CAT GAT TTC | 1428[a] | 687-710 |
| | Resistance gene: blaIMP | | |
| 1429 | 5'-TTT ACG GCT AAA GAT ACT GAA AAG T | 1433[a] | 205-229 |
| 1430[b] | 5'-GTT TAA TAA AAC AAC CAC CGA ATA AT | 1433[a] | 513-538 |
| 1431 | 5'-TAA TTG ACA CTC CAT TTA CGG CTA A | 1433[a] | 191-215 |
| 1432[b] | 5'-ACC GAA TAA TAT TTT CCT TTC AGG CA | 1433[a] | 497-522 |
| | Resistance gene: blaOXA2 | | |
| 1434 | 5'-CAC AAT CAA GAC CAA GAT TTG CGA T | 1438[a] | 319-343 |
| 1435[b] | 5'-GAA AGG GCA GCT CGT TAC GAT AGA G | 1438[a] | 532-556 |
| | Resistance gene: blaOXA10 | | |
| 1436 | 5'-CAG CAT CAA CAT TTA AGA TCC CCA | 1439[a] | 194-217 |
| 1437[b] | 5'-CTC CAC TTG ATT AAC TGC GGA AAT TC | 1439[a] | 479-504 |
| | Resistance gene: blaPER-1 | | |
| 1440 | 5'-AGA CCG TTA TCG TAA ACA GGG CTA AG | 1442[a] | 281-306 |
| 1441[b] | 5'-TTT TTT GCT CAA ACT TTT TCA GGA TC | 1442[a] | 579-604 |
| | Resistance gene: blaPER-2 | | |
| 1443 | 5'-CTT CTG CTC TGC TGA TGC TTG GC | 1445[a] | 32-54 |
| 1444[b] | 5'-GGC GAC CAG GTA TTT TGT AAT ACT GC | 1445[a] | 304-329 |
| | Resistance genes: blaPER-1, blaPER-2 | | |
| 1446 | 5'-GGC CTG YGA TTT GTT ATT TGA ACT GGT | 1442[a] | 414-440 |
| 1447[b] | 5'-CGC TST GGT CCT GTG GTG GTT TC | 1442[a] | 652-674 |
| 1448 | 5'-GAT CAG GTG CAR TAT CAA AAC TGG AC | 1442[a] | 532-557 |
| 1449[b] | 5'-AGC WGG TAA CAA YCC TTT TAA CCG CT | 1442[a] | 671-696 |
| | Resistance gene: blaSHV | | |
| 1883 | 5'-AGC CGC TTG AGC AAA TTA AAC TA | 1900[a] | 71-93 |
| 1884[b] | 5'-GTA TCC CGC AGA TAA ATC ACC AC | 1900[a] | 763-785 |
| 1885 | 5'-AGC GAA AAA CAC CTT GCC GAC | 1900[a] | 313-333 |
| 1884[b] | 5'-GTA TCC CGC AGA TAA ATC ACC AC | 1900[a] | 763-785 |
| | Resistance gene: blaTEM | | |
| 1906 | 5'-CCT TAT TCC CTT TTT TGC GG | 1927[a] | 27-46 |
| 1907[b] | 5'-CAC CTA TCT CAG CGA TCT GTC T | 1927[a] | 817-838 |

-continued

Annex L: Specific and ubiquitous primers for nucleic acid amplification (antimicrobial agents resistance genes sequences).

| SEQ ID NO. | Nucleotide sequence | Originating DNA fragment SEQ ID NO. | Originating DNA fragment Nucleotide position |
|---|---|---|---|
| 1908 | 5'-AAC AGC GGT AAG ATC CTT GAG AG | 1927[a] | 148-170 |
| 1907[b] | 5'-CAC CTA TCT CAG CGA TCT GTC T | 1927[a] | 817-838 |
| | Resistance gene: catI | | |
| 2145 | 5'-GCA AGA TGT GGC GTG TTA CGG T | 2147[a] | 363-384 |
| 2146[b] | 5'-GGG GCG AAG AAG TTG TCC ATA TT | 2147[a] | 484-506 |
| | Resistance gene: catII | | |
| 2148 | 5'-CAG ATT AAA TGC GGA TTC AGC C | 2150[a] | 67-88 |
| 2149[b] | 5'-ATC AGG TAA ATC ATC AGC GGA TA | 2150[a] | 151-173 |
| | Resistance gene: catIII | | |
| 2151 | 5'-ATA TTT CAG CAT TAC CTT GGG TT | 2153[a] | 419-441 |
| 2152[b] | 5'-TAC ACA ACT CTT GTA GCC GAT TA | 2153[a] | 603-625 |
| | Resistance gene: catP | | |
| 2154 | 5'-CGC CAT TCA GAG TTT AGG AC | 2156[a] | 178-197 |
| 2155[b] | 5'-TTC CAT ACC GTT GCG TAT CAC TT | 2156[a] | 339-361 |
| | Resistance gene: cat | | |
| 2157 | 5'-CCA CAG AAA TTG ATA TTA GTG TTT TAT | 2159[a] | 89-115 |
| 2158[b] | 5'-TCG CTA TTG TAA CCA GTT CTA | 2159[a] | 201-221 |
| 2160 | 5'-TTT TGA ACA CTA TTT TAA CCA GC | 2162[a] | 48-70 |
| 2161[b] | 5'-GAT TTA ACT TAT CCC AAT AAC CT | 2162[a] | 231-253 |
| | Resistance gene: dfrA | | |
| 1450 | 5'-ACC ACT GGG AAT ACA CTT GTA ATG GC | 1452[a] | 106-131 |
| 1451[b] | 5'-ATC TAC CTG GTC AAT CAT TGC TTC GT | 1452[a] | 296-321 |
| | Resistance gene: dhfrIa | | |
| 1457 | 5'-CAA AGG TGA ACA GCT CCT GTT T | 1461[a] | 75-96 |
| 1458[b] | 5'-TCC GTT ATT TTC TTT AGG TTG GTT AAA | 1461[a] | 249-275 |
| 1459 | 5'-AAG GTG AAC AGC TCC TGT TT | 1461[a] | 77-96 |
| 1560[b] | 5'-GAT CAC TAC GTT CTC ATT GTC A | 1461[a] | 207-228 |
| | Resistance genes: dhfrIa, dhfrXV | | |
| 1453 | 5'-ATC GAA GAA TGG AGT TAT CGG RAA TG | 1461[a] | 27-52 |
| 1454[b] | 5'-CCT AAA AYT RCT GGG GAT TTC WGG A | 1461[a] | 384-408 |
| 1455 | 5'-CAG GTG GTG GGG AGA TAT ACA AAA | 1461[a] | 290-313 |
| 1456[b] | 5'-TAT GTT AGA SRC GAA GTC TTG GKT AA | 1461[a] | 416-441 |
| | Resistance gene: dhfrIb | | |
| 1466 | 5'-AAG CAT TGA CCT ACA ATC AGT GT | 1470[a] | 98-120 |
| 1467[b] | 5'-AAT ACA ACT ACA TTG TCA TCA TTT GAT | 1470[a] | 204-230 |

-continued

Annex L: Specific and ubiquitous primers for nucleic acid amplification (antimicrobial agents resistance genes sequences).

| SEQ ID NO. | Nucleotide sequence | Originating DNA fragment SEQ ID NO. | Originating DNA fragment Nucleotide position |
|---|---|---|---|
| 1468 | 5'-CGT TAC CCG CTC AGG TTG GAC ATC AA | 1470[a] | 183-208 |
| 1469[b] | 5'-CAT CCC CCT CTG GCT CGA TGT CG | 1470[a] | 354-376 |
| | Resistance gene: dhfrV | | |
| 1471 | 5'-GAT AAT GAC AAC GTA ATA GTA TTC CC | 1475[a] | 208-233 |
| 1472[b] | 5'-GCT CAA TAT CAA TCG TCG ATA TA | 1475[a] | 342-364 |
| 1473 | 5'-TTA AAG CCT TGA CGT ACA ACC AGT GG | 1475[a] | 95-120 |
| 1474[b] | 5'-TGG GCA ATG TTT CTC TGT AAA TCT CC | 1475[a] | 300-325 |
| | Resistance genes: dhfrIb, dhfrV | | |
| 1462 | 5'-GCA CTC CCY AAT AGG AAA TAC GC | 1470[a] | 157-179 |
| 1463[b] | 5'-AGT GTT GCT CAA AAA CAA CTT CG | 1470[a] | 405-427 |
| 1464 | 5'-ACG TTY GAA TCT ATG GGM GCA CT | 1470[a] | 139-161 |
| 1465[b] | 5'-GTC GAT AAG TGG AGC GTA GAG GC | 1470[a] | 328-350 |
| | Resistance gene: dhfrVI | | |
| 1476 | 5'-GGC GAG CAG CTC CTA TTC AAA G | 1480[a] | 79-100 |
| 1477[b] | 5'-TAG GTA AGC TAA TGC CGA TTC AAC A | 1480[a] | 237-261 |
| 1478 | 5'-GAG AAT GGA GTA ATT GGC TCT GGA TT | 1480[a] | 31-56 |
| 1479[b] | 5'-GCG AAA TAC ACA ACA TCA GGG TCA T | 1480[a] | 209-233 |
| | Resistance gene: dhfrVII | | |
| 1485 | 5'-AAA ATG GCG TAA TCG GTA ATG GC | 1489[a] | 32-54 |
| 1486[b] | 5'-CAT TTG AGC TTG AAA TTC CTT TCC TC | 1489[a] | 189-214 |
| 1487 | 5'-AAT CGA AAA TAT GCA GTA GTG TCG AG | 1489[a] | 166-191 |
| 1488[b] | 5'-AGA CTA TTG TAG ATT TGA CCG CCA | 1489[a] | 294-317 |
| | Resistance genes: dhfrVII, dhfrXVII | | |
| 1481 | 5'-RTT ACA GAT CAT KTA TAT GTC TCT | 1489[a] | 268-291 |
| 1482[b] | 5'-TAA TTT ATA TTA GAC AWA AAA AAC TG | 1489[a] | 421-446 |
| 1483 | 5'-CAR YGT CAG AAA ATG GCG TAA TC | 1489[a] | 23-45 |
| 1484[b] | 5'-TKC AAA GCR WTT TCT ATT GAA GGA AA | 1489[a] | 229-254 |
| | Resistance gene: dhfrVIII | | |
| 1490 | 5'-GAC CTA TGA GAG CTT GCC CGT CAA A | 1494[a] | 144-168 |
| 1491[b] | 5'-TCG CCT TCG TAC AGT CGC TTA ACA AA | 1494[a] | 376-401 |
| 1492 | 5'-CAT TTT AGC TGC CAC CGC CAA TGG TT | 1494[a] | 18-43 |
| 1493[b] | 5'-GCG TCG CTG ACG TTG TTC ACG AAG A | 1494[a] | 245-269 |
| | Resistance gene: dhfrIX | | |
| 1495 | 5'-TCT CTA AAC ATG ATT GTC GCT GTC | 1499[a] | 7-30 |
| 1496[b] | 5'-CAG TGA GGC AAA AGT TTT TCT ACC | 1499[a] | 133-156 |

-continued

Annex L: Specific and ubiquitous primers for nucleic acid amplification (antimicrobial agents resistance genes sequences).

| SEQ ID NO. | Nucleotide sequence | Originating DNA fragment SEQ ID NO. | Originating DNA fragment Nucleotide position |
|---|---|---|---|
| 1497 | 5'-CGG ACG ACT TCA TGT GGT AGT CAG T | 1499[a] | 171-195 |
| 1498[b] | 5'-TTT GTT TTC AGT AAT GGT CGG GAC CT | 1499[a] | 446-471 |
| | Resistance gene: dhfrXII | | |
| 1500 | 5'-ATC GGG TTA TTG GCA ATG GTC CTA | 1504[a] | 50-73 |
| 1501[b] | 5'-GCG GTA GTT AGC TTG GCG TGA GAT T | 1504[a] | 201-225 |
| 1502 | 5'-GCG GGC GGA GCT GAG ATA TAC A | 1504[a] | 304-325 |
| 1503[b] | 5'-AAC GGA GTG GGT GTA CGG AAT TAC AG | 1504[a] | 452-477 |
| | Resistance gene: dhfrXIII | | |
| 1505 | 5'-ATT TTT CGC AGG CTC ACC GAG AGC | 1507[a] | 106-129 |
| 1506[b] | 5'-CGG ATG AGA CAA CCT CGA ATT CTG CTG | 1507[a] | 413-439 |
| | Resistance gene: dhfrXV | | |
| 1508 | 5'-AGA ATG TAT TGG TAT TTC CAT CTA TCG | 1512[a] | 215-241 |
| 1509[b] | 5'-CAA TGT CGA TTG TTG AAA TAT GTA AA | 1512[a] | 336-361 |
| 1510 | 5'-TGG AGT GCC AAA GGG GAA CAA T | 1512[a] | 67-88 |
| 1511[b] | 5'-CAG ACA CAA TCA CAT GAT CCG TTA TCG | 1512[a] | 266-292 |
| | Resistance gene: dhfrXVII | | |
| 1513 | 5'-TTC AAG CTC AAA TGA AAA CGT CC | 1517[a] | 201-223 |
| 1514[b] | 5'-GAA ATT CTC AGG CAT TAT AGG GAA T | 1517[a] | 381-405 |
| 1515 | 5'-GTG GTC AGT AAA AGG TGA GCA AC | 1517[a] | 66-88 |
| 1516[b] | 5'-TCT TTC AAA GCA TTT TCT ATT GAA GG | 1517[a] | 232-257 |
| | Resistance gene: embB | | |
| 2102 | 5'-CAC CTT CAC CCT GAC CGA CG | 2105[a] | 822-841 |
| 2103[b] | 5'-CGA ACC AGC GGA AAT AGT TGG AC | 2105[a] | 948-970 |
| | Resistance genes: ereA, ereA2 | | |
| 1528 | 5'-AAC TTG AGC GAT TTT CGG ATA CCC TG | 1530[a] | 80-105 |
| 1529[b] | 5'-TTG CCG ATG AAA TAA CCG CCG ACT | 1530[a] | 317-340 |
| | Resistance gene: ereB | | |
| 1531 | 5'-TCT TTT TGT TAC GAC ATA CGC TTT T | 1535[a] | 152-176 |
| 1532[b] | 5'-AGT GCT TCT TTA TCC GCT GTT CTA | 1535[a] | 456-479 |
| 1533 | 5'-CAG CGG ATA AAG AAG CAC TAC ACA TT | 1535[a] | 461-486 |
| 1534[b] | 5'-CCT CCT GAA ATA AAG CCC GAC AT | 1535[a] | 727-749 |
| | Resistance gene: gyrA | | |
| 1340 | 5'-GAA CAA GGT ATG ACA CCG GAT AAA T | 1299[a] | 163-188 |
| 1341[b] | 5'-GAT AAC TGA AAT CCT GAG CCA TAC G | 1299[a] | 274-299 |

-continued

Annex L: Specific and ubiquitous primers for nucleic acid amplification (antimicrobial agents resistance genes sequences).

| SEQ ID NO. | Nucleotide sequence | Originating DNA fragment SEQ ID NO. | Nucleotide position |
|---|---|---|---|
| 1936 | 5'-TAC CAC CCG CAC GGC | 1954[a] | 205-219 |
| 1937[b] | 5'-CGG AGT CGC CGT CGA TG | 1954[a] | 309-325 |
| 1942 | 5'-GAC TGG AAC AAA GCC TAT AAA AAA TCA | 1954[a] | 148-174 |
| 1937[b] | 5'-CGG AGT CGC CGT CGA TG | 1954[a] | 309-325 |
| 2040 | 5'-TGT GAC CCC AGA CAA ACC C | 2054[a] | 33-51 |
| 2041[b] | 5'-GTT GAG CGG CAG CAC TAT CT | 2054[a] | 207-226 |
| | Resistance gene: inhA | | |
| 2098 | 5'-CTG AGT CAC ACC GAC AAA CGT C | 2101[a] | 910-931 |
| 2099[b] | 5'-CCA GGA CTG AAC GGG ATA CGA A | 2101[a] | 1074-1095 |
| | Resistance genes: linA, linA' | | |
| 1536 | 5'-AGA TGT ATT AAC TGG AAA ACA ACA A | 1540[a] | 99-123 |
| 1537[b] | 5'-CTT TGT AAT TAG TTT CTG AAA ACC A | 1540[a] | 352-376 |
| 1538 | 5'-TTA GAA GAT ATA GGA TAC AAA ATA GAA G | 1540[a] | 187-214 |
| 1539[b] | 5'-GAA TGA AAA AGA AGT TGA GCT T | 1540[a] | 404-425 |
| | Resistance gene: linB | | |
| 1541 | 5'-TGA TAA TCT TAT ACG TGG GGA ATT T | 1545[a] | 246-270 |
| 1542[b] | 5'-ATA ATT TTC TAA TTG CCC TGT TTC AT | 1545[a] | 359-384 |
| 1543 | 5'-GGG CAA TTA GAA AAT TAT TTA TCA GA | 1545[a] | 367-392 |
| 1544[b] | 5'-TTT TAC TCA TGT TTA GCC AAT TAT CA | 1545[a] | 579-604 |
| | Resistance gene: mefA | | |
| 1546 | 5'-CAA GAA GGA ATG GCT GTA CTA C | 1548[a] | 625-646 |
| 1547[b] | 5'-TAA TTC CCA AAT AAC CCT AAT AAT AGA | 1548[a] | 816-842 |
| | Resistance gene: mefE | | |
| 1549 | 5'-GCT TAT TAT TAG GAA GAT TAG GGG GC | 1551[a] | 815-840 |
| 1550[b] | 5'-TAG CAA GTG ACA TGA TAC TTC CGA | 1551[a] | 1052-1075 |
| | Resistance genes: mefA, mefE | | |
| 1552 | 5'-GGC AAG CAG TAT CAT TAA TCA CTA | 1548[a] | 50-73 |
| 1553[b] | 5'-CAA TGC TAC GGA TAA ACA ATA CTA TC | 1548[a] | 318-343 |
| 1554 | 5'-AGA AAA TTA AGC CTG AAT ATT TAG GAC | 1548[a] | 1010-1035 |
| 1555[b] | 5'-TAG TAA AAA CCA ATG ATT TAC ACC G | 1548[a] | 1119-1143 |
| | Resistance genes: mphA, mphK | | |
| 1556 | 5'-ACT GTA CGC ACT TGC AGC CCG ACA T | 1560[a] | 33-57 |
| 1557[b] | 5'-GAA CGG CAG GCG ATT CTT GAG CAT | 1560[a] | 214-237 |
| 1558 | 5'-GTG GTG GTG CAT GGC GAT CTC T | 1560[a] | 583-604 |
| 1559[b] | 5'-GCC GCA GCG AGG TAC TCT TCG TTA | 1560[a] | 855-878 |

-continued

Annex L: Specific and ubiquitous primers for nucleic acid amplification (antimicrobial agents resistance genes sequences).

| SEQ ID NO. | Nucleotide sequence | Originating DNA fragment SEQ ID NO. | Originating DNA fragment Nucleotide position |
|---|---|---|---|
| | Resistance gene: mupA | | |
| 2142 | 5'-GCC TTA ATT TCG GAT AGT GC | 2144[a] | 1831-1850 |
| 2143[b] | 5'-GAG AAA GAG CCC AAT TAT CTA ATG T | 2144[a] | 2002-2026 |
| | Resistance gene: parC | | |
| 1342 | 5'-GAT GTT ATT GGT CAA TAT CAT CCA | 1321[a] | 205-229 |
| 1343[b] | 5'-AAG AAA CTG TCT CTT TAT TAA TAT CAC GT | 1321[a] | 396-425 |
| 1934 | 5'-GAA CGC CAG CGC GAA ATT CAA AAA G | 1781 | 67-91 |
| 1935[b] | 5'-AGC TCG GCA TAC TTC GAC AGG | 1781 | 277-297 |
| 2044 | 5'-ACC GTA AGT CGG CCA AGT CA | 2055[a] | 176-195 |
| 2045[b] | 5'-GTT CTT TCT CCG TAT CGT C | 2055[a] | 436-454 |
| | Resistance gene: ppflo-like | | |
| 2163 | 5'-ACC TTC ATC CTA CCG ATG TGG GTT | 2165[a] | 922-945 |
| 2164[b] | 5'-CAA CGA CAC CAG CAC TGC CAT TG | 2165[a] | 1136-1158 |
| | Resistance gene: rpoB | | |
| 2065 | 5'-CCA GGA CGT GGA GGC GAT CAC A | 2072[a] | 1218-1239 |
| 2066[b] | 5'-CAC CGA CAG CGA GCC GAT CAG A | 2072[a] | 1485-1506 |
| | Resistance gene: satG | | |
| 1581 | 5'-AAT TGG GGA CTA CAC CTA TTA TGA TG | 1585[a] | 93-118 |
| 1582[b] | 5'-GGC AAA TCA GTC AGT TCA GGA GT | 1585[a] | 310-332 |
| 1583 | 5'-CGA TTG GCA ACA ATA CAC TCC TG | 1585[a] | 294-316 |
| 1584[b] | 5'-TCA CCT ATT TTT ACG CCT GGT AGG AC | 1585[a] | 388-413 |
| | Resistance gene: sulII | | |
| 1961 | 5'-GCT CAA GGC AGA TGG CAT TCC C | 1965[a] | 222-243 |
| 1962[b] | 5'-GGA CAA GGC GGT TGC GTT TGA T | 1965[a] | 496-517 |
| 1963 | 5'-CAT TCC CGT CTC GCT CGA CAG T | 1965[a] | 237-258 |
| 1964[b] | 5'-ATC TGC CTG CCC GTC TTG C | 1965[a] | 393-411 |
| | Resistance gene: tetB | | |
| 1966 | 5'-CAT GCC AGT CTT GCC AAC G | 1970[a] | 66-84 |
| 1967[b] | 5'-CAG CAA TAA GTA ATC CAG CGA TG | 1970[a] | 242-264 |
| 1968 | 5'-GGA GAG ATT TCA CCG CAT AG | 1970[a] | 457-476 |
| 1969[b] | 5'-AGC CAA CCA TCA TGC TAT TCC A | 1970[a] | 721-742 |
| | Resistance gene: tetM | | |
| 1586 | 5'-ATT CCC ACA ATC TTT TTT ATC AAT AA | 1590[a] | 361-386 |
| 1587[b] | 5'-CAT TGT TCA GAT TCG GTA AAG TTC | 1590[a] | 501-524 |

-continued

| Annex L: Specific and ubiquitous primers for nucleic acid amplification (antimicrobial agents resistance genes sequences). | | | |
|---|---|---|---|
| | | Originating DNA fragment | |
| SEQ ID NO. | Nucleotide sequence | SEQ ID NO. | Nucleotide position |
| 1588 | 5'-GTT TTT GAA GTT AAA TAG TGT TCT T | 1590[a] | 957-981 |
| 1589[b] | 5'-CTT CCA TTT GTA CTT TCC CTA | 1590[a] | 1172-1192 |
| | Resistance gene: vatB | | |
| 1609 | 5'-GCC CTG ATC CAA ATA GCA TAT A | 1613[a] | 11-32 |
| 1610[b] | 5'-CCT GGC ATA ACA GTA ACA TTC TG | 1613[a] | 379-401 |
| 1611 | 5'-TGG GAA AAA GCA ACT CCA TCT C | 1613[a] | 301-322 |
| 1612[b] | 5'-ACA ACT GAA TTC GCA GCA ACA AT | 1613[a] | 424-446 |
| | Resistance gene: vatC | | |
| 1614 | 5'-CCA ATC CAG AAG AAA TAT ACC C | 1618[a] | 26-47 |
| 1615[b] | 5'-ATT AGT TTA TCC CCA ATC AAT TCA | 1618[a] | 177-200 |
| 1616 | 5'-ATA ATG AAT GGG GCT AAT CAT CGT AT | 1618[a] | 241-266 |
| 1617[b] | 5'-GCC AAC AAC TGA ATA AGG ATC AAC | 1618[a] | 463-486 |
| | Resistance gene: vga | | |
| 1619 | 5'-AAG GCA AAA TAA AAG GAG CAA AGC | 1623[a] | 641-664 |
| 1620[b] | 5'-TGT ACC CGA GAC ATC TTC ACC AC | 1623[a] | 821-843 |
| 1621 | 5'-AAT TGA AGG ACG GGT ATT GTG GAA AG | 1623[a] | 843-868 |
| 1622[b] | 5'-CGA TTT TGA CAG ATG GCG ATA ATG AA | 1623[a] | 975-1000 |
| | Resistance gene: vgaB | | |
| 1624 | 5'-TTC TTT AAT GCT CGT AGA TGA ACC TA | 1628[a] | 354-379 |
| 1625[b] | 5'-TTT TCG TAT TCT TCT TGT TGC TTT C | 1628[a] | 578-602 |
| 1626 | 5'-AGG AAT GAT TAA GCC CCC TTC AAA AA | 1628[a] | 663-688 |
| 1627[b] | 5'-TTA CAT TGC GAC CAT GAA ATT GCT CT | 1628[a] | 849-874 |
| | Resistance genes: vgb, vgh | | |
| 1629 | 5'-AAG GGG AAA GTT TGG ATT ACA CAA CA | 1633[a] | 73-98 |
| 1630[b] | 5'-GAA CCA CAG GGC ATT ATC AGA ACC | 1633[a] | 445-468 |
| 1631 | 5'-CGA CGA TGC TTT ATG GTT TGT | 1633[a] | 576-596 |
| 1632[b] | 5'-GTT AAT TTG CCT ATC TTG TCA CAC TC | 1633[a] | 850-875 |
| | Resistance gene: vgbB | | |
| 1634 | 5'-TTA ACT TGT CTA TTC CCG ATT CAG G | 1882[a] | 23-47 |
| 1635[b] | 5'-GCT GTG GCA ATG GAT ATT CTG TA | 1882[a] | 267-289 |
| 1636 | 5'-TTC CTA CCC CTG ATG CTA AAG TGA | 1882[a] | 155-178 |
| 1637[b] | 5'-CAA AGT GCG TTA TCC GAA CCT AA | 1882[a] | 442-464 |
| | Sequencing primers<br>Resistance gene: gyrA | | |
| 1290 | 5'-GAY TAY GCI ATG ISI GTI ATH GT | 1299[a] | 70-83 |
| 1292[b] | 5'-ARI SCY TCI ARI ATR TGI GC | 1299[a] | 1132-1152 |

-continued

Annex L: Specific and ubiquitous primers for nucleic acid amplification (antimicrobial agents resistance genes sequences).

| SEQ ID NO. | Nucleotide sequence | Originating DNA fragment SEQ ID NO. | Originating DNA fragment Nucleotide position |
|---|---|---|---|
| 1291 | 5'-GCI YTI CCI GAY GTI MGI GAY GG | 1299[a] | 100-123 |
| 1292[b] | 5'-ARI SCY TCI ARI ATR TGI GC | 1299[a] | 1132-1152 |
| 1293 | 5'-ATG GCT GAA TTA CCT CAA TC | 1299[a] | 1-21 |
| 1294[b] | 5'-ATG ATT GTT GTA TAT CTT CTT CAA C | 1299[a] | 2626-2651 |
| 1295[b] | 5'-CAG AAA GTT TGA AGC GTT GT | 1299[a] | 1255-1275 |
| 1296 | 5'-AAC GAT TCG TGA GTC AGA TA | 1299[a] | 1188-1208 |
| 1297 | 5'-CGG TCA ACA TTG AGG AAG AGC T | 1300[a] | 29-51 |
| 1298[b] | 5'-ACG AAA TCG ACC GTC TCT TTT TC | 1300[a] | 415-437 |
| | Resistance gene: gyrB | | |
| 1301 | 5'-GTI MGI AWI MGI CCI GSI ATG TA | 1307[a] | 82-105 |
| 1302[b] | 5'-TAI ADI GGI GGI KKI GCI ATR TA | 1307[a] | 1600-1623 |
| 1303 | 5'-GGI GAI GAI DYI MGI GAR GG | 1307[a] | 955-975 |
| 1304[b] | 5'-CIA RYT TIK YIT TIG TYT G | 1307[a] | 1024-1043 |
| 1305 | 5'-ATG GTG ACT GCA TTG TCA GAT G | 1307[a] | 1-23 |
| 1306[b] | 5'-GTC TAC GGT TTT CTA CAA CGT C | 1307[a] | 1858-1888 |
| | Resistance gene: parC | | |
| 1308 | 5'-ATG TAY GTI ATI ATG GAY MGI GC | 1320[a] | 67-90 |
| 1309[b] | 5'-ATI ATY TTR TTI CCY TTI CCY TT | 1320[a] | 1993-2016 |
| 1310 | 5'-ATI ATI TSI ATI ACY TCR TC | 1320[a] | 1112-1132 |
| 1311[b] | 5'-GAR ATG AAR ATI MGI GGI GAR CA | 1320[a] | 1288-1311 |
| 1312 | 5'-AAR TAY ATI ATI CAR GAR MGI GC | 1321[a] | 67-90 |
| 1313[b] | 5'-AMI AYI CKR TGI GGI TTI TTY TT | 1321[a] | 2212-2235 |
| 1314 | 5'-TAI GAI TTY ACI GAI SMI CAR GC | 1321[a] | 1228-1251 |
| 1315[b] | 5'-ACI ATI GCI TCI GCY TGI KSY TC | 1321[a] | 1240-1263 |
| 1316 | 5'-GTG AGT GAA ATA ATT CAA GAT T | 1321[a] | 1-23 |
| 1317[b] | 5'-CAC CAA AAT CAT CTG TAT CTA C | 1321[a] | 2356-2378 |
| 1318 | 5'-ACC TAY TCS ATG TAC GTR ATC ATG GA | 1320[a] | 58-84 |
| 1319[b] | 5'-AGR TCG TCI ACC ATC GGY AGY TT | 1320[a] | 832-855 |
| | Resistance gene: parE | | |
| 1322 | 5'-RTI GAI AAY ISI GTI GAY GAR G | 1328[a] | 133-155 |
| 1325[b] | 5'-RTT CAT YTC ICC IAR ICC YTT | 1328[a] | 1732-1752 |
| 1323 | 5'-ACI AWR SAI GGI GGI ACI CAY G | 1328[a] | 829-850 |

-continued

Annex L: Specific and ubiquitous primers for nucleic acid amplification (antimicrobial agents resistance genes sequences).

| SEQ ID NO. | Nucleotide sequence | Originating DNA fragment SEQ ID NO. | Nucleotide position |
|---|---|---|---|
| 1324[b] | 5'-CCI CCI GCI SWR TCI CCY TC | 1328[a] | 1280-1302 |
| 1326 | 5'-TGA TTC AAT ACA GGT TTT AGA G | 1328[a] | 27-49 |
| 1327[b] | 5'-CTA GAT TTC CTC CTC ATC AAA T | 1328[a] | 1971-1993 |

[a]Sequence from databases.
[b]These sequences are from the complementary DNA strand of the sequence of the originating fragment given in the Sequence Listing.

Annex LI: Internal hybridization probes for specific detection of antimicrobial agents resistance genes sequences.

| SEQ ID NO. | Nucleotide sequence | Originating DNA fragment SEQ ID NO. | Nucleotide position |
|---|---|---|---|
| | Resistance gene: aph3'VIa | | |
| 2252 | 5'-CCA CAT ACA GTG TCT CTC | 1406[a] | 149-166 |
| | Resistance gene: blaSHV | | |
| 1886 | 5'-GAC GCC CGC GCC ACC ACT | 1900[a] | 484-501 |
| 1887 | 5'-GAC GCC CGC GAC ACC ACT A | 1899[a] | 514-532 |
| 1888 | 5'-GAC GCC CGC AAC ACC ACT A | 1901[a] | 514-532 |
| 1889 | 5'-GTT CGC AAC TGC AGC TGC TG | 1899[a] | 593-612 |
| 1890 | 5'-TTC GCA ACG GCA GCT GCT G | 1899[a] | 594-612 |
| 1891 | 5'-CCG GAG CTG CCG AIC GGG | 1902[a] | 692-709 |
| 1892 | 5'-CGG AGC TGC CAA RCG GGG | 1903[a] | 693-710 |
| 1893 | 5'-GGA GCT GGC GAR CGG GGT | 1899[a] | 694-711 |
| 1894 | 5'-GAC CGG AGC TAG CGA RCG | 1904[a] | 690-707 |
| 1895 | 5'-CGG AGC TAG CAA RCG GGG T | 1905[a] | 693-711 |
| 1896 | 5'-GAA ACG GAA CTG AAT GAG GCG | 1899[a] | 484-504 |
| 1897 | 5'-CAT TAC CAT GGG CGA TAA CAG | 1899[a] | 366-386 |
| 1898 | 5'-CCA TTA CCA TGA GCG ATA ACA G | 1899[a] | 365-386 |
| | Resistance gene: blaTEM | | |
| 1909 | 5'-ATG ACT TGG TTA AGT ACT CAC C | 1928[a] | 293-314 |
| 1910 | 5'-ATG ACT TGG TTG AGT ACT CAC C | 1927[a] | 293-314 |
| 1911 | 5'-CCA TAA CCA TGG GTG ATA ACA C | 1928[a] | 371-392 |
| 1912 | 5'-CCA TAA CCA TGA GTG ATA ACA C | 1927[a] | 371-392 |
| 1913 | 5'-CGC CTT GAT CAT TGG GAA CC | 1928[a] | 475-494 |
| 1914 | 5'-CGC CTT GAT CGT TGG GAA CC | 1927[a] | 475-494 |
| 1915 | 5'-CGC CTT GAT AGT TGG GAA CC | 1929[a] | 475-494 |
| 1916 | 5'-CGT GGG TCT TGC GGT ATC AT | 1927[a] | 712-731 |

-continued

Annex LI: Internal hybridization probes for specific detection of antimicrobial agents resistance genes sequences.

| SEQ ID NO. | Nucleotide sequence | Originating DNA fragment SEQ ID NO. | Nucleotide position |
|---|---|---|---|
| 1917 | 5'-CGT GGG TCT GGC GGT ATC AT | 1930[a] | 712-731 |
| 1918 | 5'-GTG GGT CTC ACG GTA TCA TTG | 1927[a] | 713-733 |
| 1919 | 5'-CGT GGG TCT CTC GGT ATC ATT | 1931[a] | 712-732 |
| 1920 | 5'-CGT GGI TCT CGC GGT ATC AT | 1927[a] | 712-731 |
| 1921 | 5'-CGT GGG TCT AGC GGT ATC ATT | 1932[a] | 713-733 |
| 1922 | 5'-GTT TTC CAA TGA TTA GCA CTT TTA | 1927[a] | 188-211 |
| 1923 | 5'-GTT TTC CAA TGA TAA GCA CTT TTA | 1927[a] | 188-211 |
| 1924 | 5'-GTT TTC CAA TGC TGA GCA CTT TT | 1932[a] | 188-210 |
| 1925 | 5'-CGT TTT CCA ATG ATG AGC ACT TT | 1927[a] | 187-209 |
| 1926 | 5'-GTT TTC CAA TGG TGA GCA CTT TT | 1933[a] | 188-210 |
| 2006 | 5'-TGG AGC CGG TGA GCG TGG | 1927[a] | 699-716 |
| 2007 | 5'-TGG AGC CAG TGA GCG TGG | 2010[a] | 699-716 |
| 2008 | 5'-TCT GGA GCC GAT GAG CGT G | 1929[a] | 697-715 |
| 2009 | 5'-CTG GAG CCA GTA AGC GTG G | 2011[a] | 698-716 |
| 2141 | 5'-CAC CAG TCA CAG AAA AGC | 1927[a] | 311-328 |
| | Resistance gene: dhfrIa | | |
| 2253 | 5'-CAT TAC CCA ACC GAA AGT A | 1461[a] | 158-176 |
| | Resistance gene: embB | | |
| 2104 | 5'-CTG GGC ATG GCI CGA GTC | 2105[a] | 910-927 |
| | Resistance gene: gyrA | | |
| 1333 | 5'-TCA TGG TGA CTT ATC TAT TTA TG | 1299[a] | 240-263 |
| 1334 | 5'-CAT CTA TTT ATA AAG CAA TGG TA | 1299[a] | 251-274 |
| 1335 | 5'-CTA TTT ATG GAG CAA TGG T | 1299[a] | 254-273 |
| 1940 | 5'-GTA TCG TTG GTG ACG TAA T | 1299[a] | 206-224 |
| 1943 | 5'-GCT GGT GGA CGG CCA G | 1954[a] | 279-294 |
| 1945 | 5'-CGG CGA CTA CGC GGT AT | 1954[a] | 216-232 |
| 1946 | 5'-CGG CGA CTT CGC GGT AT | 1954[a] | 216-232 |
| 1947 | 5'-CGG TAT ACG GCA CCA TCG T | 1954[a] | 227-245 |
| 1948 | 5'-GCG GTA TAC AAC ACC ATC G | 1954[a] | 226-244 |
| 1949 | 5'-CGG TAT ACG CCA CCA TCG T | 1954[a] | 227-245 |
| 2042 | 5'-CAC GGG GAT TTC TCT ATT TA | 2054[a] | 103-122 |
| 2043 | 5'-CAC GGG GAT TAC TCT ATT TA | 2054[a] | 103-122 |
| | Resistance gene: inhA | | |
| 2100 | 5'-GCG AGA CGA TAG GTT GTC | 2101[a] | 1017-1034 |

-continued

Annex LI: Internal hybridization probes for specific detection of antimicrobial agents resistance genes sequences.

| SEQ ID NO. | Nucleotide sequence | Originating DNA fragment SEQ ID NO. | Originating DNA fragment Nucleotide position |
|---|---|---|---|
| | Resistance gene: parC | | |
| 1336 | 5'-TGG AGA CTA CTC AGT GT | 1321[a] | 232-249 |
| 1337 | 5'-TGG AGA CTT CTC AGT GT | 1321[a] | 232-249 |
| 1338 | 5'-GTG TAC GGA GCA ATG | 1321[a] | 245-260 |
| 1339 | 5'-CCA GCG GAA ATG CGT | 1321[a] | 342-357 |
| 1941 | 5'-GCA ATG GTC CGT TTA AGT | 1321[a] | 253-270 |
| 1944 | 5'-TTT CGC CGC CAT GCG TTA C | 1781 | 247-265 |
| 1950 | 5'-GGC GAC ATC GCC TGC | 1781 | 137-151 |
| 1951 | 5'-GGC GAC AGA GCC TGC TA | 1781 | 137-153 |
| 1952 | 5'-CCT GCT ATG GAG CGA TGG T | 1781 | 147-165 |
| 1953 | 5'-CGC CTG CTA TAA AGC GAT GGT | 1781 | 145-165 |
| 2046 | 5'-ACG GGG ATT TTT CTA TCT AT | 2055[a] | 227-246 |
| | Resistance gene: rpoB | | |
| 2067 | 5'-AGC TGA GCC AAT TCA TGG | 2072[a] | 1304-1321 |
| 2068 | 5'-ATT CAT GGA CCA GAA CAA C | 2072[a] | 1314-1332 |
| 2069 | 5'-CGC TGT CGG GGT TGA CCC | 2072[a] | 1334-1351 |
| 2070 | 5'-GTT GAC CCA CAA GCG CCG | 2072[a] | 1344-1361 |
| 2071 | 5'-CGA CTG TCG GCG CTG GGG | 2072[a] | 1360-1377 |
| | Resistance gene: tetM | | |
| 2254 | 5'-ACC TGA ACA GAG AGA AAT G | 1590[a] | 1062-1080 |

[a]Sequence from databases.

Annex LII: Molecular beacon internal hybridization probes for specific detection of atpD sequences.

| SEQ ID NO. | Nucleotide sequence[a] | Originating DNA fragment SEQ ID NO. | Originating DNA fragment Nucleotide position |
|---|---|---|---|
| | Bacterial species: *Bacteroides fragilis* | | |
| 2136 | 5'-CCA ACG CGT CCT CAA TCA TTT CTA ACT TCT ATG GCC GGC GTT GG | 929 | 353-382 |
| | Bacterial species: *Bordetella pertussis* | | |
| 2182 | 5'-GCG CGC CAA CGA CTT CTA CCA CGA AAT GGA AGA GTC GCG CGC | 1672 | 576-605 |

-continued

Annex LII: Molecular beacon internal hybridization probes for specific detection of atpD sequences.

| SEQ ID NO. | Nucleotide sequence[a] | Originating DNA fragment SEQ ID NO. | Originating DNA fragment Nucleotide position |
|---|---|---|---|
| | Bacterial group: *Campylobacter jejuni* and *C. coli* | | |
| 2133 | 5'-CCA CGC ACA WAA ACT TGT TTT AGA AGT AGC AGC WCA GCG TGG | 1576, 1600, 1849, 1863, 2139[b,c] | 44-73[d] |
| | Fungal species: *Candida glabrata* | | |
| 2078 | 5'-CCG AGC CTT GGT CTT CGG CCA AAT GAA CGC TCG G | 463 | 442-463 |
| | Fungal species: *Candida krusei* | | |
| 2075 | 5'-CCG AGC CAG GTT CTG AAG TCT CTG CAT TAT TAG GTG CTC GG | 468 | 720-748 |
| | Fungal species: *Candida lusitaniae* | | |
| 2080 | 5'-CCG AGC CGA AGA GGG CCA AGA TGT CGC TCG G | 470 | 520-538 |
| | Fungal species: *Candida parapsilosis* | | |
| 2079 | 5'-CCG AG C GTT CAG TTA CTT CAG TCC AAG CCG GCT CGG | 472 | 837-860 |
| | Fungal species: *Candida tropicalis* | | |
| 2077 | 5'-CCG AGC AAC CGA TCC AGC TCC AGC TAC GCT CGG | 475 | 877-897 |
| | Bacterial species: *Klebsiella pneumoniae* | | |
| 2281 | 5'-CCC CCA GCT GGG CGG CGG TAT CGA TGG GGG | 317 | 40-59 |
| | Fungal genus: *Candida* sp. | | |
| 2076 | 5'-CCG AGC YGA YAA CAT TTT CAG ATT CAC CCA RGC GCT CGG | 460-478, 663[b] | 697-723[c] |

[a]Underlined nucleotides indicate the molecular beacon's stem.
[b]Sequence from databases.
[c]These sequences were aligned to derive the corresponding primer.
[d]The nucleotide positions refer to the *C. jejuni* atpD sequence fragment (SEQ ID NO. 1576).
[a]Underlined nucleotides indicate the molecular beacon's stem.
[b]These sequences were aligned to derive the corresponding primer.
[c]The nucleotide positions refer to the *C. albicans* atpD sequence fragment (SEQ ID NO. 460).

Annex LIII: Internal hybridization probes for specific detection of atpD sequences.

| SEQ ID NO. | Nucleotide sequence | Originating DNA fragment SEQ ID NO. | Originating DNA fragment Nucleotide position |
|---|---|---|---|
| | Bacterial species: *Acinetobacter baumannii* | | |
| 2169 | 5'-CCC GTT TGC GAA AGG TGG | 243 | 304-321 |
| | Bacterial species: *Klebsiella pneumoniae* | | |
| 2167 | 5'-CAG CAG CTG GGC GGC GGT | 317 | 36-53 |

Annex LIV: Internal hybridization probes for specific detection of ddl and mtl sequences.

| SEQ ID NO. | Nucleotide sequence | Originating DNA fragment SEQ ID NO. | Nucleotide position |
|---|---|---|---|
| | Bacterial species: *Enterococcus faecium* (ddl) | | |
| 2286 | 5'-AGT TGC TGT ATT AGG AAA TG | 2288[a] | 784-803 |
| 2287 | 5'-TCG AAG TTG CTG TAT TAG GA | 2288[a] | 780-799 |
| | Bacterial species: *Enterococcus faecalis* mtl) | | |
| 2289 | 5'-CAC CGA AGA AGA TGA AAA AA | 1243[a] | 264-283 |
| 2290 | 5'-TGG CAC CGA AGA AGA TGA | 1243[a] | 261-278 |
| 2291 | 5'-ATT TTG GCA CCG AAG AAG A | 1243[a] | 257-275 |

[a]Sequence from databases.

SEQUENCE LISTING (2672 sequences)

SEQ ID NO: 1 - DNA, 750 bp, Acinetobacter baumannii
  ref <308>: DATABASE ACCESSION NUMBER: ATCC 19606
caaactcgtgagcacatccttctttctcgtcaggtaggtgtaccttacatcatcgtattcttaaacaaatgcgaccttgttgatgacgaagaattacttgaattagtagaaatggaagtacgtgaacttctttctacttatgacttcccaggtgatgacactccagtaatccgtggttcagctcttgcagcgcttaacggtgaagctggtccttacggtgaagaatcagttcttgctcttgtagcagcacttgactcttacatcccagagccagagcgtgcaatcgacaaagcattcttgatgccaatcgaagacgtattctcaatttctggtcgtggtacagtagtaacaggccgtgttgaagctggtatcatcaaagttggtgaagaagtagagatcgttggtattaaagatacagttaaaacaactgtaactggcgtagaaatgttccgtaaacttcttgacgaaggccgtgcaggtgagaactgtggtatcttacttcgtggtactaagcgtgaagaagtacaacgtggtcaagtacttgctaaaccaggtacaatcaagccgcacactaaattcgacgcagaagtatacgtactttctaaagaagaaggtggtcgtcacactccattcttaaatggttaccgtccacagttctacttccgtacaactgacgtaactggtgcratccagttgaaagaaggcgttgaaatggtaatgccaggtgacaacgttgaaatgtcagtagaa

SEQ ID NO: 2 - DNA, 826 bp, Actinomyces meyeri
  ref <308>: DATABASE ACCESSION NUMBER: ATCC 35568
cggtgcgatcctcgtggtcgccgcgaccgacggccccatggcccagacccgcgagcacgtcctgctcgcccgtcaggtcggcgttcccaccatcctcatcgccctcaacaagtccgacatggttgacgacgaggaaatgatggaactggtcgaggaggagtgccgcgacctgctggagtcccaggacttcgatcgcgatgccccgatcgtccaggtttccgctctgaaggccctcgagggcgacgcggagtgggttgccaagatcgaggagctcatggaggctgtggattcctacatccccacccccgagcgcgatatggacaagcccttcctcatgccgatcgaggacgtcttcacgatcacaggtcgtggcacggtcgtcacggggcgtgttgagcgtggcaagctgccgatcaactccgaggtcgagatcctcggtatccgtgatccccagaagaccacggtcaccggcatcgagatgttccacaagtcgatggacgaggcatgggccggcgagaactgtggcctgctgctgcgcggtaccaagcgcgatgaggttgagcgcggccaggttgtggccattcccggctccatcacgcctcacaccgagttcgagggccaggtttacatcctcaagaaggaagagggcggccgtcacaacccgttcttctcgaactaccgtccgcagttctacttccgtaccacggacgtgaccggcgtcatcaccctccccgagggcaccgacatggtcatgcctggcgacaccaccgagatctccgttcagctgatccagcccatcgccatggagcccggctgggcttcgcca

SEQ ID NO: 3 - DNA, 835 bp, Aerococcus viridans
  ref <308>: DATABASE ACCESSION NUMBER: ATCC 11563
tggtgcgatcttagtagtatctgctgctgatggtccaatgccacaaactcgtgagcacatccttttagctggccaaatcggtgttcctgcattcgtagtattcttaaacaaagttgaccaagttgacgatgaagaattactagaattagttgaaatggaagttcgtgacttattatctgagtacaactacccaggtgacgatctacctgtaatcgctggttctgctttattagcattacaaggcgatgaagctcaagaagctaaaatcatggaattaatggaagctgtagactcttacattccagaaccagaacgtgacaacgacaaaccattcatgatgccaattgaggatgtattctcaatcactggtcgtggtactgttgctacaggtcgtgttgaacgtggtgaagttcgtacaggtgacgaagttgacatcgttggtattgctgaacaaatcggtaaatcagttgtaactggtgttgaaatgttccgtaaaaacttagactacgctcaagctggtgacaacatcggtgcattattacgtggtgttcaacgtgaagacatccaacgtggtcaagtattggctgctcctggttcaatcactccacatactaaatttaaagcgcaagtttacgttttatctaaagaagaaggtggacgtcatacaccattcttaactaactaccgtccacaattctacttccgtactactgacattactggtgttatcactttaccagaagacgtagctatggttatgcctggtgacaacgttgatatggacgttgaattgattcacccagttgcgatcgaagatggtactaaattctctatc

SEQ ID NO: 4 - DNA, 827 bp, Achromobacter xylosoxidans subsp. denitrificans
  ref <308>: DATABASE ACCESSION NUMBER: ATCC 15173
cctggtggtgtcggccgctgacggcccgatgccgcaaacgcgcgaacacatcctgctgagccgccaggttggcgtgccgtacatcatcgtcttcctgaacaaggccgacatggttgacgacgccgagctgcttgagctggtggaaatggaagttcgcgarctgctgagcaagtacgacttcccgggcgacgacaccccgatcgtgaagggttcggccaagctggcgctggaaggcgacaagggcgaactgggcgaacaggccatcatggcgctggccgctgcgctggactcgtacatcccgacgcctgagcgtgccgttgacggcgcgttcctgatgccggttgaagacgtgttctcgatctcgggtcgcggcaccgtggtgaccggccgtatcgaacgcggcatcatcaaggtcggcgaggaaatcgaaatcgtcggtctggtgccgacggtgaagacgacctgcacgggcgtggaaatgttccgcaagctgctggaccaaggtcaagccggcgacaacgtgggcatcctrctgcgcggcaccaagcgtgaagacgtccagcgcggccaggttctggccaagccgggctcgatcaccccgcacacggacttcacgtccgaggtgtacatcctgtccaaggaagaaggcggccgtcacactccgttcttccaaggctatcgtccccagttctacttccgcacgacggacgtgacgggcacgatcgagctgccggccgacaaggaaatggtcctgccgggcgacaacgtggccatgacggtcaagctgctggctccgatcgccatggaagaaggcctgcgttcgccac

SEQ ID NO: 5 - DNA, 823 bp, Anaerorhabdus furcosus
  ref <308>: DATABASE ACCESSION NUMBER: ATCC 25662
tggatcaatcctagtagttgctgcaactgatggaccaatgcctcaaactcgtgaacatatcttacttgctcgtcaagtaggtgttccaagaatggttgtattcttgaacaaatgcgacatggttgaagatgaagaattaatcgaccttgttgaaatggaagttcgtgaacttctaagtgcttacggtttcgaaggtgatgatacaccagttatccgtggttctgcattaaaatctcttgaaggaaatgctgattgggaagcaaaagttgctgaattaatggatgcagttgactcttggattccaactccaactcatgaaacagacaaaccattcttaatggctgttgaagatgtattcacaattacaggtcgtggtacagttgctactggacgtgttgaacgtggacacttaaaccttaacgaagaagttgaaatcgttggtattcatgatactaagaaatcagttgttactggtatcgaaatgttccgtaaattattagactatgctgaagcaggagacaacattggtgcattattacgtggtgtttctcgtgatgaaatcgaacgtggacaatgtctagctaaacctggatcagttactccacatacagctttcaaagctcaagtatacgtattaactaaagaagaaggtggacgtcatacaccattcgtaactaactaccgtcctcaattctatttccgtacaactgacgtaacaggagttgttaaacttcctgaaggtactgaaatggttatgcctggagacaacatcgaaatgatcgttgaattaatcgctccaatcgctgttgaacaaggaactaag

SEQ ID NO: 6 - DNA, 825 bp, Bacillus anthracis
  strain 4229
cggcggtatcttagtagtatctgctgctgatggcccaatgcctcaaactcgtgagcacatccttctttctcgtcaagtaggtgtaccttacatcgttgtattcttaaacaaatgcgacatggtagacgacgaagaattattagaattagtagaaatggaagttcgcgacctattatctgaatacggattcccaggcgacgacattcctgtaatcaaaggttctgctcttaaagctcttcaaggagaagctgattgggaagcaaaaatcattgaattaatggctgaagttgatgcttacatcccaactccagaacgtgaaactgacaaaccattcttaatgcctgtagaggacgtattctctatcacaggtcgtggtacagttgctactggtcgtgttgagcgcggtatcgttaaagttggtgacgtagtagaaatcatcggtcttgctgaagaaaatgcttctacaactgtaactggtgtagagatgttccgtaaacttcttgaccaagctcaagctggagacaacatcggtgctttacttcgtggggttgctcgtgaagacatccaacgtggacaagtacttgcaaaaagcggttctgtaaaagctcacgctaaattcaaagctgaagttttcgtattatctaaagaagaaggtggacgtcacactccattcttcgctaactaccgtcctcagttctacttccgtacaactgacgtaactggtatcatccaattaccagaaggtactgaaatggtaatgcctggtgacaacatcgaaatgactatcgaacttatcgctccaatcgctatcgaagagggaactaa

SEQ ID NO: 7 - DNA, 829 bp, Bacillus cereus
  ref <308>: DATABASE ACCESSION NUMBER: ATCC 14579
cggcggtatcttagtagtatctgctgctgatggcccaatgcctcaaacacgtgagcacatccttctttctcgtcaagtaggtgttccttacatcgttgtattcttaaacaaatgcgacatggtagatgacgaagaattattagaattagtagaaatggaagttcgcgacctattatctgaatacggattcccaggcgacgacattcctgtaatcaaaggttctgctcttaaagctcttcaaggagaagctgattgggaagcaaaaatcattgaattaatggctgaagttgatgcttacatcccaactccagaacgtgaaactgacaaaccattcttaatgcctgtagaggacgtattctctatcacaggtcgtggtacagttgctactggtcgtgttgagcgcggtatcgttaaagttggtgacgtagtagaaatcatcggtcttgctgaagaaaatgcttctacaactgtaactggtgtagagatgttccgtaaacttcttgaccaagctcaagctggagacaacatcggtgctttacttcgtggggttgctcgtgaagacatccaacgtggacaagtacttgcaaaaagcggttctgtaaaagctcacgctaaattcaaagctgaagttttcgtattatctaaagaagaaggtggacgtcacactccattcttcgctaactaccgtcctcagttctacttccgtacaactgacgtaactggtatcatccaattaccagaaggtactgaaatggtaatgcctggtgacaacattgaaatgactatcgaacttatcgctccaatcgctatcgaagagggaactaaattc

SEQ ID NO: 8 - DNA, 818 bp, Bacteroides distasonis
  ref <308>: DATABASE ACCESSION NUMBER: ATCC 8503
cggtgctatcatcgtagttgctgctactgatggtcctatgcctcaaactcgcgagcacatccttttggctcgtcaggtaaacgttccgagattggttgtattcatgaacaagtgtgacatggttgacgacgaggaaatgttggaattggttgagatggagatgagagagttgctttcattctatcaattcgacggtgacaacactccgatcatccgtggttctgctcttggtgcattgaacggtgatgctcaatgggaagataaagtaatggagttgatggaagcttgtgatacttggattcctctgcctccgcgcgaaatcgacaagccgttcttgatgccggttgaggacgtattctcaatcacgggtcgtggtactgttgctacaggtcgtatcgagacaggtattgttaaggttggtgaggaagttcagatcatcggtcttggcgctgctggtaagaaatctgttgttacaggtgttgagatgttccgtaagttattggatcaaggtgaggctggtgataacgttggtttgttgcttcgcggtatcgataagaatgagatcaagcgtggtatggtaatctgccacccgggtcaggttaaagagcattctaagttcaaggctgaggtttatatcttgaagaaagaggaaggtggtcgtcacactccgttccacaacaaatatcgtcctcagttctatatccgtacattggatgtaactggtgagatcactttgccggaaggaactgaaatggtaatgccgggtgataacgtaacgatcgaggttgagttgatctatccggtagcatgtagcgtag

SEQ ID NO: 9 - DNA, 639 bp, Enterococcus casseliflavus
  strain R763
ggtcctatgcctcaaacacgtgaacacatcttgttatcacgtaacgttggtgtaccatacatcgttgttttcttaaacaaaatggatatggttgatgacgaagaattactagaattagttgaaatggaagttcgtgacttattgtcagaatatgacttcccaggcgacgatgttcctgtaatcgctggttctgctttgaaagctcttgaaggcgatgcttcatacgaagaaaaaatcatggaattaatggctgcagttgacgaatacgttccaactccagaacgtgacactgacaaaccattcatgatgccagtcgaagacgtattctcaatcactggacgtggtactgttgctacaggccgtgttgaacgtggacaagttcgcgttggtgacgaagttgaaatcgttggtattgctgaagaaactgctaaaacaactgtaactggtgttgaaatgttccgtaaattgttagactatgctgaagcaggggataacattggtgcattgctacgtggtgttgctcgtgaagacatccaacgtggacaagtattggctaaagctggtacaatcacacctcatacaaaatttaaagctgaagtttacgttttaacaaaagaagaaggtggacgtcacacacca

SEQ ID NO: 10 - DNA, 692 bp, Staphylococcus saprophyticus
  strain CSG 197
gaacacattcttttatcacgtaacgttggtgttccagcattagttgtattcttaaacaaagttgacatggttgacgatgaagaattattagaattagtagaaatggaagttcgtgacttattaagcgaatatgacttcccaggtgacgatgtacctgtaatctctggttctgcattaaaagctttagaaggcgacgctgactatgagcaaaaaatcttagacttaatgcaagctgttgatgacttcattccaacaccagaacgtgattctgacaaaccattcatgatgccagttgaggacgtattctcaatcactggtcgtggtactgttgctacaggccgtgttgaacgtggtcaaatcaaagtcggtgaagaaatcgaaatcatcggtatgcaagaagaatcaagcaaaacaactgttactggtgtagaaatgttccgtaaattattagactacgctgaagctggtgacaacattggtgcattattacgtggtgtttcacgtgatgacgtacaacgtggtcaagttttagctgctcctggtactattacaccacatacaaaattcaaagcggatgtttacgttttatctaaagatgaaggtggtcgtcatacaccattcttcactaactaccgcccacaattctatttccgtactactgacgtaactggtgttgttaacttaccagaagg

SEQ ID NO: 11 - DNA, 821 bp, Bacteroides ovatus
  ref <308>: DATABASE ACCESSION NUMBER: ATCC 8483
cggtgctatcatcgtttgtgctgcaactgatggtccgatgcctcaaactcgcgaacacattctgttagctcgtcaggtaaacgtacctcgtctggttgtattcttgaacaaatgcgatatggtagacgacgaagaaatgttggaactcgttgaaatggaaatgagagaactcctttcattctatgatttcgatggtgacaatactcctatcatccgtggttctgctcttggcgcattgaacggtgttgaaaaatgggaagacaaagttatggaactgatggatgcagttgataactggattccactgcctccgcgcgatgttgataaaccattcttgatgccggttgaagacgtgttctctatcacaggtcgtggtactgtagcaacaggtcgtatcgaaacaggtgtcatccacgttggtgatgaagtcgaaattcttggtttaggtgaagataagaaatcagttgtaactggtgttgaaatgttccgtaaactgttggatcaaggtgaagctggtgacaacgtaggtcttttgcttcgtggtattgacaagaacgaaatcaaacgtggtatggttctttgtaaaccaggtcagattaaaccgcactctaaattcaaagctgaggtttatatcttgaagaaagaagaaggtggtcgtcacactccgttccacaacaaataccgtcctcagttctacttgcgtactatggactgtacaggtgaaatcactttgccggaaggaacagaaatggtaatgccgggtgataacgtaactattacagttgagttgatttacccagtagcattgaacccgggcttcg

SEQ ID NO: 12 - DNA, 838 bp, Bartonella henselae
  ref <308>: DATABASE ACCESSION NUMBER: ATCC 49882
tggtgcgattttggttgtttcagctgctgatggtccgatgcctcaaacacgtgagcatattcttcttgcccgtcaggttggtgttccagcgattgttgtttttcttaataaggttgatcaggttgatgatgctgagcttttggagcttgttgagcttgaagttcgggagttattgtcgaaatatgattttccaggagacgatattccgatcgttaaaggttctgctttggcagcgcttgaagataaagataaaagcattggtgaagatgcggttcgtcttttgatgagtgaagttgataattatataccgacgcctgaacgtcctgttgatcagccgtttttgatgccaattgaagatgttttttcgatttcgggtcgtggaactgttgtgacgggtcgtgttgagcgtggtgttattaaggttggtgaagaagttgagattatcggcattcgtccaacttctaagacaacagttacaggggttgaaatgttccgcaagcttttagatcaggggcaagcgggtgataatattggagcgctgcttcgtggtattgatcgtgaagggattgagcgtggacaagttttggcgaagcctgcttcggttacacctcatacgagatttaaagcagaggcttacattttgacgaaagatgaaggtggtcgtcatactccatttttcacgaattatcgtcctcagttttatttccgtactacggatgtaacgggaattgttacgcttccagaaggtacagagatggttatgcctggtgataatgttgctatggatgtctctctgattgttccaattgccatggaagaaaaacttcgttttgctatc

SEQ ID NO: 13 - DNA, 839 bp, Bifidobacterium adolescentis
  ref <308>: DATABASE ACCESSION NUMBER: ATCC 15703
tggcgccatccttgttgtggccgccaccgacggcccgatggctcagacccgcgagcacgtgctgctcgctcgtcaggtgggcgtcccgaagatcctcgtcgctctgaacaagtgcgatatggtcgacgacgacgagctcatcgagctcgttgaggaagaggtccgtgacctcctcgacgaaaatggcttcgatcgcgattgcccggtcatccacgtgtccgcttacggcgcactgcacgatgacgctccggaccacgagaagtgggttgagcagatcaagaagctcatggacgccgtcgatgactacatcccgaccccggtccacgatctggacaagccgttcctgatgccgatcgaagatgtcttcaccatctccggccgtggcaccgtggtgaccggccgtgtcgagcgtggtaagctcccggtcaactccaacgtcgagatcgtcggcatccgtccgacccagaccaccaccgtcacctccatcgagaccttccacaagcagatggacgagtgcgaggctggcgacaacaccggtctgctgctccgcggcatcaaccgtgaccaggtcgagcgtggccaggttctggctgctccgggctccgtgaccccgcacaccaagttcgagggcgaagtctacgtgctgaccaaggacgaaggcggccgtcactcgccgttcttctccaactaccgtccgcagttctacttccgtaccaccgacgtcaccggcgtcatcaccctgccggaaggcgttgagatggtgcagccgggcgatcacgctaccttcggcgttgagctgatccagccgatcgctatggaagagggcctgaccttcgcag

SEQ ID NO: 14 - DNA, 839 bp, Bifidobacterium dentium
  ref <308>: DATABASE ACCESSION NUMBER: ATCC 27534
tggcgctatcctcgttgtggccgccaccgacggcccgatggctcagacccgcgagcacgtgctgctcgctcgtcaggtgggcgtgccgcgtatcctcgtcgccctgaacaagtgcgatatggtcgacgacgaagagctcatcgagctcgttgaggaagaggtccgtgacctcctcgacgaaaacggcttcgatcgcgattgcccggtcatccacacctccgcctacggcgcgctgcacgatgacgctccggaccacgacaagtgggttgagtccgtcaaggaactcatgaaggccgtcgacgagtacatcccgaccccgacccacgatctggacaagccgttcctgatgccgatcgaagatgtgttcaccatctccggccgtggcaccgtggttaccggccgtgtcgagcgtggtaagctcccggtcaactccaacgttgagatcgtcggcatccgtccgacccagaccaccaccgtcacctccatcgagaccttccacaagcagatggacgagtgcgaggctggcgacaacaccggtctgctgctccgcggcatcaaccgtgaccaggtcgagcgtggccaggttctggctgctccgggctccgtgaccccgcacaccaagttcgagggcgaagtctacgtgctgaccaaggacgaaggcggccgtcactcgccgttcttctccaactaccgtccgcagttctacttccgtaccaccgacgtcaccggcgtcatcaccctgccggaaggcgttgagatggtgcagccgggcgatcacgctaccttcggcgttgagctgatccagccgatcgctatggaagagggcctgaccttcgcag

SEQ ID NO: 15 - DNA, 838 bp, Brucella abortus
  strain S2308
tggcgcgatcctggtggtttcggctgctgacggcccgatgccgcagacccgcgagcacatcctgcttgcccgtcaggttggcgttccggcgatcgtcgtgttcctcaacaagtgcgaccaggttgacgatgcagaactgctcgaactggttgaactggaagtgcgcgaacttctgtcgaagtacgaattccccggcgacgaaatcccgatcatcaagggctcggctcttgctgctctggaagattcttccaaggaactgggcgaagatgccatccgcaacctgatggacgcggttgacagctacattccgaccccggaacgcccgatcgaccagccgttcctgatgccgatcgaagacgtgttctcgatctccggccgtggtacggttgtgacgggtcgcgttgagcgcggtatcgttaaggtcggtgaagaagttgaaatcgtcggcatcaaggcgacgacgaagaccacggttaccggcgttgaaatgttccgcaagctgctcgaccagggccaggctggcgacaacattggcgcgctgatccgcggcgttggccgtgaagacgttgaacgcggccaggttctctgcaagccgggttctgtgaagccgcacaccaagtttaaggcagaagcctatattctgaccaaggacgaaggtggccgtcatacgccgttcttcaccaactaccgtccgcagttctacttccgtacgacggacgtgacgggtgttgtgacgcttccggctggcacggaaatggtcatgcctggcgataacgtcgccatggacgttaccctgatcgtgccgatcgccatggaagagaagcttcgcttcgctatc

SEQ ID NO: 16 - DNA, 771 bp, Burkholderia cepacia
  strain LSPQ 2217
ggcagcagacggcccgatgccgcaaacgcgtgagcacatcctgctggcgcgtcaggttggcgttccgtacatcatcgtgttcctgaacaagtgcgacatggtggacgacgccgaactgctcgagctggtcgagatggaagttcgcgaactcctgtcgaagtacgacttcccgggcgacgacacgccgatcgtgaagggttcggcgaagctggcgctggaaggcgacacgggcgagctgggcgaagtggcgatcatgagcctggccgacgcgctggacacgtacatcccgacgccggagcgtgcagttgacggcgcgttcctgatgccggtggaagacgtgttctcgatctcgggccgcggtacggtggtgacgggtcgtgtcgagcgcggcatcgtgaaggtcggcgaagaaatcgaaatcgtcggtatcaagccgacggtgaagacgacctgcacgggcgttgaaatgttccgcaagctgctggaccaaggtcaagcaggcgacaacgttggtatcctgctgcgcggcacgaagcgtgaagacgtggagcgtggccaggttctggcgaagccgggttcgatcacgccgcacacgcacttcacggctgaagtgtacgtgctgagcaaggacgaaggcggccgtcacacgccgttcttcaacaactaccgtccgcagttctacttccgtacgacggacgtgacgggctcgatcgagctgccgaaggacaaggaaatggtgatgccgggcgacaacgtgtcgatcacggtgaa

SEQ ID NO: 17 - DNA, 829 bp, Cedecea davisae
  ref <308>: DATABASE ACCESSION NUMBER: ATCC 33431
ggcgctatcctggttgttgctgcgactgatggcccaatgccacagacccgtgagcacatcctgctgggtcgtcaggttggcgttccgtacatcatcgtgttcctgaacaaatgcgacatggttgatgacgaagagctgctggaactggtagaaatggaagttcgtgaacttctgtcccagtacgacttcccgggcgacgatactccaatcgttcgtggttctgctctgaaagcgctggaaggcgaagcagagtgggaagctaaaatcgttgagctggctggctacctggattcttacatccctgagccagagcgtgctatcgataagccgttcctgctgccaatcgaagacgtattctccatctccggccgtggtaccgttgttaccggtcgtgtagagcgcggtatcatcaaagttggtgaagaagttgaaatcgttggtatcaaagatactgcgaaatctacctgtaccggcgttgaaatgttccgcaaactgctggacgaaggccgtgctggtgagaacgttggtgttctgctgcgtggtatcaaacgtgaagaaatcgaacgtggtcaggtactggctaagccaggctctatcaagccacacaccaagttcgaatctgaagtgtacatcctgtccaaagacgaaggcggccgtcatactccgttcttcaaaggctaccgtccacagttctacttccgtacaactgacgtgaccggcaccatcgaactgccagaaggcgttgagatggtaatgcctggcgacaacatcaaaatggttgttaccctgatccacccaatcgcgatggatgacggtctgcgtttcgcaa

SEQ ID NO: 18 - DNA, 824 bp, Cedecea neteri
  ref <308>: DATABASE ACCESSION NUMBER: ATCC 33855
cgctatcctggttgttgctgcgactgacggccctatgcctcagacccgtgagcacatcctgctgggtcgtcaggttggcgttccttacatcatcgtgttcctgaacaaatgtgacatggttgatgacgaagagctgctggagctggttgaaatggaagttcgtgaacttctgtctcagtacgacttcccgggcgatgacactccaatcatccgtggttctgctctgaaagcgctggaaggcgaagcagagtgggaagctaaaatygttgagctggctggcttcctggattcctacatcccagaaccagtacgtgcaatcgayctgccgttcctgctgccaatcgaagacgtattctccatctccggccgtggtaccgttgttaccggtcgtgtagagcgcggtatcgttaaagtgggcgaagaagtagaaatcgttggtatcaaagatactgcgaaatctacctgtaccggcgttgaaatgttccgcaaactgctggacgaaggccgtgctggtgagaacgttggtgttctgctgcgtggtatcaaacgtgaagaaatcgaacgtggtcaggttctggctaagccaggctctatcaagccgcacaccaagttcgaatctgaagtgtacatcctgtccaaagacgaaggcggccgtcatactccgttcttcaaaggctaccgtccacagttctacttccgtacaactgacgtgaccggtaccatcgaactgccagaaggcgtagagatggtaatgccaggcgacaacatcaaaatggttgttaccctgatccacccaatcgcgatggacgacggtctgcgtttcg

SEQ ID NO: 19 - DNA, 827 bp, Cedecea lapagei
  ref <308>: DATABASE ACCESSION NUMBER: ATCC 33432
cgctattctggttgttgctgcaactgacggccctatgcctcagacccgtgagcacatcctgctgggtcgccaggttggcgttccttacatcatcgtgttcctgaacaaatgtgacatggttgatgacgaagagctgctggagctggtagaaatggaagttcgtgaacttctgtctcagtacgacttcccaggcgatgataccccaatcatccgtggttctgctctgaaagcgctggaaggcgaagcagagtgggaagctaaaatcgttgagctggctggcttcctggattcctacatcccagaaccagtacgtgcaatcgacctgccgttcctgctgccaatcgaagacgtattctccatctccggccgtggtaccgttgtkaccggtcgtgtagagcgcggtatcgttaaagtgggcgaagaagtagaaatcgttggtatcaaagatactgcgaaatctacctgtactggcgttgaaatgttccgcaaactgctggacgaaggccgtgctggtgagaacgttggtgttctgctgcgtggtatcaaacgtgaagaaatcgaacgtggtcaggttctggctaagccaggctctatcaagccgcacaccaagttcgaatctgaagtgtacatcctgtccaaagacgaaggcggccgtcatactccgttcttcaarggctaccgtccacagttctacttccgtaccactgacgtgaccggtaccatcgaactgccagaaggcgtagagatggtaatgccaggtgacaacatcaaaatggttgttaccctgatccacccaatcgcgatggacgacggtctgcgtttcgcaa

SEQ ID NO: 20 - DNA, 831 bp, Chlamydia pneumoniae
  strain CWL 029
gcggagctatcctagtcgtttcagctacagacggagctatgccacaaactaaagaacatatcttgctagctcgccaggttggagttccttatatcgttgttttcttgaataaagtagatatgatctctcaagaagatgctgaacttattgaccttgttgagatggaacttagtgagcttcttgaagaaaaaggctacaaaggatgccctattatccgtggttctgctttgaaagctcttgaaggtgatgcaaattatatcgaaaaagttcgagaacttatgcaagctgtggatgacaacatccctacaccagaaagagaaattgataagcctttcttaatgcctatcgaagacgtattctcaatctctggtcgtggtactgtggttacaggaagaatcgagcgtggaatcgttaaagtttctgataaagttcagctcgtgggattaggagagactaaagaaacaatcgttactggagtcgaaatgttcaggaaagaacttcctgaaggtcgtgcaggagaaaacgttggtttactcctcagaggtattggaaagaacgatgttgaaagaggtatggtggtttgtcagcctaacagcgtgaagcctcatacgaaatttaagtcagctgtttacgttcttcagaaagaagaaggcggacgtcataagcctttcttcagcggatacagacctcagttcttcttccgtactacagacgtgacaggagtcgtaactcttcctgaaggaactgaaatggtaatgcctggagataacgttgagcttgatgttgagctcattggaacagttgctcttgaagaaggaatgagatttgcaa

SEQ ID NO: 21 - DNA, 826 bp, Chlamydia psittaci
tggagcgattctcgttgtttccgctactgacggtgcgatgcctcagaccaaagaacatattcttttggcgagacaggttggtgttccttacatcgttgttttccttaacaaaatcgatatgatttctcaagaagatgctgagctcgtagacttagttgaaatggaattgtccgaacttctagaagaaaaaggttataaaggttgcccaattatccgtggttctgctttgaaagccttagaaggtgatgcaagctacgttgaaaaaattcgcgagttaatgcaagcagtggatgataacatccctactccagagcgtgaagttgataagcctttcttaatgcctatcgaagacgtattctctatttctggtcgtggtactgtggtcacaggacgtatcgagcgtggaatcgttaaagtgggtgataaagtacagattgttggtttaagagatactagagagacaattgttaccggtgtggaaatgttcagaaaagaacttccagaaggtcaagcaggggaaaacgttggtttgctcctcagaggtatcggtaagaatgacgttgaacgtggtatggttatctgccaacctaatagcgtgaaatctcacacacaatttaaaggtgctgtctacattctacaaaaagaagagggtggacgtcataaacctttctttaccggatacagacctcagttcttcttccgtacaacagatgttacaggtgttgtaactctcccagaaggtacagagatggttatgccaggcgataacgttgaattcgaagttcaattaattagcccagtagctctagaagaaggtatgagattt

SEQ ID NO: 22 - DNA, 822 bp, Chlamydia trachomatis
  strain LGV 12
ggggctattctagtagtttctgcaacagacggagctatgcctcaaactaaagagcatattcttttggcaagacaagttggggttccttacatcgttgtttttctcaataaaattgacatgatttccgaagaagacgctgaattggtcgacttggttgagatggagttggctgagcttcttgaagagaaaggatacaaagggtgtccaatcatcagaggttctgctctgaaagctttggaaggggatgctgcatacatagagaaagttcgagagctaatgcaagccgtcgatgataatatccctactccagaaagagaaattgacaagcctttcttaatgcccattgaggacgtgttctctatctccggacgaggaactgtagtaactggacgtattgagcgtggaattgttaaagtttccgataaagttcagttggtcggtcttagagatactaaagaaacgattgttactggggttgaaatgttcagaaaagaactcccagaaggtcgtgcaggagagaatgttggattgctcctcagaggtattggtaagaacgatgtggaaagaggaatggttgtttgcttgccaaacagtgttaaacctcatacacggtttaagtgtgctgtttacgttctgcaaaaagaagaaggtggacgacataagcctttcttcacaggatatagacctcaattcttcttccgtacaacagacgttacaggtgtggtaactctgcctgagggagttgagatggtcatgcctggggataacgttgagtttgaagtgcagttgattagccctgtggctttagaagaaggtatgaga

SEQ ID NO: 23 - DNA, 835 bp, Chryseobacterium meningosepticum
  strain CDC B7681
cggagctatcttagtatgtgctgctacagatggtccaatgcctcaaactagagaacacatcctactttgccgtcaggtaaacgtacctagaattgttgtgttcatgaacaaagttgacatggtagatgatccagaattgttagagcttgttgagcttgaacttagagatctattatctacttacgaatatgatggtgataactctccagtaattcaaggttctgctcttggtgctcttaacggtgatgctaagtgggtagctactgtagaagctctaatggatgctgttgatacttggatcgagcaaccagtaagagattctgataagccattccttatgccaatcgaagacgtattctctattacaggtagaggtactgtagcaactggtagaatcgaggctggtgtaatcaacacaggtgatcctgttgacatcgtaggtatgggtgacgagaagttaacttctactattacaggtgttgagatgtttagaaaaatcctagacagaggtgaagctggtgataacgtaggtctattgttgagaggtattgaaaagactgacatcaagagaggtatggttatcgctaagaaagattcagttaagccacacaagaaattcaaagctgaggtttatatcctttctaaagaagaaggtggacgtcacactccattccacaacaaataccgtcctcagttctatgtaagaactactgacgttacaggtgaaatcttcttaccagaaggtgtagaaatggtaatgcctggtgataacttaactatcactgtagaattgttacaaccaatcgctcttaacgagggtcttagattcgcgatc

SEQ ID NO: 24 - DNA, 816 bp, Citrobacter amalonaticus
  ref <308>: DATABASE ACCESSION NUMBER: ATCC 25405
cggcgcgatcctggttgttgctgcgactgacggcccgatgccgcagactcgtgagcacatcctgctgggtcgtcaggtaggcgttccgtacatcatcgtgttcctgaacaaatgcgacatggttgatgacgaagagctgctggaactggtagaaatggaagttcgtgaacttctgtctcagtacgatttcccgggcgacgacaccccgatcgttcgtggttctgctctgaaagcgctggaaggcgacgcagagtgggaagcgaaaatcatcgaactggccggcttcctggattcttacatcccggaaccagagcgtgcgattgacaagccgttcctgctgccgatcgaagacgtattctccatctccggtcgtggtaccgttgttaccggtcgtgtagaacgcggtatcatcaaagtgggcgaagaagttgaaatcgttggtatcaaagagactgccaagtctacctgtactggcgttgaaatgttccgcaaactgctggacgaaggccgtgcgggtgagaacgttggtgttctgctgcgtggtatcaaacgtgaagaaatcgaacgtggtcaggtactggctaagccgggcwccatcaagccgcacaccatgttcgaatcygaagtgtacatcctgtccaaagacgaaggcggccgtcatactccgttcttcaaaggctaccgtccgcagttctacttccgtacaactgacgtgactggcaccatcgaactgccggaaggcgttgagatggtaatgccgggcgacaacatcaaaatggttgttaccctgatccacccgatcgcgatggacgacgg

SEQ ID NO: 25 - DNA, 825 bp, Citrobacter braakii
  ref <308>: DATABASE ACCESSION NUMBER: ATCC 43162
cgcgatcctggttgttgctgcaactgacggcccgatgccgcagactcgtgagcacatcctgctgggtcgycaggtaggcgttccgtacatcatcgtgttcctgaacaaatgcgacatggttgatgacgaagagctgctggaactggtagaaatggaagttcgtgaacttctgtctcagtacgatttcccgggcgacgacacgccgatcgttcgtggttctgctctgaaagcgctggaaggcgawgcagagtgggaagcgaaaatcatcgaactggctggcttcctggattcttacatcccggaaccagagcgtgcgattgacaagccgttcctgctgcctatcgaagacgtattctccatctctggtcgtggtaccgttgttaccggtcgtgtagagcgcggtatcatcaaagttggtgaagaagttgaaatcgttggtatcaargacactgctaagtctacctgtactggcgttgaaatgttccgcaaactgctggacgaaggccgtgctggtgagaacgttggtgttctgctgcgtggtatcaagcgtgaagaaatcgaacgtggtcaggtactggctaagccgggctctatcaagccgcacaccaagttcgaatctgaagtgtacattctgtccaaagacgaaggcggccgtcatactccgttcttcaarggctaccgtccgcagttctacttccgtactactgacgtgactggtaccatcgaactgccggaaggcgttgagatggtaatgccgggcgacaacatcaaaatggttgttaccctgatccacccaatcgcgatggacgacggtctgcgtttcgc

SEQ ID NO: 26 - DNA, 830 bp, Citrobacter koseri
  ref <308>: DATABASE ACCESSION NUMBER: ATCC 27156
cggcgcgatcctggttgttgctgcgactgacggcccgatgccgcagacccgtgagcacatcctgctgggtcgtcaggtaggcgttccgtacatcatcgtgttcctgaacaaatgcgacatggttgatgacgaagagctgctggaactggttgagatggaagtgcgtgaactgctgtctcagtacgatttcccgggcgacgacacgccgatcgttcgtggttctgctctgaaagcgctggaaggcgamgctgagtgggaagcgaaaatcatcgaactggctggctacctggattcttacatcccggaaccagagcgtgcgattgacaagccgttcctgctgccgatcgaagacgtattctccatctccggtcgtggtaccgttgttaccggtcgtgtagagcgcggtatcatcaaagtgggcgaagaagttgaaatygttggtatcaaagagactgcgaagtctacctgtactggcgttgaaatgttccgcaaactgctggacgaaggccgtgctggtgagaacgtaggtgttctgctgcgtggtatcaaacgtgaagaaatcgaacgtggtcaggtactggctaagccgggytccatcaagccgcacaccaagttcgaatctgaagtgtacatyctgtcyaaagatgaaggcggccgtcatactccgttcttcaaaggctaccgtccgcagttctacttccgtacaactgacgtgactggcaccatcgaactgccggaaggcgtagagatggtaatgccgggcgacaacatcaaaatggttgttaccctgatccacccgatcgcgatggacgacggtctgcgtttcgcaa

SEQ ID NO: 27 - DNA, 827 bp, Citrobacter farmeri
  ref <308>: DATABASE ACCESSION NUMBER: ATCC 51112
cgcgatcctggttgttgctgcgactgacggcccgatgccgcagactcgtgagcacatcctgctgggtcgtcaggtaggcgttccgtacatcatcgtgttcctgaacaaatgcgacatggttgatgacgaagagctgctggaactggtagagatggaagttcgtgaactgctgtctcagtacgatttcccgggcgacgacacgccgatcgttcgtggttctgctctgaaagcgctggaaggcgacgcagagtgggaagcgaaaatcatcgaactggcaggcttcctggattcttacatcccggaaccagagcgtgcgattgacaagccgttcctgctgccgatcgaagacgtattctccatctctggtcgtggtaccgttgttaccggtcgtgtagagcgcggtatcatcaaagtgggtgaagaagttgaaatcgttggtatcaaagagactgccaagtctacctgtactggcgttgaaatgttccgcaaactgctggacgaaggccgtgctggtgagaacgtaggtgttctgctgcgtggtatcaaacgtgaagaaatcgaacgtggtcaggtactggctaagccgggcwccatcaagccrcacactatgttcgaatctgaagtgtacattctgtccaaagacgaaggcggccgtcatactccgttcttcaaaggctaccgtccgcagttctacttccgtacgactgacgtgactggcaccatcgaactgccggaaggtgttgagatggttatgccgggcgacaacatcaaaatggttgttaccctgatccacccgatcgcgatggacgacggtctgcgtttcgcaa

SEQ ID NO: 28 - DNA, 797 bp, Citrobacter freundii
  ref <308>: DATABASE ACCESSION NUMBER: ATCC 8090
cctggttgttgctgcgactgacggcccgatgccgcagactcgtgagcacatcctgctgggtcgtcaggtaggcgttccgtacatcatcgtgttcctgaacaaatgcgacatggttgatgacgaagagctgctggaactggtagaaatggaagttcgtgaacttctgtctcagtacgatttcccgggcgacgacactccgatcgttcgtggttctgctctgaaagcgctggaaggcgaagcagagtgggaagcgaaaatcatcgaactggctggcttcctggattcttacatcccagaaccagagcgtgcgattgacaagccgttcctgctgcctatcgaagacgtattctccatctccggtcgtggtaccgttgttaccggtcgtgtagagcgcggtatcatcaaagttggtgaagaagttgaaatcgttggtatcaaagagactgctaagtctacctgtactggcgttgaaatgttccgcaaactgctggacgaaggccgtgctggtgagaacgttggtgttctgctgcgtggtatcaaacgtgaagaaatcgaacgtggtcaggtactggctaagccgggctctatcaagccgcacaccaagttcgaatctgaagtgtacattctgtccaaagacgaaggcggccgtcatactccgttcttcaaaggctaccgtccgcagttctacttccgtactactgacgtgactggtaccatcgaactgccggaaggcgtagagatggtaatgccgggcgacaacatcaaaatggttgttaccctgatccacccaatcgcga

SEQ ID NO: 29 - DNA, 826 bp, Citrobacter sedlakii
  ref <308>: DATABASE ACCESSION NUMBER: ATCC 51115
cggcgcgatcctggttgttgccgcgactgacggcccgatgccgcagacccgtgagcacatcctgctgggtcgtcaggtaggcgttccgtacatcatcgtgttcctgaacaaatgcgacatggttgatgacgaagagctgctggaactggtagagatggaagttcgtgaactgctgtctcagtacgatttcccgggcgacgacacgccgatcgttcgtggttcagctctgaaagcgctggaaggcgacgcagagtgggaagcgaaaatcatcgaactggctggcttcctggattcttacattccggaaccagagcgtgcgattgacaagccgttcctgctgccgatcgaagacgtattctccatctccggtcgtggtaccgttgttaccggtcgtgtagagcgcggtatcatcaaagtgggcgaagaagttgaaatcgttggtatcaaagagactgcgaagtctacctgtactggcgttgaaatgttccgcaaactgctggacgaaggccgtgcgggtgagaacgtaggtgttctgctgcgtggtatcaaacgtgaagaaatcgaacgtggtcaggtactggcgaagccgggcaccatcaagccgcacaccaagttcgaatctgaagtgtatattctgtccaaagatgaaggcggccgtcatactccgttcttcaaaggctaccgtccgcagttctacttccgtacaactgacgtgactggcaccatcgaactgccggaaggcgtagagatggtaatgccgggcgacaacatcaaaatggttgttaccctgatccacccgatcgcgatggacgacggtctgcgtttc

SEQ ID NO: 30 - DNA, 823 bp, Citrobacter werkmanii
  ref <308>: DATABASE ACCESSION NUMBER: ATCC 51114
gcgatcctggttgttgctgcgactgacggcccgatgccgcagactcgtgagcacatcctgctgggtcgtcaggtaggcgttccgtacatcatcgtgttcctgaacaaatgcgacatggttgatgacgaagagctgctggaactggtagaaatggaagttcgtgaacttctgtctcagtacgatttcccgggcgacgacactccgatcgttcgtggttctgctctgaaagcgctggaaggcgaagcagagtgggaagcgaaaatcatcgaactggctggctttctggattcttacatcccggaaccagagcgtgcgattgacaagccgttcctgctrcctatcgaagacgtattctccatctccggtcgtggtaccgttgttaccggtcgtgtagagcgcggtatcatcaaagttggtgaagaagttgaaatcgttggtatcaaagacaccgctaagtctacctgtaccggcgttgaaatgttccgcaaactgctggacgaaggccgtgctggtgagaacgttggtgttctgctgcgtggtatcaaacgtgaagaaatcgaacgtggtcaggtactggctaagccgggctctatcaagccgcacaccaagttcgaatctgaagtgtacatcctgtccaaagacgaaggcggccgtcatactccgttcttcaaaggctaccgtccgcagttctacttccgtactactgacgtgactggtaccatcgaactgccggaaggcgtagagatggtaatgccgggcgacaacatyaaaatggttgttacyctgatccacccgatcgcgatggacgacggtctgcgtttcg

SEQ ID NO: 31 - DNA, 826 bp, Citrobacter youngae
  ref <308>: DATABASE ACCESSION NUMBER: ATCC 29935
ggcgcgatcctggttgttgctgcgactgacggcccgatgccgcagactcgtgagcacatcctgctgggtcgtcaggtaggcgttccgtacatcatcgtgttcctgaacaaatgcgacatggttgatgacgaagagctgctggaactggtagaaatggaagttcgtgaacttctgtctcagtacgatttcccgggcgacgatacgccgatcgttcgtggttctgctctgaaagcgctggaaggcgaagcagagtgggaagcgaaaatcatcgaactggctggcttcctggattcttacatcccggaaccagaacgtgctatcgataagccgttcctgctgccaatcgaagacgtattctccatctccggtcgtggtaccgttgttactggtcgtgtagaacgcggtatcatcaaagttggtgaagaagttgaaatcgttggtatcaaagagactgccaagtctacctgtactggcgttgaaatgttccgcaaactgctggacgaaggccgtgctggtgagaacgttggtgttctgctgcgtggtatcaaacgtgaagaaatcgaacgtggtcaggtactggctaagccgggctctatcaagccgcacaccaagttcgaatctgaagtgtacattctgtccaaagacgaaggcggccgtcatactccgttcttcaaaggctaccgtccgcagttctacttccgtactactgacgtgacgggtaccatcgaactgccggaaggcgtagagatggtaatgccgggcgacaacatcaaaatggttgttaccctgatccacccaatcgcgatggatgacggtctgcgtttcg

SEQ ID NO: 32 - DNA, 841 bp, Clostridium perfringens
  ref <308>: DATABASE ACCESSION NUMBER: ATCC 13124
cggagctatattagtttgttcagcagctgatggtccaatgcctcaaacaagagagcacatcttattatcatcaagagttggagttgaccacatcgtagtattcttaaacaaagcagatatggttgacgacgaagaattattagaattagttgaaatggaagttagagagttattaagcgagtacaacttcccaggagacgayattccagtaatcaarggatcagctttagtagcattagaaaacccaactgacgaagctgcaacagcttgtatcagagagttaatggatgctgtagatagctacatcccaacaccagaaagagcaacagataagccattcttaatgccagtagaggacgtattcacaatcactggtagaggaacagttgcaacaggaagagttgaaagaggagttctacatgtaggagacgaagtagaagtaatcggattaactgaagaaagaagaaaaactgttgtaacaggaatcgaaatgttcagaaagttattagatgaagcacaagctggagataacatcggagcattattaagaggtatccaaagaactgayatcgaaagaggtcaagttttagctcaagttggaacaatcaacccacacaaaaaattcgtaggtcaagtatacgtacttaaaaaagaagaaggtggaagacatactccattcttcgatggatacagaccacaattctacttcagaacaacagacgttacaggatcaatcaaattaccagaaggaatggaaatggttatgcctggagaccacatcgacatggaagttgaattaatcacagaaatcgctatggaygaaggattaagattcgctatc

SEQ ID NO: 33 - DNA, 822 bp, Comamonas acidovorans
  ref <308>: DATABASE ACCESSION NUMBER: ATCC 15668
cggcgccatcctggtgtgctcggccgctgacggccccatgccccagacccgcgagcacatcctgctggcccgtcaggtgggcgtgccctacatcatcgtgttcctgaacaagtgcgacatggtggacgacgaagagctgctggaactggtcgaaatggaagtgcgcgagctgcttgccaagtacgacttccccggcgacgacacccccatcatccgcggctcggccaagctggccctggaaggcgaccagtccgacaagggcgaacctgccatcctgcgcctggctgaagcactggactcctacatccccacgcccgagcgcgctgtggacggcgcctttgcaatgcccgtggaagacgtgttctcgatctctggccgtggcaccgtggtgactggccgtatcgagcgcggcatcatcaaggtcggcgaagaaatcgaaatcgtcggtatccgcgacacccagaagaccatcgtcaccggcgtggaaatgttccgcaagctgctggaccaaggtcaagctggcgacaacgtgggtctgctgctgcgcggcaccaagcgtgaagacgtggaacgcggccaagtgctgtgcaagcccggctccatcaagccccacacccacttcacggctgaggtgtacgtgctgtccaaggacgaaggtggtcgccacactccgttcttcaacaactaccgtccccagttctatttccgtacgaccgacgtgaccggctccatcgagctgcccgccgacaaggaaatggtgatgcctggcgacaacgtgtcgatcaccgtcaagctgatcgcccccatcgccatggaagaagg

SEQ ID NO: 34 - DNA, 702 bp, Corynebacterium bovis
  ref <308>: DATABASE ACCESSION NUMBER: ATCC 7715
gccgcagacccgtgagcacgtcctcctggcccgtcaggtcggtgtgccctacatcctcgtcgccctcaacaagtgcgacatggtcgacgacgaggacctcatcgagctcgtcgagatggaggtccgtgagctcctcgccgagcaggactacgacgaggacgccccgatcatccacatctccgccctcaaggccctcgagggtgacccggagtggacgcagcgcatcgtcgacctcatgaaggcctgcgacgacgccatcccggatccggagcgcgagacggacaagccgttcctcatgccgatcgaggacatcttcacgatcaccggccgcggcaccgtcgtcacgggccgtgtcgagcgtggcatcctcaacgtcaacgaggaggtcgagatcctgggtatctgcgagaactcccagaagacgaccgtcacctccatcgagatgttcaacaagttcctcgacacggccgaggccggcgacaacgccgccctgctgctccgtggcctgaagcgcgaggacgtcgagcgtggccagatcgtggccaagccgggcgcctacacgccgcacaccgagttcgagggctccgtgtacatcctctccaaggacgagggtggccgccacacgccgttcttcgacaactaccgtccgcagttctacttccggacgaccgacgtcaccggcgtcgtcaagctgccggaggg

SEQ ID NO: 35 - DNA, 689 bp, Corynebacterium cervicis
  NCTC 10604
ggctcagacccgcgagcacgttctgcttgctcgccaggttggcgttccgacgatcctggttgccctcaacaaggccgatatggtcgacgatgaggaaatgctggagctcgttgaggaagagtgccgcgacctgctcgagtcccaggacttcgatcgtgacgccccgatcatccaggtttccgcgctgaaggctctcgaaggtgatccgcagtgggttgctaaggtcgaggagctcatggaggcagtcgacaccttcgtgccgactcctgagcgcgacatggacaagccgttcctcatgccgatcgaagacgtcttcaccatcaccggccgtggcaccgttgttaccggtcgtgttgagcgtggcaagctcccgatcaactctgaggttgaaatcctcggtatccgcgaaccgcagaagaccaccgttaccggtatcgagatgttccacaagtccatggatgaagcatgggcaggcgagaactgtggtctcctcctgcgtggcaccaagcgcgatgaggttgagcgcggtcaggtcgttgccgttcccggttcgatcaccccgcacaccaacttcaccggacaggtctacatcctcaagaaggaagaaggcggtcgtcacaacccgttcttctcgaactaccgtccgcagttctacttccgcaccacggacgtgaccggcgtcatcaccc

SEQ ID NO: 36 - DNA, 804 bp, Corynebacterium flavescens
  ref <308>: DATABASE ACCESSION NUMBER: ATCC 10340
ggttgttgctgcaaccgatggtcctatgccgcagacccgcgagcacgttcttctggctcgccaggttggcgttccttacatcctcgttgctcttaacaagtgcgacatggttgatgatgaggaaatcatcgagctcgttgagatggaaatccgcgaactgctcgctgagcaggactacgacgaggatgcccccatcatccacatctccgctctcaaggctcttgagggtgacgagaagtgggtacaggccatcgtcgacctcatgcaggcctgcgatgactccattccggatccggagcgcgagaccgacaagcccttcctcatgcctatcgaggacatcttcaccatcaccggccgcggtaccgttgttaccggccgtgttgagcgtggcgttttgaaggtcaacgaggatgttgagatcatcggcatcaaggagaagtccatctccaccaccgttaccggtatcgaaatgttccgcaagatgatggactacaccgaggctggcgacaactgtggtctgcttctgcgtggtaccaagcgtgaagaggtcgagcgcggccaggttgttatcaagccgggcgcctacaccccccacaccaagttcgagggttccgtctacgtcctcaagaaggaagagggcggccgccacaccccgttcatggacaactaccgtccgcagttctacttccgtaccactgacgtgaccggcgttgttcacctgcctgagggcaccgagatggtcatgcctggcgacaacgttgatatgaccgttgagctcatccagcccgtcgctaggatgagggc

SEQ ID NO: 37 - DNA, 692 bp, Corynebacterium kutscheri
  ref <308>: DATABASE ACCESSION NUMBER: ATCC 15677
tgcctcagacccgtgagcacgttcttcttgctcgccaggttggcgttccttacatcctcgttgctcttaacaagtgcgacatggttgacgatgaggaaatcatcgagctcgttgagatggaagttcgcgagcttcttgctgagcaggagtacgatgaagaggctccaatcatccacatctctgctttgaaggctcttgagggcgacgagaagtggactcaggccatcatcgacctcatgcaggcttgtgatgactccatcccagatccagagcgtgagaccgacaagccattcctcatgcctatcgaggatatcttcaccatcaccggtcgtggcaccgttgttaccggtcgtgttgagcgcggttccttgaaggtgaatgaggacgtcgagatcatcggcatcaaggagaagtccaccactactaccgttaccggtatcgaaatgttccgtaagcttcttgattacaccgaagctggcgataactgtggtctgcttcttcgtggtatcaagcgcgaagacgttgagcgtggtcaggttgttgttaagccaggcgcttacacacctcacaccgagttcgagggctctgtttacgttctttccaaggacgagggcggccgccacaccccattcttcgacaactaccgtccacagttctacttccgcaccactgacgttaccggtgttgtgaag

SEQ ID NO: 38 - DNA, 797 bp, Corynebacterium minutissimum
  ref <308>: DATABASE ACCESSION NUMBER: ATCC 23348
cctggttgttgctgcaaccgatggcccgatgccgcagacccgcgagcacgttcttctggcccgccaggttggcgttccgtacatcctcgttgcactgaacaagtgtgacatggttgacgatgaggaaatcatcgagctcgttgagatggagatccgtgagctgctcgctgagcaggactacgacgaggaagctccgatcgttcacatctccgctctgaaggctcttgagggcgacgagaagtgggcacagtccatcgttgacctgatgcaggcttgcgatgactccatcccggatccggagcgcgagctggacaagccgttcctgatgccgatcgaggacatcttcaccattaccggccgcggtaccgttgttaccggccgtgttgagcgtggctccctgaacgttaacgaggacatcgagatcatcggtatcaaggacaagtccatgtccaccaccgttaccggtatcgagatgttccgcaagatgatggactacaccgaggctggcgacaactgtggtctgcttctgcgtggtaccaagcgtgaagaggttgagcgtggccaggtttgcatcaagccgggcgcttacaccccgcacaccaagttcgagggttccgtctacgtcctgaagaaggaagagggcggccgccacaccccgttcatggacaactaccgtccgcagttctacttccgcaccaccgacgtcaccggtgtcatcaagctgccggagggcaccgagatggtcatgccgggcgacaacgttgagatgtccgtagagctgatccagccggtcgcta

SEQ ID NO: 39 - DNA, 702 bp, Corynebacterium mycetoides
  ref <308>: DATABASE ACCESSION NUMBER: ATCC 21134
gccgcagacccgcgagcacgttcttctggcccgccaggtcggcgtcccctacatcctcgttgcgctgaacaagtgcgacatggttgatgatgaggagatcatcgagctcgtggagatggaggtccgtgagctgctcggcgagcaggactacgacgaggacgcccccatcatccacatctccgctctgaaggctctcgagggcgacgagaagtgggttcagtccgtgctcgacctcatgcaggcgtgcgacgactccatcccggatccggtccgcgagaccgaccgcgacttcctgatgccgatcgaggacatcttcaccatctccggccgcggcaccgtggttaccggtcgtgtggagcgcggcgtgctcaacctcaacgacgaggtcgagatcatcggcatccgcgacaagtcccagaagaccaccgtcacctccatcgagatgttcaacaagctgctcgataccgctgaggcaggcgacaacgcggctctgctgctccgcggtctgaagcgcgaggacgtcgagcgtggccaggttgtcatcaagccgggcgcctacaccccgcacaccaagttcgagggttccgtctacgtcctgtccaaggacgagggcggccgccacaccccgttcttcgacaactaccgtccgcagttctacttccgcaccaccgacgtgaccggtgttgtgaagctgccggaggg

SEQ ID NO: 40 - DNA, 674 bp, Corynebacterium pseudogenitalium
  ref <308>: DATABASE ACCESSION NUMBER: ATCC 33038
gctcgccaggttggcgttccttacatcctcgttgcgctgaacaagtgcgacatggttgatgatgaggaaatcatcgagctcgttgagatggagatccgtgagctgctcgcagagcaggattacgatgaggaagctcctatcgttcacatctccgctctgaaggccctcgagggcgatgacaagtgggtacagtccgtcgttgatctgatggaagcctgcgacaactccatcccggatccggagcgcgctaccgaccagccgttcctgatgcctatcgaggacatcttcaccattaccggccgcggtaccgttgttaccggccgtgttgagcgtggccgtctgaacgtcaacgaggacgttgagatcatcggtatccaggagaagtcccagaccaccaccgttaccggtatcgagatgttccgcaagatgatggactacaccgaggctggcgacaactgtggtctgcttctgcgtggtaccaagcgtgaggacgttgagcgtggccaggttgttatcaagccgggcgcttacaccccgcacaccaagttcgagggctccgtctacgtcctgaagaaggaagagggcggccgccacaccccgttcatgaacaactaccgtccgcagttctacttccgtaccacggacgttaccggtgttgttcacctgccagaggg

SEQ ID NO: 41 - DNA, 694 bp, Corynebacterium renale
  ref <308>: DATABASE ACCESSION NUMBER: ATCC 19412
tgcctcagacccgtgagcacgttctgcttgctcgtcaggtcggcgttccttacatcctcgttgcactgaacaagtgcgacatggtcgacgacgaagaaatcatcgagctcgtcgagatggaaatccgtgaactgctcgcagagcaggactacgatgaggaagctcctatcgttcacatctccgctctgggcgccctgaacggcgagcagaagtgggttgactccatcgtcgaactgatggaagcttgcgacaactccatcccagacccagttcgcgacatcgaccacccattcctgatgcctatcgaggacatcttcaccattaccggtcgcggtaccgttgttaccggccgtgtcgagcgtggccgtctcaacgtcaacgaagaagttgagatcatcggtatcaaggacaagtcccagaagaccaccgtcaccggtatcgagatgttccgcaagatgctggactacaccgaagctggcgacaactgtggtctgctgctccgcggcatcggccgtgaggatgtcgagcgtggccaggttatcatcaagccaggcgcttacacccctcactctgagttcgagggctctgtctacgtcctgtccaaggacgagggtggccgccacaccccattcttcgacaactaccgtccacagttctacttccgcaccaccgacgtgaccggcgttgtgcacct

SEQ ID NO: 42 - DNA, 687 bp, Corynebacterium ulcerans
  NCTC 8665
gccgcagacccgcgagcacgttctgctggctcgccaggttggcgttccktacatcctsgttgcactgaacaagtgcgacatggttgacgatgaggarctcctsgagctcgtcgagatggaggtccgcgagctgctggctgagcaggactacgacgaggaagctccgrtcgttcacatctccgcwctgaacgccctggacggcgacsagaagtgggctvactccatcctcgagctgatgcaggcttgcgacgagtccatcccggatccggagcgcgagaccgacaagccgttcctgatgccgattgaggacatcttcaccattaccggtcgcggyaccgttgttaccggccgtgttgagcgtggcdtcctgaacgtsaacgacgasgttgagatcatgggyatccgggagaagtcccagaagaccaccgtyacckscatcgagatgttcaacaagmtgmtggacwccgcagaggctggcgacaacgctgswctgctgctgcgtggtmtsaagcgtgaggacgttgagcgtggccagatcatcgytaagccgggcgcktacaccccgcacaccgagttcgagggctccgtctacgtcctgtccaaggacgagggcggccgccacaccccgttcttcgacaactaccgtccgcagttctacttccgcaccaccgacgtsaccggtgttgt

SEQ ID NO: 43 - DNA, 778 bp, Corynebacterium urealyticum
  ref <308>: DATABASE ACCESSION NUMBER: ATCC 43042
ctggttgttgctgcaaccgatggcccgatgccgcagacccgtgagcacgttctgctggctcgccaggttggcgttccgtacatcctcgttgcactgaacaagtgcgacatggttgacgatgaggagctcctcgagctcgtcgagatggaggtccgcgagcttctggctgagcaggactacgacgaggaggctccggtcgtcccgatctccgcactgggcgccctggacggcgatcagaagtgggtcgactccatcctcgagctcatgaaggcttgcgacgagtccatcccggacccggagcgcgagaccgacaagccgttcctgatgccggttgaggacatcttcaccattaccggtcgcggcaccgtcgttaccggccgtgttgagcgtggcgtcctgaacctgaacgacgaggtcgagatcctgggcatccgcgagaagtccaccaagaccaccgtcacctccatcgagatgttcaacaagctgctggacaccgcagaggctggcgacaacgctgcactgctgctgcgtggtctgaagcgtgaggacgtcgagcgaggccagatcatcgctaagccgggcgcttacaccccgcacaccgagttcgagggctccgtctacgtcctgtccaaggacgagggcggccgtcacaccccgttcttcgacaactaccgtccgcagttctacttccgtaccaccgacgtcaccggtgtcgttaccctgccagagggcaccgacatggtcatgccgggcgacaacgttgagatgagcgtcaagc

SEQ ID NO: 44 - DNA, 703 bp, Corynebacterium xerosis
  ref <308>: DATABASE ACCESSION NUMBER: ATCC 373
cgcagacccgtgagcacgtcctcctggcccgccaggtcggcgtcccctacatcctcgtcgccctgaacaagtgcgacatggtcgacgatgaggagatcatcgagctcgtggagatggaggtgcgtgagcttctcgccgagcaggactacgacgaggaggccccgatcgtgcacatctccgccctgggcgccctcaatggcgaagagaagtgggtcgactccatcgtcgagctcatgaacgccgtcgacgagaacgttccggacccggtccgcgagaccgacaagccgttcctgatgcccgtcgaggacatcttcaccatcaccggccgcggcaccgtcgccaccggtcgcgtggagcgcggcaccctgaaggtcaacgacgaggtcgagatcctgggcatccaggagaagtcccagaccaccaccgtcaccggcatcgagatgttccgcaagctgctggactccgccgaggccggcgacaactgtggcctgctgctccgcggcatcaagcgcgaggacatcgagcgcggccagatcatcgcgaagccgggcgcctacaccccgcacaccgagttcgagggctccgtctacatcctggccaaggacgagggcggccgccacaccccgttcttcgacaactaccgtccgcagttctacttccgcaccaccgacgtcaccggcgtcgtgaagctgccggagggcac

SEQ ID NO: 45 - DNA, 832 bp, Coxiella burnetii
  strain Nine Mile phase II
ggagcgatattggtggtgagcgcagcggacggcccgatgccgcaaacgcgggaacacattgtattggcgaagcaagtgggtgttccgaacatagtggtttacttgaacaaagcggacatggtggatgacaaagagctgttggaattagtggaaatggaagtgagggatttattgaacagttatgatttccctggggatgagacgccgataatagtggggtcagcgttaaaggcgttagaaggtgacaagagtgaggttggggagccatcgataatcaaattagtggaaacgatggacacgtacttcccgcagccggagcgagcgatagacaaaccgtttttaatgccgatcgaagatgtgttttcgatatcgggccgagggacggtggtgacgggacgcgtagagcgagggatcatcaaagtgggcgacgagatagagattgtggggatcaaggacacgacgaagacgacgtgcacgggcgttgagatgtttcgcaaattattggatgaaggtcaagcgggtgacaacgtaggaattttattgagagggacgaaacgcgaagaagtggagcgtggtcaagtattggcgaaaccgggatcgatcacgccacacaagaaatttgaggcggagatttatgtgttgtcgaaggaagaagggggacgccacacaccgtttttacaaggctatcgaccgcaattttatttccgcacgacggacgtgacgggccagttattgagtttaccggaggggatagagatggtgatgccgggagataacgtgaaagtgacggttgaattgattgcgccggtagcgatggatgaagggctacgat

SEQ ID NO: 46 - DNA, 816 bp, Edwardsiella hoshinae
  ref <308>: DATABASE ACCESSION NUMBER: ATCC 33379
ggcgctatcctggttgttgctgcgactgacggcccgatgccgcagacccgtgagcacatcctgctgggtcgccaggtaggcgttccgtacatcatcgtgttcctgaacaagtgcgacatggttgatgacgaagagctgctggaactggttgagatggaagttcgcgaactgctgtctcagtacgatttcccgggcgacgatacgccggtaatccgcggttctgcgctgaaagcgctggaaggcgaagccgagtgggaagcgaagatcatcgaactggctgaaacgctggactcctacattccggaacctgagcgtgacatcgacaagccgttcctgctgccgatcgaagacgtattctcaatctctggtcgtggtaccgttgttaccggtcgtgtagagcgcggtatcatcaaggtaggcgacgaagttgaaatcgtaggtatcaagccgaccaccaagactacctgtactggcgttgaaatgttccgcaaactgctggacgaaggccgtgctggtgagaacgtaggtgttctgctgcgtggtaccaagcgtgacgaaatcgaacgtggtcaggtactggctaagccgggcaccatcactccgcacaccaagttcgaatcagaagtgtacatcctgagcaaggatgaaggcggccgtcatactccgttcttcaaaggttaccgtccgcagttctacttccgtaccactgacgtgactggcaccatcgaactgccggaaggcgtagagatggtaatgccgggcgacaacatcaagatggttgttaccctgatccacccgatcgccatggacgatggt

SEQ ID NO: 47 - DNA, 821 bp, Edwardsiella tarda
  ref <308>: DATABASE ACCESSION NUMBER: ATCC 15947
ggcgcgatcctggttgttgctgcgactgacggcccgatgccgcagacccgtgagcacatcctgttgggtcgccaggtaggcgttccgtacatcatcgtgttcctgaacaagtgcgacatggttgatgacgaagagctgctggaactggttgagatggaagttcgcgaactgctgtctcagtacgacttcccgggcgacgacacgccggtaatccgcggttctgcgctgaaagcgctggaaggcgaagccgagtgggaagcgaagatcatcgaactggctgaaactctggactcctacatcccggaacctgagcgtgacatcgacaagccgttcctgctgccgatcgaagacgtattctctatctctggccgtggtaccgttgttaccggtcgtgtagagcgcggtatcatcaaggtaggcgacgaagttgaaatcgttggtatcaagccgaccaccaagaccacctgtactggcgttgaaatgttccgcaaactgctggacgaaggccgtgctggtgagaacgttggtgttctgctgcgtggtactaagcgtgacgaaatcgaacgtggtcaggtactggctaagccgggcaccatcactccgcacaccaagttcgaatctgaagtgtacatcctgagcaaggatgaaggcggccgtcatactccgttcttcaaaggctaccgtccgcagttctacttccgtactactgacgtgactggtaccatcgaactgccggaaggcgtagagatggtaatgccgggcgacaacatcaagatggttgttaccctgatccacccgatcgccatggacgatggtctgcg

SEQ ID NO: 48 - DNA, 830 bp, Eikenella corrodens
  ref <308>: DATABASE ACCESSION NUMBER: ATCC 23834
cggtgccatcctggtggtatccgctgctgacggccccatgcctcagactcgcgaacacatcctgttggctcgtcaggtaggtgtaccctacatcctcgtattcatgaacaaatgcgacatggtagatgatgccgagctgcttgagttggttgagatggaaatccgcgacctgctctccagctatgacttccctggtgacgactgcccgatcgtacaaggttccgctctcaaagccctcgaaggcgatgccggttacaaagaaaaaatcttcgaactagctgctgctttggatagctacatccccactcctcaacgtgctgtagacaaacccttcctgttgccgatcgaagacgtattctctatctccggccgtggtaccgtagtaaccggtcgtgtagagcgcggcatcatcaaagtaggtgaagagatcgaaatcgttggtctgaagcccactcagaaaactacctgtactggcgtggaaatgttccgcaaactgctggacgaaggtcaggccggtgacaacgtaggcgtactgctgcgcggtaccaaacgtgaagaagttgagcgtggtcaagtattggctaaacccggcaccatcactccgcacaccaagttcaaagccgaagtatacgtattgagcaaagaagaaggtggtcgtcacaccccgttctttgccaactaccgtccacagttctacttccgtactactgacgtaaccggtgctgtagagctggagcctggtgtagaaatggttatgcctggtgagaacgtaaccatcaccgtagaactgattgctccgattgctatggaagaaggtctgcgctttgcga

SEQ ID NO: 49 - DNA, 808 bp, Enterobacter aerogenes
  ref <308>: DATABASE ACCESSION NUMBER: ATCC 13048
ggcgcgatcctggttgttgctgcgactgacggcccgatgccgcagactcgtgagcacatcctgctgggtcgtcaggtaggcgttccgtacatcatcgtgttcctgaacaaatgcgacatggttgatgacgaagagctgctggaactggttgagatggaagttcgtgaactgctgtctcagtacgatttcccgggcgacgacactccgatcgttcgtggttctgctctgaaagcgctggaaggcgacgcagagtgggaagcgaaaatcatcgaactggctggcttcctggattcttacatcccrgaaccagagcgtgcgattgacaagccgttcctgctgccgatcgaagacgtattctccatctccggtcgtggtaccgttgttaccggtcgtgtagagcgcggtatcatcaaagttggtgaagaagttgaaatcgttggtatcaaagacaccgcgaaaaccacctgtactggcgttgaaatgttccgcaaactgctggacgaaggccgtgctggtgagaacgtaggygttctgctgcgtggtatcaaacgtgaagaaatcgaacgtggtcaggtactggctaagccgggcagcatcaagccgcacaccaagttcgaatctgaagtgtacatcctgtccaaagacgaaggcggccgtcatactccgttcttcaaaggctaccgtccgcagttctacttccgtactactgacgtgactggtaccatcgaactgccggaaggcgtagagrtggtaatgccgggcgacaacatcaaaatggttgttaccctgatccacccgatcgcgatgg

SEQ ID NO: 50 - DNA, 828 bp, Enterobacter agglomerans
  ref <308>: DATABASE ACCESSION NUMBER: ATCC 27989
cggcgcgatcctggttgttgctgcgactgacggcccgatgccgcagactcgtgagcacatcctgctgggtcgtcaggtaggcgttccgtacatcatcgtgttcctgaacaaatgtgacatggttgatgacgaagagctgctggaactggttgaaatggaagttcgtgaacttctgtctcagtacgatttcccgggcgacgatactccgatcgttcgtggttctgctctgaaagcgctggaaggcgamgcwgagtgggaagcgaaaatcatcgarctggctggccacctggatacctatatcccggaaccagagcgtgcgattgacaagccgttcctgctgccgatcgaagacgtattctccatctccggtcgcggtaccgttgttaccggtcgtgtagagcgcggtatcatyaaagtgggcgaagaagttgaaatcgttggtatcaaagatacygcgaaatcaacctgtaccggcgttgaaatgttccgcaaactgctggacgaaggccgtgctggtgagaacgttggtgttctgctgcgtggtatcaaacgtgaagaaatcgaacgtggtcaggtactggctaagccgggcaccatcaagccgcacaccaagttcgaatctgaagtgtacattctgtccaaagatgaaggcggtcgtcacactccgttcttcaaaggctaccgtccscagttctacttccgtacaactgacgtgactggcaccatcgaactgccggaaggcgtagagatggtaatgccgggcgacaacatcaaaatggttgttaccctgatccacccgatcgcgatggacgacggtctgcgttcgca

SEQ ID NO: 51 - DNA, 825 bp, Enterobacter amnigenus
  ref <308>: DATABASE ACCESSION NUMBER: ATCC 33072
tggcgcgatcctggttgttgctgcaactgatggccctatgccacagacgcgtgagcacatcctgctgggtcgtcaggtaggcgttccttacatcatcgtgttcctgaacaaatgcgacatggttgatgacgaagagctgctggaactggtagaaatggaagttcgtgaacttctgtctcagtacgatttcccaggtgatgacactccaatcatccgtggttctgctctgaaagcgctggaaggcgaagcagagtgggaagctaaaatcgttgagctggctggctacctggattcttacatcccggaaccagaacgtgctatcgataagccattcctgctgccaatcgaagacgtattctctatctccggccgtggtactgttgtaaccggtcgtgtagagcgcggtatcgttaaagttggcgaagaagttgaaatcgttggtatcaaagagactgctaagtctacctgtactggcgttgaaatgttccgcaaactgctggacgaaggccgtgctggtgagaacgttggtgttctgctgcgtggtatcaaacgtgaagaaatcgaacgtggtcaggtactggctaagccaggctcaatcaagccgcacaccaaattcgaatctgaagtttatattctgtccaaagatgaaggcggccgtcatactccgttcttcaaaggctaccgtccacagttctacttccgtacaactgacgtgaccggcaccatcgaactgccagaaggcgtagagatggtaatgccaggcgacaacattcagatggttgttaccctgatccacccaatcgcgatggatgacggtctgcgttt

SEQ ID NO: 52 - DNA, 822 bp, Enterobacter asburiae
  ref <308>: DATABASE ACCESSION NUMBER: ATCC 35953
cggcgcgatcctggttgttgctgcgactgacggcccaatgcctcagactcgtgagcacatcctgctgggtcgtcaggtaggcgttcctttcatcatcgtgttcctgaacaaatgcgacatggttgatgacgaagagctgctggaactggtagagatggaagttcgtgaactgctgtctcagtacgatttcccgggcgacgatactccaatcgttcgtggttctgctctgaaagcgctggaaggcgacgcagagtgggaagcgaaaatcatcgaactggctggcttcctggattcttacatcccagaaccagagcgtgcgattgacaagccattcctgctgccaatcgaagacgtattctccatctccggtcgtggtaccgttgttaccggtcgtgtagagcgcggtatcatcaaagttggcgaagaagttgaaatcgttggtatcaaagagactgctaagtctacctgtactggcgttgaaatgttccgcaaactgctggacgaaggccgtgctggtgagaacgttggtgttctgctgcgtggtatcaaacgtgaagaaatcgaacgtggtcaggttctggcgaagccaggctcaatcaagccacacaccaagttcgaatctgaagtgtacatcctgtccaaagacgaaggcggccgtcatactccgttcttcaaaggctaccgtccacagttctacttccgtacaactgacgtgaccggtaccatcgaactgccagaaggcgttgagatggtaatgccaggcgacaacatcaagatggttgtgactctgatccacccaatcgcgatggacgacggtctgcg

SEQ ID NO: 53 - DNA, 826 bp, Enterobacter cancerogenus
  ref <308>: DATABASE ACCESSION NUMBER: ATCC 35317
cggcgcgatcctggttgttgctgcgactgacggcccaatgcctcagactcgtgagcacatcctgctgggtcgtcaggtaggcgttccttacatcatcgtgttcctgaacaagtgcgacatggttgatgacgaagagctgctggaactggtagaaatggaagttcgtgaactgctgtctcagtacgatttcccaggcgacgacactccaatcgttcgtggttccgcgctgaaagcgctggaaggcgaagctgagtgggaagcaaaaatcatcgaactggctggcttcctggattcttacatcccagaaccagagcgtgcgattgacaagccattcctgctgccaatcgaagacgtattctccatctccggtcgtggtaccgttgttaccggtcgtgtagagcgcggtatcatcaaagttggtgaagaagttgaaatcgttggtatcaaagatactgckaaatctacctgtactggcgttgaaatgttccgcaaactgctggacgaaggccgtgctggtgagaacgttggtgttctgctgcgtggtatcaaacgcgaagaaatcgaacgtggtcaggttctggcgaagccaggctcaatcaagccacacaccaagttcgaatctgaagtgtacatcctgtccaaagacgaaggcggccgtcatactccgttcttcaaaggctaccgtccacagttctacttccgtacaactgacgtgaccggtaccatcgaactgccagaaggcgtagagatggtaatgccaggcgacaacatcaagatggttgtgacgctgatccacccaatcgcgatggacgacggtctgcgtttc

SEQ ID NO: 54 - DNA, 806 bp, Enterobacter cloacae
  ref <308>: DATABASE ACCESSION NUMBER: ATCC 13047
gatcctggtagtagctgcgactgacggcccaatgcctcagactcgtgagcacatcctgctgggtcgtcaggtaggcgttccttacatcatcgtgttcctgaacaaatgcgacatggttgatgacgaagagctgctggaactggtagagatggaagttcgtgaactgctgtctcagtacgatttcccaggcgacgataccccaatcgttcgtggttctgctctgaaagcgctggaaggcgacgcagagtgggaagmgaaaatcatcgaactggctggctacctggattcttacatcccagaaccagagcgtgcgattgayaagccattcctgctgccaatcgaagacgtattctccatctccggtcgtggtaccgttgttaccggtcgtgtagagcgcggtatcatcaaagtgggtgaagaagttgaaatcgttggtatcaaagagactgcgaagtctacctgtactggcgttgaaatgttccgcaaactgctggacgaaggccgtgctggtgagaacgttggtgttctgctgcgtggtatcaaacgtgaagaaatcgaacgtggtcaggttctggcgaagccaggctcaatcaagccacacaccaagttcgaatctgaagtgtacatcctgtccaaagacgaaggcggccgtcatactccgttcttcaaaggctaccgtccacagttctacttccgtacaactgacgtgaccggtaccatcgaactgccagaaggcgtagaggtggtaatgccaggcgacaacatcaagatggttgtgactctgatccacccaatcgcgatggacg

SEQ ID NO: 55 - DNA, 826 bp, Enterobacter gergoviae
  ref <308>: DATABASE ACCESSION NUMBER: ATCC 33028
cggcgcgatcctggttgttgctgcgactgacggcccgatgccgcagacccgtgagcacatcctgctgggtcgtcaggtaggcgttccgtacatcatcgtgttcctgaacaagtgcgacatggttgatgacgaagagctgctggaactggtagagatggaagttcgtgaactgctgtctcagtacgatttcccgggcgacgacaccccgatcgttcgcggttctgcgctgaaagcgctggaaggcgacgcagagtgggaagcgaaaatcatcgaactggctggccacctggatacctayatcccggaaccagagcgtgcgattgacaagccgttcctgctgccgatcgaagacgtattctccatttccggtcgtggtaccgttgttaccggtcgtgtagagcgcggtatcatcaaggttggtgaagaagttgaaatcgttggtatcaaagacaccgcgaaaaccacctgtactggcgttgaaatgttccgcaaactgctggacgaaggccgtgctggtgagaacgtcggcgttctgctgcgtggtatcaagcgtgaagaaatcgaacgtggtcaggtactggctaagccgggctccatcaagccgcacaccaagttcgaatctgaagtgtacatcctgtccaaagacgaaggcggccgtcacactccgttcttcaaaggctaccgtccgcagttctacttccgtacaactgacgtgactggcaccatcgaactgccggaaggcgtagagatggtaatgccgggcgacaacatcaagatggttgttaccctgatccacccgatcgcgatggacgacggtctgcgtttc

SEQ ID NO: 56 - DNA, 829 bp, Enterobacter hormaechei
  ref <308>: DATABASE ACCESSION NUMBER: ATCC 49162
ggcgcgatcctggttgttgctgcgactgacggccctatgcctcagacccgtgagcacatcctgctgggtcgtcaggtaggcgttccttacatcatcgtgttcctgaacaaatgcgacatggttgatgacgaagagctgctggaactggtagagatggaagttcgtgaactgctgtctcagtacgatttcccaggcgacgacaccccaatcgttcgtggttccgcgctgaaagcgctggaaggcgamgcagagtgggaagmgaaaatcatcgarctggctggcttcctggattcttacatcccagaaccagagcgtgcgattgacaagccattcctgctgccaatcgaagacgtattctccatctccggtcgtggtaccgttgttaccggtcgtgtwgagcgcggtatcatcaaagtaggtgaagaagttgaaatcgttggtatcaaagagactgcgaagtctacctgtactggcgttgaaatgttccgcaaactgctggacgaaggccgtgctggtgagaacgttggtgttctgctgcgtggtatcaaacgtgaagaaatcgaacgtggtcaggttctggcgaagccaggctcaatcaagccacacaccaagttcgaatctgaagtgtacattctgtccaaagacgaaggcggccgtcatactccgttcttcaaaggctaccgtccacagttctacttccgtacaactgacgtgaccggtaccatcgaactgccagaaggcgtagagatggtaatgccaggcgacaacatcaagatggttgtgacgctgatccacccaatcgcgatggacgacggtctgcgtttcgcaa

SEQ ID NO: 57 - DNA, 831 bp, Enterobacter sakazakii
  ref <308>: DATABASE ACCESSION NUMBER: ATCC 29544
ggcgctatcctggttgttgctgcgactgacggcccgatgccgcagacccgtgagcacatcctgctgggtcgtcaggtaggcgttccgtacatcatcgtgttcctgaacaaatgcgacatggttgatgacgaagagctgctggaactggttgagatggaagtgcgcgagctgctgtctcagtacgacttcccgggcgacgacaccccgatcgttcgtggttctgctctgaaagcgctggaaggcgacgctgagtgggaagcgaaaatcatcgagctggcaggtcacctggattcctacatcccggaaccggagcgtgcgattgacaagccgttcctgctgccgatcgaagacgtattctccatctcyggtcgtggtaccgttgttaccggtcgtgtagagcgcggtatcatcaaggttggtgaagaagttgaaatcgtgggcatcaaagacaccgcgaaatccacctgtaccggcgttgaaatgttccgcaaactgctggacgaaggccgtgcgggcgagaacgtaggtgttctgctgcgtggtatcaaacgtgaagaaatcgaacgtggtcaggtactggctaagccgggctccatcaagccgcacaccaagttcgaatctgaagtgtacattctgtccaaagatgaaggcggccgtcacactccgttcttcaaaggctaccgtccgcagttctacttccgtacractgacgtgactggcaccatcgaactgccggaaggcgttgagatggtaatgccgggcgacaacatcaaaatggttgttaccctgatccacccgatcgcgatggacgacggtctgcgtttcgcaatc

SEQ ID NO: 58 - DNA, 835 bp, Enterococcus casseliflavus
  ref <308>: DATABASE ACCESSION NUMBER: ATCC 25788
cggcgcgatcttagtagtatctgctgctgatggtcctatgcctcaaacacgtgaacacatcttgttatcacgtaacgttggtgtaccatacatcgttgttttcttaaacaaaatggatatggttgatgacgaagaattactagaattagttgaaatggaagttcgtgacttattgtcagaatatgacttcccaggcgacgatgttcctgtaatcgctggttctgctttgaaagctcytgaaggcgatgcttcatacgaagaaaaaatcatggaattaatggctgcagttgacgaatacgttccaactccagaacgtgacactgacaaaccattcatgatgccagtcgaagacgtattctcaatcactggacgtggtactgttgctacaggccgtgttgaacgtggacaagttcgcgttggtgacgaagttgaaatcgttggtattgctgaagaaactgctaaaacaactgtaactggtgttgaaatgttccgtaaattgttagactatgctgaagcaggggataacattggtgcattgctacgtggtgttgctcgtgaagacatccaacgtggacaagtattggctaaagctggtacaatcacacctcatacaaaatttaaagctgaagtttacgttttaacaaaagaagaaggtggacgtcacacaccattcttcactaactaccgtcctcagttctacttccgtacaactgacgtaactggtgttgttgaattaccagaaggaactgaaatggttatgcctggtgataacgtaacaatcgacgttgaattgatccacccaatcgctatcgaagacggaactcgtttctcaatt

SEQ ID NO: 59 - DNA, 826 bp, Enterococcus cecorum
  ref <308>: DATABASE ACCESSION NUMBER: ATCC 43198
ggtgctatcttagtagtatctgctgctgatggtcctatgccacaaactcgtgaacacattcttttatcacgtaacgttggtgttccatacatcgttgttttcttaaacaaagttgatatggttgacgacgaagaattattagaattagttgaaatggaagtacgtgacttattaactgaatacgacttcccaggagacgatgttcctgtaatcgctggttctgcattaaaagctttagaaggcgacccatcttacgaagaaaaaatcttagaattaatggctgcagttgacgaatacatcccaactccagaacgtgacaacgataaaccattcatgatgccagtcgaagacgtattttcaatcactggtcgtggtactgttgctacaggtcgtgttgaacgtggacaagtacgtgttggtgacgaagttgaaatagttggtatccatgatgaaatttctaaaacaacagttactggtgttgaaatgttccgtaaattattagattacgctgaagctggagacaacatcggtgcattattacgtggtgtggctcgtgaagatatccaacgtggtcaagtattagctaaaccaggttcaatcactccacatacaaaattcactgctgaagtgtacgttttaactaaagaagaaggtggacgtcatactccattcttcactaactaccgtccacaattctacttccgtacaactgacgttacaggtgtagttaacttaccagaaggtactgaaatggttatgcctggtgataacgtaactatggaagttgaattaatccacccaatcgctatcgaagacggaactcgtt

SEQ ID NO: 60 - DNA, 835 bp, Enterococcus dispar
  ref <308>: DATABASE ACCESSION NUMBER: ATCC 51266
cggcgcgatcttggtagtatctgctgctgatggtcctatgcctcaaactcgtgaacacatcctattgtcacgtaacgttggtgttccttacatcgtcgttttcttgaacaaaatggacatggttgatgacgaagaattattagaattagttgaaatggaagttcgtgacttattgtcagaatacgacttcccaggcgacgacactccagttatcgcaggttcagctttgaaagccttagaaggcgacgcttcatatgaagaaaaaatcttagaattaatggctgcagttgacgaatatatcccaactccagttcgtgatactgacaaaccattcatgatgccagtcgaagatgtattctcaatcactggtcgtggtactgttgcaactggtcgtgttgaacgtggacaagttcgcgttggtgacgaagttgaaatcgtaggtatcgctgaagaaactgctaaaactactgtaacaggtgttgaaatgttccgtaaattgttggattacgctgaagctggcgacaacattggtgcattattacgtggtgtggctcgtgaagatatccaacgtggtcaagtattatcaaaaccaggttcaatcactccacatacaaaatttgcggcagaagtttacgttttaactaaagaagaaggtggacgtcatactccattcttcactaactaccgcccacaattctacttccgtacaactgacgtaacaggtgttgttgaattaccagaaggtactgaaatggttatgcctggcgataacgttactatggacgttgaattaatccacccaatcgcgatcgaagacggtactcgtttctcaatc

SEQ ID NO: 61 - DNA, 835 bp, Enterococcus durans
  ref <308>: DATABASE ACCESSION NUMBER: ATCC 19432
cggagctatcttagtagtttctgctgctgatggccctatgcctcaaactcgtgaacatatcctattatctcgtcaagttggtgttccttacatcgtygtattcttgaacaaagtagatatggtcgatgacgaagaattactagaattagttgaaatggaagttcgtgacttattaacagaatacgaattccctggtgacgatgttcctgtaatcgctggttcagctttgaaagctttagaaggcgacgcttcatacgaagaaaaaatccttgaattaatggctgcagttgacgaatatatcccaactccagaacgtgacaacgacaaaccattcatgatgccagttgaagatgtattctcratcactggtcgtggtactgttgctacaggtcgtgttgaacgtggacaagttcgcgttggtgacgttgtagatatcgttggtatcgcagaagaaacagctcaaacaacagttactggtgttgaaatgttccgtaaattattagrctacgctgaagctggagacaacattggtgctttactacgtggtgttgcacgtgaagacatccaacgtggacaagttttagctaaaccaggtacaatcackcctcatacaaaattctctgcagaagtatacgtgttgactaaagaagaaggtggacgtcatactccattcttcactaactaccgtccacaattctacttccgtacaactgacgtaacaggtgttgttgaattaccagaaggaactgaaatggttatgcctggcgacaacgtaacaatggaagttgaattaatccacccaatcgctatcgaaaatggtactaaattctcaatc

SEQ ID NO: 62 - DNA, 680 bp, Enterococcus faecalis
  strain R610
agtagtttctgctgctgatggtcctatgcctcaaacacgtgaacatatcttattatcacgtaacgttggtgtaccatacatcgttgtattcttaaacaaaatggatatggttgatgacgaagaattattagaattagtagaaatggaagttcgtgacttattatcagaatacgatttcccaggcgatgatgttccagttatcgcaggttctgctttgaaagctttagaaggcgacgagtcttatgaagaaaaaatcttagaattaatggctgcagttgacgaatatatcccaactccagaacgtgatactgacaaaccattcatgatgccagtcgaagacgtattctcaatcactggacgtggtactgttgctacaggccgtgttgaacgtggtgaagttcgcgttggtgacgaagttgaaatcgttggtattaaagacgaaacatctaaaacaactgttacaggtgttgaaatgttccgtaaattattagactacgctgaagcaggcgacaacatcggtgctttattacgtggtgtagcacgtgaagatatcgaacgtggacaagtattagctaaaccagctacaatcactccacacacaaaattcaaagctgaagtatacgtattatcaaaagaagaaggcggacgtcacactccattcttcactaactaccgtcctc

SEQ ID NO: 63 - DNA, 680 bp, Enterococcus faecalis; identical to SEQ ID NO: 62
  strain R487

SEQ ID NO: 64 - DNA, 685 bp, Enterococcus faecium
  strain R482
agtagtttctgctgctgacggcccaatgcctcaaactcgtgaacacatcctattgtctcgtcaagttggtgttccttacatcgttgtattcttgaacaaagtagacatggttgatgacgaagaattactagaattagttgaaatggaagttcgtgacctattaacagaatacgaattccctggtgacgatgttcctgtagttgctggatcagctttgaaagctctagaaggcgacgcttcatacgaagaaaaaattcttgaattaatggctgcagttgacgaatacatcccaactccagaacgtgacaacgacaaaccattcatgatgccagttgaagacgtgttctcaattactggacgtggtactgttgctacaggtcgtgttgaacgtggacaagttcgcgttggtgacgaagttgaagttgttggtattgctgaagaaacttcaaaaacaacagttactggtgttgaaatgttccgtaaattgttagactacgctgaagctggagacaacattggtgctttactacgtggtgttgcacgtgaagacatccaacgtggacaagttttagctaaaccaggtacaatcacacctcatacaaaattctctgcagaagtatacgtgttgacaaaagaagaaggtggacgtcatactccattcttcactaactaccgtcctcaattt

SEQ ID NO: 65 - DNA, 825 bp, Enterococcus flavescens
  ref <308>: DATABASE ACCESSION NUMBER: ATCC 49996
cggcgcgatcttagtagtatctgctgctgatggtcctaygcctcaaacacgtgaacacatcttgttatcacgtaacgttggtgtaccatacatcgttgttttcttaaacaaaatggatatggttgatgacgaagaattactagaattagttgaaatggaagttcgtgacttattgtcagaatatgacttcccaggcgacgatgttcctgtaatcgctggttctgctttgaaagctcttgaaggcgatgcttcatacgaagaaaaaatcatggaattaatggctgcagttgacgaatacgttccaactccagaacgtgacactgacaaaccattcatgatgccagtcgaagacgtattctcaatcactggacgtggtactgttgctacaggccgtgttgaacgtggacaagttcgcgttggtgacgaagttgaaatcgttggtattgctgaagaaactgctaaaacaactgtaactggtgttgaaatgttccgtaaattgttagactatgctgaagcaggggataacattggtgcattgctacgtggggttgctcgtgaagacatccaacgtggacaagtattagctaaagctggtacaatcacacctcatacaaaatttaaagctgaagtttacgttttaacaaaagaagaaggtggacgtcacactccattcttcactaactaccgtcctcagttctacttccgtacaactgacgtaactggtgttgttgaattaccagaaggaactgaaatggttatgcctggtgataamgtaacaatcgacgttgaattgatccacccaatcgctatcgaagacggaactcg

SEQ ID NO: 66 - DNA, 636 bp, Enterococcus gallinarum
  strain R420
tcctatgcctcaaactcgtgaacacatcttgttatcacgtaacgttggcgtaccatacatcgttgttttcttgaacaaaatggatatggttgatgacgaagaattgctagaattagttgaaatggaagttcgtgacctattgtctgagtatgacttcccaggcgacgatgttcctgtaatcgccggttctgctttgaaagctcttgaaggagatccttcatacgaagaaaaaatcatggaattgatggctgcagttgacgaatacgttccaactccagaacgtgatactgacaaaccattcatgatgccagtcgaagacgtattctcaatcactggacgtggtactgttgctacaggccgtgttgaacgtggacaagttcgcgttggtgatgaagtagaaatcgttggtattgctgacgaaactgctaaaacaactgtaacaggtgttgaaatgttccgtaaattgttagactatgctgaagcaggggataacattggtgcattgctacgtggggttgctcgtgaagacatccaacgtggacaagtattggctaaagctggtacaatcacacctcatacaaaattcaaagctgaagtttatgttttgacaaaagaagaaggtggacgtcacactcc

SEQ ID NO: 67 - DNA, 835 bp, Enterococcus hirae
  ref <308>: DATABASE ACCESSION NUMBER: ATCC 8043
cggagctatcttagtagtttctgctgctgatggtcctatgcctcaaactcgtgaacatatcctaytatctcgtcaagttggtgttccatacatcgttgtattcttgaacaaagtagatatggttgacgacgaagaattactagaattagttgaaatggaagttcgtgacttattaacagaatacgaattccctggtgacgatgttcctgtagttgctggtycagctttgaaagctttagaaggcgacgcttcatacgaagaaaaaatccttgaattgatggctgcagttgacgaatatatcccaactccagaacgtgacaacgacaaaccattcatgatgccagtcgaagacgtattctcaatcactggtcgtggtactgttgctacaggtcgtgttgaacgtggacaagttcgcgttggtgacgttgtagatatcgttggtatcgcagaagaaacagctcaaacaacagttactggtgttgaaatgttccgtaaattattagactacgctgaagctggagacaacattggtgctttactacgtggtgttgcacgtgaagacatccaacgtggacaagttttagctaaaccaggtacaatcacacctcatacaaaattctctgcagaagtatacgtgttgacaaaagaagaaggtggacgtcatactccattcttcactaactaccgtccacaattctacttccgtacractgacgtaacaggtgttgttgaattaccagaaggaactgaaatggttatgcctggcgacaacgtaacaatggaagttgaattaatccacccaatcgctatcgaaaacggtactaaattctcaatc

SEQ ID NO: 68 - DNA, 835 bp, Enterococcus mundtii
  ref <308>: DATABASE ACCESSION NUMBER: ATCC 43186
cggagcaatcttagttgtttctgctgctgacggccctatgcctcaaactcgtgaacacatcctattatctcgtcaagttggtgtaccatacatcgttgtattcttgaacaaagtagatatggttgatgacgaagaattacttgaattagttgaaatggaagttcgtgacctattaacagaatacgaattccctggtgacgatgttcctgtaatcgctggttcagctttaagagctttagaaggcgacgctkcatacgaagaaaaaattcttgaattgatggctgcagttgacgaatatatcccaactccagaacgtgataacgacaaaccattcatgatgccagttgaggacgtattctcaatcactggtcgtggtactgttgctacaggacgtgttgaacgtggacaagytcgtgttggtgacgttatcgatatcgttggtatcgcagaagaaacagctcaaacaactgtaactggtgttgaaatgttccgtaaattattagactacgctgaagcaggcgataacattggtgcgttactacgtggtgtttcacgtgaagacatccaacgtggtcaagttttagctaaaccaggtacaatcacacctcatacaaaattctctgcagaagtatacgtgttgactaaagaagaaggtggacgtcatactccattcttcactaactaccgtccacaattctacttcygtacgactgacgtaactrgtgttgtygaattaccagaaggaactgaaatggttatgcctggcgacaacgtaacaatggaagttgaattaatccacccaatcgctatcgaaaatggtactaaattctcaatc

SEQ ID NO: 69 - DNA, 836 bp, Enterococcus pseudoavium
  ref <308>: DATABASE ACCESSION NUMBER: ATCC 49372
cggagctatcttagtagtatctgctgctgatggccctatgcctcaaacacgtgaacacatcttgttatctcgtaacgttggtgttccttacatcgytgtattcttaaacaaaatggatatggttgatgacgaagaattactagaattagttgaaatggaagttcgtgacttattgtcagaatacgatttcccaggcgacgacactcyagttatcgctggttcagcyttgaaagctttagaaggcgacccttcatacraagaaaaaatcttagaattaatgsctgctgttgacgaatacatcccaacaccagttcgtgatactgacaaaccattcatgatgccagtcgaagacgtattctcaatcactggtcgtggtactgttgcaactggtcgtgttgaacgtggacaagttcgcgttggtgacgaagttgaaatcgtaggtatcgctgaagaaactgctaaaacaactgttacaggtgttgaaatgttccgtaaattgttagactacgctgaagcaggcgataacatcggtgcattattacgtggtgttgcacgtgaagacatccaacgtggacaagtattggctaaaccagcttcaatcactccacatacaaaattctctgcagaagtttacgttttaactaaagaagaaggcgggcgtcacactccgttcttcactaactaccgtcctcagttctacttccgtacaactgacgtaactggtgttgttgatctaccagaaggtactgaaatggtaatgcctggtgataacgtaactatggaagttgaattaatccacccaatcgcgatcgaagacggaactcgtttctctattc

SEQ ID NO: 70 - DNA, 835 bp, Enterococcus raffinosus
  ref <308>: DATABASE ACCESSION NUMBER: ATCC 49427
cggagctrtcttagtagtatctgctgctgatggccctatgcctcaaactcgtgaacacatcttgttatctcgtaacgttggtgttccttacatcgttgtattcttaaacaaaatggatatggttgacgatgaagaattactagaattagttgaaatggaagttcgtgacttattaactgaatacgacttcccaggcgacgacactccagttatcgcaggttcagctttgaaagccttagaaggcgacgcttcatacgaagaaaaaatcttagaattaatggctgctgttgatgaatacatcccaacaccagttcgtgatactgacaaaccattcatgatgccagyggaagacgtaytctcaatcactggtcgtggaactgttgcaactggtcgtgttgaacgtggacaagttcgcgttggtgacgaagttgaaatcgtaggtattgctgaagaaactgctaaaacaactgttacaggtgttgaaatgttccgtaaattgttggattacgctgaagcgggcgacaacattggtgcattattacgtggtgttgcacgtgaagacatccaacgtggacaagtattggctaaaccagcttcaatcactccacatacaaaattctctgcagaagtttacgttttaactaaagaagaaggcggacgtcatactccattcttcactaactaccgtcctcagttctacttccgtacaactgacgtaactggtgtagttgatctaccagaaggtactgaaatggtaatgcctggtgataacgtaactatggaagttgaattaatccacccaatcgcgatcgaagacggaactcgtttctctatt

SEQ ID NO: 71 - DNA, 835 bp, Enterococcus saccharolyticus
  ref <308>: DATABASE ACCESSION NUMBER: ATCC 43076
cggcgcgatcttagtagtatctgctgctgatggtcctatgcctcaaactcgtgaacacatcttgttatctcgtaacgtaggtgttccttacatcgttgtattcttaaacaaaatggatatggttgatgacgaagaattattagaattagtagaaatggaagttcgtgacttattatcagaatacgatttcccaggcgatgacactccagttattgcaggttctgctttgaaagctttagaaggcgatccagtttacgaagaaaaaatcttcgaattaatggctgcagttgacgaatatatcccaactccagaacgtgatactgaaaaaccattcatgatgccagttgaggatgtattctcaatcactggtcgtggtactgttgctacaggtcgtgttgaacgtggacaagttcgcgttggtgacgttgtagaaatcgttggtatcgacgaagaaacagctcaaactactgtaacaggtgttgaaatgttccgtaaattattagactacgctgaagcaggcgataacatcggtgctttattacgtggggttgctcgtgaagacatccaacgtggacaagtattagctaaaccaggaacaatcactcctcatacaaaattcgtagctgaagtttacgttttaactaaagaagaaggtggacgtcatactccattcttcactaactaccgtcctcaattctacttccgtacaactgacgtaactggtgttgtagaattacgcgaaggtactgaaatggtaatgcctggtgacaacgtaactatcgacgttgaattaatccacccaatcgctatcgaagacggaactcgtttctctatt

SEQ ID NO: 72 - DNA, 823 bp, Enterococcus solitarius
  ref <308>: DATABASE ACCESSION NUMBER: ATCC 49428
gagctatcttggtagtttctgcagctgatggcccaatgccacaaactcgtgaacatattttgttgtcacgtaatgtaggtgtaccttacatcgttgtgttcttgaacaaaatggatatggttgatgacgaagaattacttgagttagttgaaatggaagtacgtgatctattatctgaatacgacttcccaggagatgatactccagttatttccggttcagctttgaaagctttagaaggcgacgaagaatatgaacaaaaaattatggacttaatggatgcagttgatgactacattccaactcctgaacgtgaccatgacaaaccattcatgatgccaattgaagatgtattttcaattacaggccgtggtactgttgctacaggacgtgttgaacgcgggactatcaaagtcggcgatgaagttgacattattggtattcatgaagacgttaaaaagacaacagttactggtgtagaaatgttccgtaaattgttggactacgctgaagcaggcgataacattggtactttgttacgtggtgtttctcgtgatgatatcgaacgtggtcaagtattagctaaaccaggttcaatcacaccacatacaagattctctgctgaagtttatgttttgactaaagaagaaggcggacgtcatactccattcttctcaaactatcgtcctcaattctacttccgtacaactgatatcactggtgtcattgaattgccagaaggtactgaaatggtaatgccaggtgataatgtaacaatggatgttgaattaatccacccagtcgctatcgaagaaggaactcg

SEQ ID NO: 73 - DNA, 835 bp, Enterococcus casseliflavus
  ref <308>: DATABASE ACCESSION NUMBER: ATCC 25788
cggtgcaatcttggtcgtatcagcgacagatggcccaatgccacaaacacgggagcatattttgctttctcgtcaagtgggtgtgaaacatttgatcgtctttttgaataagacggaccttgtcgatgatgacgagttgatcgatttagttgaaatggaagtcagagaattgctgactgaatatgattttcctggcgacgacattcctgtgatcaagggctctgcgttaaaagccttggaaggggacccagatgctgaagcagcgatcttaacgctgatggatacagtagatgaatatatcccaacgccagaacgtgatactgacaaaccattgttgttaccgatcgaagatgtcttttcgatcacaggacgggggaccgttgcttctggtcggatcgatcgcggcatggtaaaagtcggggatgaagtagaaatcgtcggaatcaaacctgaaacacaaaaagcagtcgtgacaggggtagaaatgttccgcaaaacgatggacttcggagaagctggcgataacgtaggggtattgttacggggcatcacccgtgatgaaattgaacgtggccaagtgttagcaaaaccaggttctatcacaccgcatacgaaattccaagcggaagtctatgtgttgacaaaagaagaaggcggtcgccataccccattctttaataattatcgcccacaattttacttccgtacaacggacgtaactgggaatatcgttttaccagaaggaacggaaatggtgatgcctggtgacaacgtaacgatcgatgtggaattgatccatccgatcgctgtagaaaatggaacgaccttctcgatt

SEQ ID NO: 74 - DNA, 380 bp, Staphylococcus saprophyticus
  ref <308>: DATABASE ACCESSION NUMBER: ATCC 15305
taacgggcgtctcgatagaaaaacacgtgaaaatcccaatgattataaacaatcaatatacgattttgctgaagctgtaacaaaaggtattaaggaacaaacaaataaaaattaataggcaacttaaccagaatcgttaaaactatatgaagattctggttttttaaattcaaaaagttttctaaaaaatttacttgcttttttaagtataggtataaaatacgattgattaaaacagtaaaggaaatgaatcatgaaacaattaactaagcctttatacttttacctattactttttattacaacaacgctgattggcgcgttactattatatttgccaatcacaggtaaacatcctattgattttgtggacgcccgtt

SEQ ID NO: 75 - DNA, 666 bp, Enterococcus flavescens
  ref <308>: DATABASE ACCESSION NUMBER: ATCC 49996
gcaatcttggtcgtatcagcgacagatggcccaatgccacaaacacgggagcatattttgctttctcgtcaagtgggtgtgaaacatttgatcgtctttttgaataagacggaccttgtcgatgatgacgagttgatcgatttagttgaaatggaagtcagagaattgctgactgaatatgattttcctggcgacgacattcctgtgatcaagggctctgcgttaaaagccttggaaggggacccagatgctgaagcagcgatcttaacgctgatggatacggtagatgaatatatcccaacgccagaacgtgatactgacaaaccattgttgttaccgatcgaagatgtcttttcgatcacaggacgggggaccgttgcttctggtcggatcgatcgcggcatggtaaaagtcggggatgaagtagaaatcgtcggaatcaaacctgaaacacaaaaagcagtcgtgacaggggtagaaatgttccgcaaaacgatggacttcggagaagctggcgataacgtaggggtattgttacggggcatcacccgtgatgaaattgaacgtggccaagtgttagcaaaaccaggttctatcacaccgcatacgaaattccaagcggaagtctatgtgttgacaaaagaagaaggcggtcgccatacccca

SEQ ID NO: 76 - DNA, 751 bp, Enterococcus gallinarum
  ref <308>: DATABASE ACCESSION NUMBER: ATCC 49573
tggtgcgattttagttgtatccgcaacagatggtccaatgcctcaaacccgggaacatatcttgctttcgagacaagttggtgtgaaacatctgattgttttcttgaacaaaatcgatttagtcgatgacgaagaattgattgatttagtagaaatggaagtaagagaactgctatctgaatataattttccaggggatgacattcctgttatcaaaggttcggcattaaaagcgttggaaggagaccctgatgcagaagctgccatcatggaattaatggatacagtagacagctatatcccaacacctgagcgtgatacagacaaaccattactcttgccagttgaagatgtcttttcgattactggacgaggaacagttgcttccggacggatcgatcggggaacagttcgggtaggcgatgaagtagaaatcgtcggtatcaaacctgaaacccaaaaagctgtagtgacaggcgtcgaaatgttccgcaagacgatggactttggggaagccggtgacaatgtaggtgtcttgctgagagggatcactcgtgacgaaattgaacgaggacaagtgttggctaaaccaggttcgatcacaccacatacaaaattccaagcagaagtttatgtattgacgaaagaagaaggtggtcgtcatacaccattcttcaacaactatcgtccacaattttatttccgtacaacggatgtgacagggaacattacattgcctgaaggaacagaa

SEQ ID NO: 77 - DNA, 834 bp, Ehrlichia canis
  strain Florida
tgcagcaatattagtagtgtctgcaactgatggagcaatgccacaaacaagagaacatatattattagcaaagcaagtaggtgtaaaagatatagtagtgtggatgaataagtgtgatgttgtagatgatgaagaaatgttgtcattagttgaaatggaaataagggaattgttatcaaaatatgggtatcctggggatgatatagatgtagttagaggatctgcagttaaagcattagaagaagaaacaggctcaggtgtgtggagtgaaaaaataatggaattgatgaatgctttagaaaaaataagtttaccagtaagagaaaaagataagccatttttaatgtcaatagaagatgtgttttcaatacctggaagaggtacagtagtaacaggaagaatagaaagaggagtaattagagtaggggataaaatagagatagtaggattgcgtgagatacaaagtacagtatgtacaggtgttgaaatgtttcataaagcattagatgcaggagaagcaggggataatgctggaatattgttaagagggataaaaaaagaagatgtagaaagagggcaagtattgagtgcacctggacagatacattcatataagagatttaaggcagaggtatatatattgaaaaaagaagaaggaggaagacatactccatttttctcaaattaccagccgcaattttatgttagaacaacagatgtaacagggaatataaagttaccagaaggagtagaaatggtaatgccaggggataatataaatatcgaagtgagtttggataagcctgttgctattgatcaaggattgagatttgc

SEQ ID NO: 78 - DNA, 817 bp, Escherichia coli
  ref <308>: DATABASE ACCESSION NUMBER: ATCC 23511
cggcgcgatcctggtagttgctgcgactgacggcccgatgccgcagactcgtgagcacatcctgctgggtcgtcaggtaggcgttccgtacatcatcgtgttcctgaacaaatgcgacatggttgatgacgaagagctgctggaactggttgaaatggaagttcgtgaacttctgtctcagtacgacttcccgggcgacgacactccgatcgttcgtggttctgctctgaaagcgctggaaggcgacgcagagtgggaagcgaaaatcctggaactggctggcttcctggattcttayattccggaaccagagcgtgcgattgacaagccgttcctgctgccgatcgaagacgtattctccatctccggtcgtggtaccgttgttaccggtcgtgtagaacgcggtatcatcaaagttggtgaagaagttgaaatcgttggtatcaaagagactcagaagtctacctgtactggcgttgaaatgttccgcaaactgctggacgaaggccgtgctggtgagaacgtaggtgttctgctgcgtggtatcaaacgtgaagaaatcgaacgtggtcaggtactggctaagccgggcaccatcaagccgcacaccaagttcgaatctgaagtgtacattctgtccaaagatgaaggcggccgtcatactccgttcttcaaaggctaccgtccgcagttctacttccgtactactgacgtgactggtaccatcgaactgccggaaggcgtagagatggtaatgccgggcgacaacatcaaaatggttgttaccctgatccacccgatcgcgatggacgacggt

SEQ ID NO: 79 - DNA, 825 bp, Escherichia fergusonii
  ref <308>: DATABASE ACCESSION NUMBER: ATCC 35469
cgatcctggtagttgctgcgactgacggcccgatgccgcagactcgtgagcacatcctgctgggtcgtcaggtaggcgttccgtacatcatcgtgttcctgaacaagtgcgacatggttgatgacgaagagctgctggaactggttgaaatggaagttcgtgaacttctgtctcagtacgacttcccgggcgacgacactccgatcgttcgtggttctgctctgaaagcgctggaaggcgacgcagagtgggaagcgaaaatcctggaactggctggcttcctggattcttacattccggaaccagagcgtgcgattgacaagccgttcctgctgccgatcgaagacgtgttctccatctccggtcgtggtaccgttgttaccggtcgtgtagaacgcggtatcatcaaagttggtgaagaagttgaaatcgttggtatcaaagagactcagaagtctacctgtactggcgttgaaatgttccgcaaactgctggacgaaggccgtgctggtgagaacgtaggtgttctgctgcgtggtatcaaacgtgaagaaatcgaacgtggtcaggtactggctaagccgggcaccatcaagccgcacaccaagttcgaatctgaagtgtacattctgtccaaagatgaaggcggtcgtcatactccgttcttcaaaggctaccgtccgcagttctacttccgtactactgacgtgactggtaccatcgaactgccggaaggcgtagagatggtaatgccgggcgacaacatcaaaatggttgttaccctgatccacccgatcgcgatggacgacggtctgcgtttcgcaa

SEQ ID NO: 80 - DNA, 829 bp, Escherichia hermannii
  ref <308>: DATABASE ACCESSION NUMBER: ATCC 33650
ggcgcgatcctggttgttgctgcgactgacggcccgatgccgcagacccgtgagcacatcctgctgggtcgtcaggtaggcgttccgtacatcatcgtgttcctgaacaaatgcgacatggttgatgacgaagagctgctggaactggttgagatggaagttcgcgaactgctgtcccagtacgatttcccgggcgacgacaccccgatcgttcgtggttccgcgctgaaagcgctggaaggcgaagcagagtgggaagagaaaatcatcgaactggctggctacctggattcctatatcccggaaccagagcgtgcgattgacaagccgttcctgctgcctatcgaagacgtattctccatctccggccgtggtaccgttgttaccggtcgtgtagagcgcggtatcatcaaagtgggtgaagaagttgaaatcgtgggtatcaaagatactgcgaaatcaacctgtaccggcgttgaaatgttccgcaaactgctggacgaaggccgtgcgggcgagaacgtgggtgttctgctgcgtggtatcaaacgtgaagaaatcgaacgtggtcaggtactggctaagccgggttccatcaagcckcacaccaagttcgaatctgaagtgtacattctgtccaaagacgaaggcggccgtcacactccgttcttcaaaggctaccgtccgcagttctacttccgtacaactgacgtgactggcaccatcgaactgccggaaggcgttgagatggtaatgccgggcgacaacatcaaaatggttgttaccctgatccacccgatcgcgatggacgacggtctgcgtttcgcaa

SEQ ID NO: 81 - DNA, 816 bp, Escherichia vulneris
  ref <308>: DATABASE ACCESSION NUMBER: ATCC 33821
cggcgcgatcctggttgttgctgcgactgacggcccgatgccgcagacccgtgagcacatcctgctgggtcgtcaggtaggcgttccgtacatcatcgtgttcctgaacaaatgcgacatggttgatgacgaagagctgctggaactggttgagatggaagtgcgtgaacttctgtcccagtacgacttcccgggcgacgacaccccgatcattcgtggttctgcgctgaaagcgctggaaggcgaagctgagtgggaagagaaaatcgttgagctggctggctacctggattcctacatcccggaaccagagcgtgcgattgacaagccgttcctgctgccgatcgaagacgtattctccatctccggtcgtggtaccgttgttaccggtcgtgtagagcgcggtatcatcaargtkggtgaagaagttgaaatcgtgggtatcaaagatactgcgaaatctacctgtaccggcgttgaaatgttccgcaaactgctggacgaaggtcgtgcaggcgagaactgcggcgttctgctgcgtggtatcaagcgtgaagagatccagcgtggccaggttctggctaagccgggctcaatcaagccgcacaccaagttcgaatccgaagtgtacatcctgtccaaagacgaaggcggccgtcacactccgttcttcaaaggctaccgtccgcagttctacttccgtacaactgacgtgactggcaccatcgaactgccggaaggcgtagagatggtaatgccgggcgacaacatcaaaatggttgttaccctgatccatccgatcgcgatggacgacgg

SEQ ID NO: 82 - DNA, 828 bp, Eubacterium lentum
  ref <308>: DATABASE ACCESSION NUMBER: ATCC 43055
cggcgcctcctcgttatcgccgccaccgacggcccgatggcccagacccgcgagcacatcctgctcgcccgtcaggtcggcgtgccctacatcgtggtcttcctgaacaagtgcgacatggtcgacgacgaggagctcctcgagctcgtcgagatggaagttcgcgagctgctcgactcttacgagttcccgggcgacgacaccccgatcatccgcggctccgctttgaaggccctcgagggcgacaaagagtggcaggagaaggtctgggagctcatggacgccgtcgactcctacatcccgacgccggagcgcatggtcgacaagccgttcctgatggccgtcgaggacacgatgaccatcaccggccgcggcaccgttgccaccggtcgtgtggagcgtggtacgctgcatgtcaacgacccgctggagatcgtcggtatcaaggagacccagaacacggtctgcaccggtatcgagatgttccgcaagctgctcgacgaggctcaggccggcgacaacatcggctgcctgctccgcggtgtcaagcgcgaggagatcgttcgcggccaggttctctgcaagcccggtagcgtgaccccgcacaccgagttcgagggtcaggtctacatcctgacgaaggaagagggcggccgccacacgccgttcttcgacggctaccgtccgcagttctacttccgcacgacggacgtgacgggtgttgcccaccttcccgagggcaccgagatggtcatgccgggcgacaacgtggagatcaagggcgagctcattcacccgatcgccaggaagagggctgcgttcgctaac

SEQ ID NO: 83 - DNA, 835 bp, Eubacterium nodatum
  ref <308>: DATABASE ACCESSION NUMBER: ATCC 33099
ggagcaattctggtttgtgcagcaackgacggaccaatgcctcagacaagagaacatatccttttgtcaaggcaggtaggagtgccatatatcatcgtattcctgaataaatgtgacatggtggatgaygaagagcttctggacttggtagagatggaagtaagagaacttctcagtgagtatgaattcccgggagatgataccccgatagtaagaggttcagccctgaaggcactggaagaacccaatggagaatgggcagacaagattgtagagctgatggaggaagtagataaatacattcctgaaccaaagagagataacgacaaaccgttcctgatgcctgtagaggacgtattctcaataacaggaagaggaacagtagcgacaggaagrgttgaaagaggaatcctgaaggtcggtgatgaagtagaaatcgtgggaatgagcgaagagagaagaaaggtagtagtaacgggagttgaaatgttcagaaagcttctggatgaagcagagacaggagacaacatcggagcactgctgagaggagttcagagaacrgagatccagagaggtcaggtattggcrgcacctggaacgatcaacccacatacaaagttcaagggtcaggtatatgtactgaagaaggaagaaggaggaaggcatacgccgttcttcaayggatacagwccacagttctacttcagaacaacagacgtaacaggagatttgcagctgccggaaggarcagagatgtgcatgccgggagataatgtggtaatgaacrtcagcctgatcactccgattgctatagaagagggwctgagatttgcca

SEQ ID NO: 84 - DNA, 826 bp, Ewingella americana
  ref <308>: DATABASE ACCESSION NUMBER: ATCC 33852
gcgatcctggttgttgctgcaactgatggccctatgccacagactcgtgagcacatcctgttgggtcgycaggttggcgttccattcatgatcgtattcatgaacaaatgcgacatggttgatgacgaagagctgctggaactggtagaaatggaagttcgygaacttctgtctgcttacgatttcccaggcgacgacatcccagttgttaaaggttcagcgctgaaagcactggaaggcgaagcagagtgggaagctaagatcatcgagctggctggccacctggatagctacatcccagaaccagagcgtgcgattgacaagccattcctgctgccaatcgaagacgtattctccatctccggtcgtggtaccgttgttaccggtcgtgtagagcgcggtatcatcaaagttggcgaagaagttgaaatcgttggtatcaaggacactgttaagtctacttgtactggcgttgaaatgttccgcaaactgctggacgaaggccgtgcyggtgagaacgttggtgttctgctgcgtggtatcaagcgtgaagacatcgaacgtggtcaggttctggctaaaccaggttcaatcaaaccacacaccacwttygactcagaagtttatatcctgagcaaagatgaaggcggccgtcatactccgttcttcaaaggctaccgtccacagttctacttccgtacaactgacgtgaccggtaccatcgaactgccagaaggcgtagagatggtaatgccaggtgacaacatcaacatgrtagttaccctgatccacccaatcgcgatggatgacggtctgcgtttcgcaa

SEQ ID NO: 85 - DNA, 828 bp, Francisella tularensis
  strain LVS
tggtgctattctagtatgttctgctgcggatggtcctatgccacaaactcgtgagcacattctgctttctcgtcaagttggtgtaccaaaaatcgttgttttcttaaacaagtgtgacatggttgatgatgaagagttattagagctagttgagatggaagttcgtgagcttttagatcagtatgagttcccaggtgatgacactccagttattatgggttcagctcttagagctattgaaggtgacgaagcttacgttgagaaaattgttgagctagttcaagctatggatgactatattcctgctcctgagcgtgatactgagaagccatttattcttccgatcgaagatgtattctcaatttcaggtcgtggtactgttgtaactggtcgtattgagcgcggtgtagttaacgttggtgatgaagttgaagttgttggtattcgtccaactcaaaaaactacagtaactggtgtggaaatgttccgtaagcttttagatagaggggaagctggtgataacgttggtatcctagttcgtggacttaagagagatgatgttgagcgtggacaagtattatgtaagccaggttcaattaagccacatactaagtttgaagctgaggtttatgtattatctaaagaagagggtggtagacatactccattcttcaagggatatagaccacaattctacttccgtactacagacattactggagctgttgagcttccagagggtgtagaaatggttatgcctggtgataacgttaagatgactatcactctaattaacccaatcgctaggatgaagggttacgttttgca

SEQ ID NO: 86 - DNA, 829 bp, Fusobacterium nucleatum subsp. polymorphum
  misc_feature (1)...(829): n=a,t,c or g
  ref <308>: DATABASE ACCESSION NUMBER: ATCC 10953
cggtgctatcatcgtagktgctgctactgatggtccgatgcctcaractcgtgagcayatcytgctggctcgtcaggtaaacgtwcckagactggttgtattcatgaacaagtgygacatggtagacgacgctgaaatgytggaactcgttgaaatggaaatgcgtgaactgctttcagcytacgaattcgayggygacaacactcckttcattcagggttctgctcttggtgcrttgaayggcgttgaaaagtgggaagagaaggttatgganctgatggatgcttgcgacacttggattcctttgcctccgcgtgatattgayaaaccgttcttgatgccggttgaagacgtattctcaatcactggtcgtggtactgtagctactggtcgtatcgaagctggtgttatccatgtaggtgacgaagttgaaatcctcggtttgggtgaagacaagaagtctgttgtaactggtgttgaaatgttccgcaagttgctggatcaaggtgaagctggtgacaacgtaggtytgttgctccgtggtatcgacaagaacgaaatcaaacgtggtatggttctttgtaagcccggtcagattaaacctcactctaagttcaaagcttctatctacgttttgaagaaagaagaaggtggtcgtcacactccgttccacaacaaataccgtcctcagttctatctgcgtactatggactgtacaggtgaaatcwctcttccggaaggaactgaaatggtaatgcctggtgataacgtagaaatcactgtagaactgatctacccggtagcattgaacgtaggtttgcgtttcgct

SEQ ID NO: 87 - DNA, 828 bp, Gemella haemolysans
  ref <308>: DATABASE ACCESSION NUMBER: ATCC 10379
ctatcttagtaatcgctgctacagatggaccaatggctcaaactcgtgagcacatcctattatctcgtaacgttggagtaccaaaaatcgttgtattcttaaacaaatgtgatatggttgatgacgaagagttattagaattagttgaaatggaagttcgtgaactattatctgaatacggattcgacggagatgaactaccagtaatcaaaggttctgctcttaaagctcttgaaggagatgcagatgcagaaaaagctatcatcgaattaatggaaacagttgacgaatacatcccaactccagaacgtgataacgctaaaccattcatgatgccagttgaggacgtattctcaatcacaggtcgtggtacagttgctactggacgtgttgaacgtggacaagttaaagttggagacgtagtagaaatcgttggattaactgaagaaccagcttcaactactgtaacaggtgttgaaatgttccgtaaattattagattacgctgaagcaggagataacatcggtgcattattacgtggtgttgctcgtgaagacatcgaacgtggacaagttttagcagctcctaaaacaatcactccacacactcaattcgtagctgacgtgtacgtattatctaaagaagaaggtggacgtcacactccattcttcacaaactaccgtcctcaattctacttccgtactactgacgtaactggtgtagttactttaccagaaggtactgaaatggtaatgcctggggataacgtatcaatcaacgtagaacttatttctccaatcgcgatcgaagaaggaactcgtttctcaa

SEQ ID NO: 88 - DNA, 823 bp, Gemella morbillorum
  ref <308>: DATABASE ACCESSION NUMBER: ATCC 27824
tcttagtaatcgctgctacagatggtcctatggctcaaactcgtgaacacatcctattatctcgtaacgttggagtacctaaaattgttgtattcttaaacaaatgtgatatggttgatgacgaagagttattagaattagtagaaatggaagttcgtgaactattatctgaatacggatttgatggagatgaactaccagtaatcaaaggttcagctcttaaagctcttgaaggagatgcagatgctgaaaaagctatcatcgaattaatggaaacagttgacgagtacatcccaactccagaacgtgataacgctaaaccatttatgatgccagttgaggacgtgttctcaatcacaggtcgtggtacagttgctactggacgtgttgaacgtggacaagttaaagttggtgacgtagtagaaatcgttggattaactgaagaaccagcttcaactactgtaacaggtgttgaaatgttccgtaaattattagattacgctgaagcaggagataacatcggtgcattattacgtggtgttgctcgtgaagatatcgaacgtggacaagttttagcagctcctaaaacaatcactccacatactcaattcgtagctgatgtgtacgtattatctaaagaagaaggtggacgtcacactccattcttcacaaactaccgtccacaattctacttccgtactactgacgtaactggtgtagttactttaccagaaggtactgaaatggtaatgcctggggacaacgtatcaatcaacgtagaacttatttctccaatcgctatcgaagaaggaactcgtttctc

SEQ ID NO: 89 - DNA, 829 bp, Haemophilus actinomycetemcomitans
  ref <308>: DATABASE ACCESSION NUMBER: ATCC 33384
gctatcttagtagtagcagcaaccgacggtcctatgccacaaactcgtgagcacatcttattaggtcgccaagtaggtgttccttacatcatcgtattcttaaacaaatgcgacatggtagatgacgaagagttattagaattagttgaaatggaagttcgtgaacttctttctcaatatgacttcccgggcgatgacaccccaatcgtacgcggttctgcattaaaagcgcttgaaggcgatgccgcatgggaagaaaaaatccttgaattagcaaaccatttagatacttacatcccggaacctgagcgtgctatcgaccaaccgttccttcttccaattgaagatgtgttctctatctccggtcgtggtaccgtagtaacgggtcgtgttgagcgcggtatcatccgtaccggtgatgaagttgaaatcgtgggtatcaaaccgactgcaaaaaccaccgtaaccggtgttgaaatgttccgtaaattacttgacgaaggtcgtgcgggtgaaaacatcggtgcattattgcgtggtactaaacgtgaagaaatcgaacgtggtcaggtattggcgaaaccggggtcaatcaccccgcacactgacttcgaatctgaagtgtacgtattgtccaaagaagaaggtggtcgtcatactccattcttcaaaggttaccgtccacaattctatttccgtacaactgacgtaaccggtactatcgagttacctgaaggcgtggaaatggttatgcctggcgataacatcaaaatgaccgtatccttaattcacccaattgcgatggaccaaggtttacgtttcgctatcg

SEQ ID NO: 90 - DNA, 833 bp, Haemophilus aphrophilus
  ref <308>: DATABASE ACCESSION NUMBER: ATCC 33389
tggtgctatcttagtagtagcagcaactgatggtcctatgccacaaactcgtgagcacatcttattaggtcgccaagtaggtgttccttacatcatcgtattcttaaacaaatgcgacatggtagatgacgaagagttattagaattagttgaaatggaagttcgtgaacttctttctcaatatgacttcccgggtgatgatacaccaatcgtacgtggttctgcattacaagcgttaaacggcgttgcagaatgggaagaaaaaatccttgaattagcaaaccacttagatacttacattcctgagccacaacgtgctatcgaccaaccgttccttcttccaattgaagacgtgttctctatctccggtcgtggtactgtagtaacaggtcgtgttgagcgtggtatcatccgtaccggtgatgaagttgaaatcgtaggtatcaaaccgactgcgaaaactaccgtaaccggtgttgaaatgttccgtaaattacttgacgaaggtcgtgcaggtgaaaacatcggtgcattattacgtggcactaaacgtgaagaaatcgaacgtggtcaagtattggctaaaccgggctcaatcactccgcacactgatttcgaatctgaagtgtacgtattatccaaagaagaaggtggtcgtcatactccattcttcaaaggttaccgtccacaattctatttccgtacaactgacgtaaccggtactatcgagttaccggaaggcgtggaaatggttatgcctggcgataacatcaaaatgactgtatccttaatccacccaatcgcgatggaccaaggtttacgtttcgctatcg

SEQ ID NO: 91 - DNA, 815 bp, Haemophilus ducreyi
  DSM 8925
cggcgctatcttagttgtagcagcaactgatggtcctatgcctcaaactcgtgaacacatcttattaggccgccaagttggtgttccttacatcatcgtattcttaaataaatgcgatatggtagatgatgaagaattattagaattagttgaaatggaagttcgtgaacttctttctcaatatgatttcccaggtgacgatactcctatcgttcgtggttcagcattacaagcattaaatggtgtgcctgagtgggaagaaaaaatcattgaattagcacaacacttagattcttatatccctgagcctgagcgtgcgattgataaacctttcttattaccaatcgaagacgtattctcaatttcaggtcgtggtacagtagtaaccggtcgtgttgagcgtggtatcatcaaatcaggtgaagaagttgaaatcgtagggattaaagaaacgacaaaaacaacagtaaccggtgttgagatgttccgtaaactattagacgaaggtcgtgcgggtgaaaacgtaggtgccttattacgtggtactaaacgtgaagaaatcgaacgtggtcaagtattagcgaaaccaggtacaattacaccacacactgattttgaatcagaagtttatgtattatcaaaagaagaaggtggtcgtcatactccattcttcaaaggttatcgtcctcagttctacttccgyacaacggacgtaacaggaacgattgaattacctgaagatgttgagatggtaatgcctggtgataatatcaagatgacagtaagcttaattcaccctatcgcgatggacgaag

SEQ ID NO: 92 - DNA, 830 bp, Haemophilus haemolyticus
  ref <308>: DATABASE ACCESSION NUMBER: ATCC 33390
tggtgctatcttagtagtagcagcaactgatggtccaatgccacaaactcgtgagcacatcttattaggtcgccaagtaggtgttccatacatcatcgtattcttaaacaaatgcgacatggtagatgacgaagagttattagaattagtagaaatggaagttcgtgaacttctttctcaatatgacttcccaggtgacgatacaccaatcgtacgtggttctgcattacaagcattaaatggcgtagcagaatgggaagaaaaaatccttgagttagcaaaccacttagatacttacatcccagaaccagagcgtgcaattgaccaaccgttccttcttccaatcgaagatgtgttctcaatctcaggtcgtggtacagtagtaactggtcgtgtagaacgtggtatcatccgtactggtgatgaagtagaaatcgtaggtatcaaagatacagcaaaaactactgtaacgggtgttgaaatgttccgtaaattacttgacgaaggtcgtgcaggtgaaaacatcggtgcattattacgtggtaccaaacgtgaagaaatcgaacgtggtcaagtattagcgaaaccaggttcaatcacgccacacactgacttcgaatcagaagtttatgtattatcaaaagaagaaggtggtcgtcatactccattcttcaaaggttaccgtccacaattctatttccgtacaactgacgtaactggtactatcgagttaccagaaggcgtagaaatggtaatgccaggcgataacatcaagatgacagtaagcttaatccacccaatcgcgatggaccaaggtttacgtttcgcaa

SEQ ID NO: 93 - DNA, 824 bp, Haemophilus parahaemolyticus
  ref <308>: DATABASE ACCESSION NUMBER: ATCC 10014
tcttagtagtagcagcaacagacggtccaatgccacaaactcgtgagcacatcttattaggtcgccaagtaggtgttccatacatcatcgtattcttaaacaaatgcgatatggttgacgatgaagaattattagaattagttgaaatggaagtgcgtgaacttctttcacaatatgacttcccaggtgatgacacgccagtagtacgtggttcagcgttacaagcgttaaacggcgtagcagagtgggaagaaaaaattcttgaattagcaaaccacttagatacatacatcccagagccagagcgtgcgattgataaaccattcttattaccaatcgaagacgtattctcaatctcaggtcgtggtacagtagtaacaggtcgtgttgagcgtggtatcatcaaagcgggtgaagaagttgaaatcgtaggtatcaaagacactgcgaaaacaacagtaactggcgtggaaatgttccgtaaattattagacgaaggtcgtgcgggtgaaaacgttggtgcattattacgtggtacaaaacgtgaagaaatcgaacgtggtcaagtgttagcgaaaccaggtacaattacaccacacacagacttcgaatcagaagtgtacgtattatcaaaagaagaaggtggtcgtcacactccattcttcaaaggttaccgtccacaattctacttccgtacaactgacgtaactggtactattgaattaccagaaggcgtagaaatggtaatgccaggcgataacatcaaaatgacagtatcattaatccacccaatcgcgatggacgaaggtttacgttttgcgatt

SEQ ID NO: 94 - DNA, 833 bp, Haemophilus parainfluenzae
  ref <308>: DATABASE ACCESSION NUMBER: ATCC 7901
tggtgctatcttagtagtagcagcaactgatggtcctatgccacaaactcgtgagcacatcttattaggtcgccaagtaggtgttccttacatcatcgtgttcttaaacaaatgcgacatggtagatgacgaagagttattagaattagttgaaatggaagttcgtgaacttctttctcaatatgacttcccgggtgacgatacaccaatcgtacgtggttctgcattacaagcgttaaacggcgtwgcagaatgggaagaaaaaatccttgaattagctagccacttagattcttacattcctgagcctcaacgtgctatcgaccaaccgttccttcttccaatcgaagacgtgttctctatctccggtcgtggtacagtagtaacaggtcgtgttgagcgtggtatcatccgtaccggtgatgaagttgaaatcgtaggtatcaaaccgactgcgaaaactaccgtaaccggtgttgaaatgttccgtaaattacttgacgaaggtcgtgcaggtgaaaacatcggtgcattattacgtggtacyaaacgtgaagaaatcgaacgtggtcaagtattggctaaaccgggttcaatcactccacacactgatttcgaatctgaagtgtacgtattatccaaagaagaaggtggtcgtcatactccattcttcaaaggttaccgtccacaattctatttccgtacaactgacgtaaccggaactatcgaattaccggaaggcgtggaaatggttatgcctggtgataacatcaaaatgactgtatccttaatccacccaatcgcgatggaccaaggtttacgtttcgctatcg

SEQ ID NO: 95 - DNA, 824 bp, Haemophilus paraphrophilus
  ref <308>: DATABASE ACCESSION NUMBER: ATCC 29241
tggtgctatcttagtagtagcagcaactgatggtcctatgccacaaactcgtgagcacatcttattaggtcgccaagtaggtgttccttacatcatcgtattcttaaacaaatgcgacatggtagatgacgaagagttattagaattagttgaaatggaagttcgtgaacttctttctcaatatgacttcccgggtgacgatacgccaatcgtacgtggttctgcattacaagcgttaaacggcgttgcagaatgggaagaaaaaatccttgaattagcaaaccacttggatacttacattcctgagccacaacgtgctatcgaccaaccgttccttcttccaatcgaagacgtgttctctatctccggtcgtggtacagtagtaacaggtcgtgttgagcgtggtatcatccgtaccggtgatgaagttgaaatcgtaggtatcaaaccgactgcgaaaactaccgtaaccggtgttgaaatgttccgtaaattacttgacgaaggtcgtgcaggtgaaaacatcggtgcattattacgtggtaccaaacgtgaagaaatcgaacgtggtcaagtattggctaaaccgggttcaatcactccacacactgatttcgaatctgaagtgtacgtattatccaaagaagaaggtggtcgtcatactccattcttcaaaggttaccgtccacaattctatttccgtacaactgacgtaaccggtactatcgagttaccggaaggtgtggaaatggtaatgcctggcgataacatcaaaatgaccgtatccttaatccacccaatcgcgatggaccaaggtttacgtt

SEQ ID NO: 96 - DNA, 818 bp, Haemophilus segnis
  ref <308>: DATABASE ACCESSION NUMBER: ATCC 33393
gctatcttagtagtagcagcaactgatggtcctatgccacaaactcgtgagcacatcttattaggtcgccaagtaggtgttccttacatcatcgtattcttaaacaaatgcgacatggtagatgacgaagagttattagaattagttgaaatggaagttcgtgaacttctttctcaatatgacttcccaggtgatgatactccaatcattcgtggttctgcattacaagcgttaaacggcgtagcagaatgggaagaaaaaatccttgaattagctcaagcattagatacttacattcctgaacctgagcgtgcaatcgaccaaccgttccttcttccaattgaagacgtgttctcaatctctggtcgtggtactgtagtaacaggtcgtgtagagcgtggtatcatccgtaccggtgatgaagttgaaatcgttggtatcaaaccaactgcgaaaacaaccgtaaccggtgttgaaatgttccgtaaattacttgacgaaggtcgtgcaggtgaaaacatcggtgcattattacgtggtactaaacgtgaagaaatcgaacgtggtcaagtattagcgaaaccgggttcaatcactccacacactgacttcgaatctgaagtgtacgtattatctaaagaagaaggtggtcgtcatactccattcttcaaaggttaccgtccacaattctatttccgtacaactgacgtaaccggtactatcgagttaccggaaggcgtggaaatggttatgcctggcgataacatcaaaatgaccgtatccttaatccacccaatcgcgatggaccaaggtttacg

SEQ ID NO: 97 - DNA, 763 bp, Hafnia alvei
  ref <308>: DATABASE ACCESSION NUMBER: ATCC 13337
cggcgctatcctggttgttgctgcgactgacggccctatgcctcagactcgtgagcacatcctgctgggtcgtcaggttggcgttccttwcatcatcgtrttcctgaacaaatgcgacatggttgatgatgaagagctgctggaactggtagaaatggaagttcgtgaacttctgtctcagtacgacttcccwggygatgatactccaatcatccgtggttctgctctgaaagcgctggaaggygmacctgagtgggaagctaagatcgtagaactggctgaaactctggattcttacatyccacarccagaacgtgctatcgayaagccattcctgctgccaatcgaagacgtattctctatctctggccgtggtacwgttgttaccggtcgtgtagagcgcggtatcgttaaagttggtgaagaagttgaratcgttggtatcaaagataccgttaaatcaacttgtaccggcgttgaaatgttccgtaaactgctggacgaaggtcgtgcaggcgagaacgttggtgttctgctgcgtggtatcaagcgtgaagacatcgaacgtggtcaggttctggctaaaccaggytcyatcaagccacacaccaagttcgaatcagaagtttatattctgagcaaagatgaaggcggycgtcatactccgttcttcaaaggctaccgtccacagttctacttccgtacaactgacgtgaccggtaccatcgaattgccagaaggcgtggaaatggtaatgccaggc

SEQ ID NO: 98 - DNA, 828 bp, Kingella kingae
  ref <308>: DATABASE ACCESSION NUMBER: ATCC 23330
cggcgcaatcttggtatgttcagcagctgacggtcctatgccacaaactcgcgaacacatcttgttggctcgccaagtaggtgtaccttatatcatcgtattcatgaacaaatgcgacatggtcgatgatgctgagttgttggaattggttgaaatggaaatccgtgacttgttgtctagctacgattttccaggcgacgattgcccaatcgttcaaggttctgcattgcgygcattggaaggcgacgctgcatacaaagaaaaaatctttgaattggctgctgctttggatagctacattcctactccagaacgtgctgttgataaaccattcttgttgccaatcgaagatgtattctctatctctggtcgtggtacagtagttactggtcgtgtagagcgcggtatcatcaaagtaggcgaagagattgaaatcgttggtttgaaagacacgcaaaaaaccacttgtactggcgtggaaatgttccgcaaattgttggacgaaggtcaagctggtgataacgttggtgtattattgcgtggtacgaagcgtgaagacgttgaacgtggtcaggtattggctaaaccaggttctatcactccgcacactaaatttgaagctgaagtgtatgtgttgagcaaagaagaaggtggccgtcatacgccattcttcgctaactaccgcccacaattctacttccgtacgactgacgtaactggtgcagttactttgtctgagggtgtggaaatggttatgccaggcgaaaacgtgaaaatcactgttgagttgattgcacctatcgctaggaaaacggtttgcgttttgcg

SEQ ID NO: 99 - DNA, 828 bp, Klebsiella ornithinolytica
  ref <308>: DATABASE ACCESSION NUMBER: ATCC 31898
ggcgcgatcctggttgttgctgcgactgacggcccgatgccgcagactcgtgagcacatcctgctgggtcgtcaggtaggcgttccgtacatcatcgtgttcctgaacaaatgcgacatggttgatgacgaagagctgctggagctggttgaaatggaagtccgtgagctgctgtctcagtacgacttcccgggcgacgacacgccgatcgttcgtggttccgctctgaaagcgctggaaggcgaagcagactgggaagcgaaaatcatcgaactggctggctacctggattcttacatcccggaaccagagcgtgcgattgacaagccgttcctgctgccgatcgaagacgtattctccatctccggtcgtggtaccgttgttaccggtcgtgtagagcgcggtatcatcaaagtgggcgaagaagttgaaatcgttggtatcaaagagactgcgaagtctacctgtactggcgttgaaatgttccgcaaactgctggacgaaggccgtgctggtgagaacgttggtgttctgctgcgtggtatcaaacgtgaagaaatcgaacgtggtcaggtactggctaagccgggctctatcaagccgcacaccaagttcgaatctgaagtgtacattctgtccaaagacgaaggcggccgtcatactccgttcttcaaaggctaccgtccgcagttctacttccgtacaactgacgtgactggcaccatcgaactgccggaaggcgtagagatggtcatgccgggcgacaacatcaaaatggttgttaccctgattcacccgatcgcgatggacgatggtctgcgtttcgca

SEQ ID NO: 100 - DNA, 749 bp, Klebsiella oxytoca
  ref <308>: DATABASE ACCESSION NUMBER: ATCC 33496
gatgccgcagactcgtgagcacatcctgctgggtcgtcaggtaggcgttccgtacatcatcgtgttcctgaacaagtgcgacatggttgatgacgaagagctgctggaactggttgaaatggaagttcgtgaacttctgtctcagtacgatttcccgggcgacgacactccgatcgttcgtggttctgctctgaaagcgctggaaggcgacgcwgagtgggaakckaaaatcatcgaactggctggcttcctggattcttacattccggaaccagagcgtgcgattgacaagccgttcctgctgccgatcgaagacgtattctccatctccggtcgtggtaccgttgttaccggtcgtgtagagcgcggtatcatcaaagttggcgaagaagttgaaatygttggtatyaaagacactgctaagtctacctgtactggcgttgaaatgttccgcaaactgctggacgaaggccgygctggtgagaacgttggtgttctgctgcgtggtatcaaacgtgaagaaatcgaacgtggtcaggtactggctaagccgggctctatcaagccgcacaccaagttcgaatctgaagtttatatcctgtccaaagacgaaggcggccgtcacactccgttcttcaaaggctaccgtccgcagttctacttccgtacaactgacgtgactggcaccatcgaactgccggaaggcgtagagatggttatgccgggcgacaacatcaaaatggttgtta

SEQ ID NO: 101 - DNA, 830 bp, Klebsiella planticola
  ref <308>: DATABASE ACCESSION NUMBER: ATCC 33531
tggcgcgatcctggttgttgctgcgactgacggcccgatgccgcagactcgtgagcacatcctgctgggtcgtcaggtaggcgttccgtacatcatcgtgttcctgaacaaatgcgacatggttgatgacgaagagctgctggaactggttgaaatggaagttcgtgagctgctgtctcagtacgacttcccgggcgacgacactccgatcgttcgtggttccgctctgaaagcgctggaaggcgaagcagactgggaagcgaaaatcatcgaactggctggctacctggattcttacatcccggaaccagagcgtgcgattgacaagccgttcctgctgcctatcgaagacgtattctccatctccggtcgtggtaccgttgttaccggtcgtgtagagcgcggtatcatcaaagtgggcgaagaagttgaaatcgttggtatcaaagatactgctaartcwacctgtacyggcgttgaaatgttccgcaaactgctggacgaaggccgtgctggtgagaacgttggtgttctgctgcgtggtatcaaacgtgaagaaatcgaacgtggtcaggtactggctaagccgggctctatcaagccgcacaccaagttcgaatctgaagtgtacattctgtccaaagacgaaggcggccgtcatactccgttcttcaaaggctaccgtccgcagttctacttccgtacaactgacgtgactggcaccatcgaactgccggaaggcgtagagatggtaatgccgggcgacaacatcaaaatggttgttaccctgattcacccratcgcgatggacgacggtctgcgtttcgcaa

SEQ ID NO: 102 - DNA, 806 bp, Klebsiella pneumoniae subsp. ozaenae
  ref <308>: DATABASE ACCESSION NUMBER: ATCC 11296
cctggttgttgctgcgactgacggcccgatgccgcagactcgtgagcacatcctgctgggtcgtcaggtaggcgttccgtacatcatcgtgttcctgaacaaatgcgacatggttgatgacgaagagctgctggaactggttgagatggaagttcgtgaactgctgtctcagtacgatttcccgggcgacgacaccccgatcgttcgtggttctgctctgaaagcgctggaaggcgacgcagagtgggaagcgaaaatcatcgaactggctggccacctggatacctatatcccggaaccagagcgtgcgattgacaagccgttcctgctgccgatcgaagacgtattctccatctccggtcgtggtaccgttgttaccggtcgtgtagagcgcggtatcatcaaagtaggtgaagaagttgaaatcgttggtatcaaagaaaccgcgaaaaccacctgtactggcgttgaaatgttccgcaaactgctggacgaaggccgtgctggtgagaacgtaggtgttctgctgcgtggtatcaaacgtgaagaaatcgaacgtggtcaggtactggctaagccgggcaccatcaacccgcacaccaagttcgaatctgaagtgtacatcctgtccaaagacgaaggcggccgtcatactccgttcttcaaaggctaccgtccgcagttctacttccgtactactgacgtgactggcaccatcgaactgccggaaggcgtagagatggtaatgccgggcgacaacatcaaaatggttgttaccctgatccacccgatcgcgatggacgacg

SEQ ID NO: 103 - DNA, 743 bp, Klebsiella pneumoniae subsp. pneumoniae
  ref <308>: DATABASE ACCESSION NUMBER: ATCC 13883
gcagactcgtgagcacatcctgctgggtcgtcaggtaggcgttccgtacatcatcgtgttcctgaacaaatgcgacatggttgatgacgaagagctgctggaactggttgagatggaagttcgtgaactgctgtctcagtacgatttcccgggcgacgacactccgatcgttcgtggttctgctctgaaagcgctggaaggcgacgcagagtgggaagcgaaaatcatcgaactggctggccacctggatacctatatcccggaaccagagcgtgcgattgacaagccgttcctgctgccgatcgaagacgtattctccatctccggtcgtggtaccgttgttaccggtcgtgtagagcgcggtatcatcaaagtaggtgaagaagttgaaatcgttggtatcaaagaaaccgcgaaaaccacctgtactggcgttgaaatgttccgcaaactgctggacgaaggccgtgctggtgagaacgtaggtgttctgctgcgtggtatcaaacgtgaagaaatcgaacgtggtcaggtactggctaagccgggcaccatcaacccgcacaccaagttcgaatctgaagtgtacatcctgtccaaagacgaaggcggccgtcacactccgttcttcaaaggctaccgtccgcagttctacttccgtactactgacgtgactggcaccatcgaactgccggaaggcgtagagatggtaatgccgggcgacaacatcaaaatggttgtta

SEQ ID NO: 104 - DNA, 819 bp, Klebsiella pneumoniae subsp. rhinoscleromatis
  ref <308>: DATABASE ACCESSION NUMBER: ATCC 13884
tggttgttgctgcgactgacggcccgatgccgcagactcgtgagcacatcctgctgggtcgtcaggtaggcgttccgtacatcatcgtgttcctgaacaaatgcgacatggttgatgacgaagagctgctggaactggttgagatggaagttcgtgaactrctgtctcagtacgatttcccgggcgacgacaccccgatcgttcgtggttctgctctgaaagcgctggaaggcgacgcagagtgggaagcgaaaatcatcgaactggctggccacctggatacctatatcccggaaccagagcgtgcgattgacaagccgttcctgctgccgatcgaagacgtattctccatctccggtcgtggtaccgttgttaccggtcgtgtagagcgcggtatcatcaaagtaggtgaagaagttgaaatcgttggtatcaaagaaaccgcgaaaaccacctgtactggcgttgaaatgttccgcaaactgctggacgaaggccgtgctggtgagaacgtaggtgttctgctgcgtggtatcaaacgtgaagaaatcgaacgtggtcaggtactggctaagccgggcaccatcaacccgcacaccaagttcgaatctgaagtgtacatcctgtccaaagacgaaggcggccgtcacactccgttcttcaaaggctaccgtccgcagttctacttccgtactactgacgtgactggcaccatcgaactgccggaaggcgtagagatggtaatgccgggcgacaacatcaaaatggttgttaccctgatccatccgatcgcgatggacgacggtctgcgtttcgcaa

SEQ ID NO: 105 - DNA, 832 bp, Kluyvera ascorbata
  ref <308>: DATABASE ACCESSION NUMBER: ATCC 33433
cggcgcgatcctggttgttgctgcgactgatggccctatgccacagactcgtgagcacatcctgctgggtcgtcaggtaggcgttccttacatcatcgtgttcctgaacaaatgygacatggttgatgacgaagagctgctggaactggttgaaatggaagttcgtgaacttctgtctcagtacgatttcccaggcgacgatactccaatcatccgtggttctgctctgaaagcgctggaaggcgatgcagagtgggaagcgaaaatcatcgaactggctggcttcctggattcttacatcccagaaccagaacgtgctatcgataagccgttcctgctgccaatcgaagacgtattctccatctccggtcgtggtaccgttgttaccggtcgtgtagagcgcggtatcatcaaagttggygaagaagttgaaatcgttggtatcaaagacaccgctaagtctacctgtaccggcgttgaaatgttccgcaaactgctggacgaaggccgtgctggtgagaacgttggtgttctgctgcgtggtatcaaacgtgaagaaatcgaacgtggtcaggttctggctaagccaggctctatcaagccgcacaccaagttcgaatctgaagtgtacattctgtccaaagacgaaggcggccgtcatactccgttcttcaaaggctaccgtccacagttctacttccgtactactgacgtgaccggtaccatcgaactgccagaaggcgttgagatggtaatgccaggcgacaacatcaagatggttgtgactctgatccacccaatcgcgatggacgacggcctgcgtttcgcaacc

SEQ ID NO: 106 - DNA, 830 bp, Kluyvera cryocrescens
  ref <308>: DATABASE ACCESSION NUMBER: ATCC 33435
tggcgcgatcctggttgttgctgcaactgatggccctatgccacagactcgtgagcacatcctgctgggtcgtcaggtaggcgttccttacatcatcgtgttcctgaacaaatgtgacatggttgatgacgaagagctgctggaactggttgaaatggaagttcgtgaacttctgtctcagtacgatttcccaggcgacgacactcctatcgttcgtggttccgcgctgaaagcgctggaaggcgacgctgagtgggaagcaaaaatcatcgaactggctggcttcctggattcttacatcccagaaccagagcgtgcgattgataagccgttcctgctgccaatcgaagacgtattctccatctccggtcgtggtaccgttgttaccggtcgtgtagagcgcggtatcatcaaagttggtgaagaagttgaaatcgtgggtatcaaagacactgctaagtctacctgtaccggcgttgaaatgttccgcaaactgctggacgaaggccgtgctggtgagaacgttggtgttctgctgcgtggtatcaaacgtgaagaaatcgaacgtggtcaggttctggctaagccaggctccatcaagccgcacaccaaattcgaatctgaagtttacatcctgtccaaagacgaaggcggccgtcatactccgttcttcaaaggctaccgtccacagttctacttccgtactactgacgtgactggtaccatcgaactgccagaaggcgtagagatggtaatgccgggcgacaacatcaaaatggttgttaccctgatccacccaatcgcgatggacgacggtctgcgtttcgcaa

SEQ ID NO: 107 - DNA, 826 bp, Kluyvera georgiana
  ref <308>: DATABASE ACCESSION NUMBER: ATCC 51603
cgcgatcctggttgttgctgcgactgacggcccgatgccgcagactcgtgagcacatcctgctgggtcgtcaggttggcgttccgtacatcatcgtgttcctgaacaaatgcgacatggttgatgacgaagagctgctggaactggttgaaatggaagttcgtgaacttctgtctcagtacgacttcccgggcgacgacacgccgatcgttcgtggttctgctctgaaagcgctggaaggcgacgctgagtgggaagcgaaaatcatcgaactggcgggcttcctggattcttacatcccggaaccagagcgtgcgattgacaagccgttcctgctgccgatcgaagacgtattctccatctccggtcgtggtaccgttgttaccggtcgtgtagaacgcggtatcatcaaagttggcgaagaagttgaaatcgttggtatcaaagacaccgctaagtctacctgtactggcgttgaaatgttccgcaaactgctggacgaaggccgtgctggtgagaacgttggtgttctgctgcgtggtatcaaacgtgaagaaatcgaacgtggtcaggtactggctaagccgggttctatcaagccgcacaccaagttcgaatctgaagtgtacattctgtccaaagacgaaggcggccgtcatactccgttcttcaaaggctaccgtccgcagttctacttccgtactactgacgtgactggcaccatcgaactgccggaaggcgttgagatggtaatgccgggcgacaacatcaaaatggttgttaccctgatccacccgatcgcgaaggacgaaggtctgcgtttcgca

SEQ ID NO: 108 - DNA, 803 bp, Lactobacillus casei subsp. casei
  misc_feature (1)...(803): n=a,t,c or g
  ref <308>: DATABASE ACCESSION NUMBER: ATCC 393
gctgctgatggcccaatgccacaaactcgtgaacatatcttactttcacgtcaagttggtgttccatacatcgttgtattcatgaacaaatgtgacatggttgacgatgaagaattactagaattagttgaaatggaaattcgtgatctattaactgaatatgaattccctggcgatgacattcctgtaatcaaaggttcagctcttaaagcacttcaaggtgaagctgactgggaagctaaaattgacgagttaatggaagctgtagattcttacattccaactccagaacgtgatactgacaaaccattcatgatgccagttgaggatgtattctcaatcactggtcgtggaacagttgcaactggacgtgttgaacgtggacaagttaaagttggtgacgaagtagaagttatcggtattgaagaagagagcaaaaaagtagtagtaactggagtagaaatgttccgtaaatyactagattacgctgaagctggcgacaacattggcgcacttctacgtggtgttgctcgtgaagatatccaacgtggtcaagtattagctaaaccaggttcgattactccacacactaacttcaaagctgaaacttatgttttaactaaagaagaaggtggacgtcacactccattcttcaacaactaccgcccacaattctatttccgtactactgacgtaactggtattgttacacttccagaaggtactgaaatggtaatgcctggtgataacattgagcttgcagttganctaattgcaccaatcgctatcgaagacggtactaa

SEQ ID NO: 109 - DNA, 825 bp, Lactococcus lactis subsp. lactis
  ref <308>: DATABASE ACCESSION NUMBER: ATCC 19435
cggtgcaatcctcgttgttgctgcaactgatggaccaatgccacaaactcgtgaacacatcttgctttcacgtcaagttggtgttaaataccttatcgtcttccttaacaaggctgaccttgttgatgatgaagaattgatggaactcgttgaaatggaagttcgtgacctcttgagcgaatacgacttcccaggtgacgatattcctgtaatcgctggttcagcacttggtgctttgaacggtgaaccacaatgggttgctaaagttgaagaattgatggacatcgttgatgaatacatcccaactccagaacgcgacactgacaaaccactccttcttccagtcgaagacgtattctctatcactggtcgtggtacagttgcttcaggacgtatcgaacgtggtactgttaaagttggtgacgaagttgaaatcgttggtatcaaagaagaaactaaaaaagctgttgttactggtatcgaaatgttccgtaaaacacttactgaaggtcttgctggtgataacgtcggtgcacttctccgtggtatccaacgtgacgaaatcgaacgtggtcaagttattgctaaaccaggttcaatcactccacacaaacttttcgaaggtgaagtttacgtattgagcaaagaagaaggcggacgtcacactccattcttcgacaactaccgtcctcaattctacttccacacaactgacgttactggttcagttaaacttccagaaggaactgaaatggtaatgcctggtgacaacgtgcatatcgacgttgaattgatccacccagttgcgatcgaacaaggtactac

SEQ ID NO: 110 - DNA, 824 bp, Leclercia adecarboxylata
  ref <308>: DATABASE ACCESSION NUMBER: ATCC 23216
ggcgcgatcctggttgttgctgcgactgacggcccaatgcctcagacccgtgagcacatcctgctgggtcgtcaggtaggcgttcctttcatcatcgtgttcctgaacaaatgcgacatggttgatgacgaagagctgctggaactggttgagatggaagttcgtgaactyctgtcccagtacgacttcccgggcgacgacaccccaatcgttcgtggttctgcgctgaaagcgctggaaggcgaagcagagtgggaagagaaaatcatcgarctggctggctacctggattcctacatcccagagccagagcgtgcgattgacaagccgttcctgctgcctatcgaagacgtattctccatctccggtcgtggtaccgttgttaccggtcgtgtagagcgcggtatcatcaargttggcgaagaagttgaaatcgttggtatcaaggacactgctaagtctacctgtaccggcgttgaaatgttccgcaaactgctggacgaaggccgtgccggtgagaacgttggtgttctgctgcgtggtatcaaacgtgaagaaatcgaacgtggtcaggttctggctaagccaggctcyatcaagccgcacaccaagttcgaatctgaagtgtacatcctgtcyaaagacgaaggcggccgtcatactccgttcttcaaaggctaccgtccacagttctacttccgtackactgacgtgaccggtaccatcgarctgccagaaggcgttgagatggtaatgccaggcgacaacatcaaaatggttgttaccctgatccacccaatcgcaatggacgatggtctgcgttc

SEQ ID NO: 111 - DNA, 838 bp, Legionella micdadei
  ref <308>: DATABASE ACCESSION NUMBER: ATCC 33218
cggagcgatattagtagtatcagcagcggatggcccaatgcctcaaacgagagagcacatactyttatcccgscaggtaggtgttccctatatagtagtgttcttaaacaaagctgacatggtggatgatgcggagttattagaattagttgaaatggaagtacgcgayttgttgagcagctatgaatttccaggagatgagatcccgattgtagttggttcagcattaaaagcattggaaggcgatacgagtgatataggtgtaccagcgattgagaagttagttgagacgatggattcttatatacctgagccggtaagaaacatcgataaaagtttcttgttaccgatcgaagacgtgttctcaatatctggacgaggaacagtagtaacaggacgtatcgaaagcgggatcatcaaagttggtgaggaagtcgagattgttggtatacgtgacactcaaaagacgacatgcacaggcgttgaaatgttccgtaaattacttgacgaaggtcgagctggagacaacgttggtatattgctacgtggtacgaagcgggatgaagttgaacgcggacaagtattagctaagccgggaagcattaaaccgcatactaaatttgaagctgaagtgtatgtgttgtcaaaagatgaaggtggacgtcataccccattctttaacggatatcggcctcaattttacttcaggaccacagacgtaactggttcttgtgatttacctgarggtatagaaatggtaatgccaggtgataacgtcaagctgattgttagcttacactcaccgattgctatggacgaaggtttgcgttttgcaatc

SEQ ID NO: 112 - DNA, 838 bp, Legionella pneumophila subsp. pneumophila
  ref <308>: DATABASE ACCESSION NUMBER: ATCC 33152
cggagcgatactggttgtatcagcagctgatggtcctatgccacaaacgagggaacacattctattgtctcgccaggtaggtgttccatatattgttgtgttcatgaacaaagcggatatggttgatgaccctgagttattagagttagtggaaatggaagtgcgagatttattaagcagttacgatttcccaggggatgacatacctattgttgttggttcagctttgaaagcattggaaggtgaagacagtgatataggcgttaaggctattgagaaattggttgaaacaatggattcatacattcctgagccagttagaaacatagacaagccatttttgttgccgattgaagacgtattttcaatttctggacgcggaacagtggtaactggtcgtgtagagagtggaattgttaaagttggtgaggaagttgaaattgttggaataagagacacccaaaagacgacttgtacgggtgttgagatgttccgtaaattacttgatgaaggtcgagctggtgataacgttggtgtgttattacgaggtacgaagcgagatgaagtggagcgtggacaggtattggcgaagccaggaaccatcaagccacacaccaagtttgaagcagaagtgtatgtattatccaaggaagaaggcggacgtcacactccattctttaatggataccgtccacaattctatttcagaaccactgacgtgacaggtacttgtgacttgccatcaggagttgaaatggtaatgcctggagataatgtgcaattagttgttagcttgcatgctccgattgcgatggatgaaggtttaagattcgcaatt

SEQ ID NO: 113 - DNA, 828 bp, Leminorella grimontii
  ref <308>: DATABASE ACCESSION NUMBER: ATCC 33999
gtgcaatcctggtagtagcagcgactgacggcccgatgcctcagactcgcgagcacatcctgctgggtcgtcaggtaggcgttccgtacatcatcgtattcctgaacaagtgcgatatggttgatgacgaagagctgctggagctggttgaratggaagttcgcgaactgctgtctcagtacgacttcccgggcgacgacactccggtagtccgcggttcagcgctgaaagcgctggaaggcgaagccgagtgggaarcgaaaatcatcgagctggcaggccmtctggatacttatatcccagaacctgagcgtgcgattgacaagccgttcctgctgcckatcgaagacgtattctctatctccggccgtggtaccgttgttaccggtcgtgtagagcgcggcatcatcaaagtcggtgaagaagtggaaatcgtcggtatcaaagataccaccaagaccacctgtaccggcgttgaaatgttccgtaagctgctggacgaaggccgtgcgggcgagaacgtgggcgttctgctgcgcggtaccaagcgtgacgaaatcgaacgtggtcaagttctggccaagccgggcaccatcactcctcacacccagttcgtgtcagaagtgtatatcctgagcaaggatgaaggcggccgtcatactccgttcttcaaaggctaccgtcctcagttctacttccgtacgactgacgtgacaggcaccatcgaactgccggaaggcgtagagatggtaatgccaggcgacaacattcagatgaccgtaagtctgattgcgccgatcgcaatggacgaaggtctgcgcttcgcaa

SEQ ID NO: 114 - DNA, 826 bp, Leminorella richardii
  ref <308>: DATABASE ACCESSION NUMBER: ATCC 33998
gctatcctggttgttgctgcgactgacggcccaatgcctcagactcgtgagcacatcctgctgggtcgccaggtaggcgttccttacatcatcgtgttcctgaacaagtgcgacatggttgatgacgaagagctgctggaactggtagaaatggaagttcgtgaacttctgtctcaatacgacttcccgggcgacgatacgccggttgttcgcggttcagcgctgaaagcgctggaaggtgacgcygagtgggaarcgaaaatcattgaactggcggaatccttrgatacttayattccagagccagagcgtgcgattgacaagccgttcctgctgcctatcgaagacgttttctctatctctggccgtggtactgtagtcaccggtcgtgtagagcgcggcatcatcaaagttggtgaagaagtggaaatcgtgggaatcaaagacaccaccaagaccacctgtactggcgttgaaatgttccgtaagctgctggacgaaggccgtgcaggtgagaacgttggtgttctgctgcgyggtactaagcgtgacgaaatcgaacgtggtcaggtactggctaagccaggcaccatcactcctcacacagaattcgtgtcagaagtgtatatcctgagcaaggatgaaggcggycgtcatactccgttcttcaaaggctaccgtcctcagttctacttccgtacgactgacgtgaccggcaccatcgaactgccagaaggcgtagagatggtaatgccaggcgataacatccagatggtagttacgctgattgccccaatcgcgatggacgaaggtctgcgcttcgcaa

SEQ ID NO: 115 - DNA, 843 bp, Leptospira interrogans
  ref <308>: DATABASE ACCESSION NUMBER: ATCC 23581
tgcggcgattcttgtagtatccgcaactgacggacctatgccacaaacaaaagaacatatccttcttgctcgtcaggtaggtgttccatatgtaattgtattcattaacaaagcagatatgcttgctgctgacgaaagagcagaaatgatcgaaatggttgagatggacgttcgtgaacttctcaataagtatagcttcccaggagatacaactcctatcgttcatggttctgcggtaaaagcacttgagggcgatgaatctgaaattgggatgcctgcaattctcaaattgatggaagctctggatactttcgttccaaatccaaaacgtgtaatcgacaaacctttccttatgccagtagaagacgttttctcgatcactggtcgtggaactgttgcaactggaagagtggaacaaggtgttttgaaagtgaacgacgaagttgaaattatcggtatccgcccaacaacaaaaactgttgttaccggtatcgaaatgttcagaaaacttctcgatcaagcggaagctggcgacaacatcggcgctcttcttcgtggaactaaaaaagaagaaatcgaaagagggcaagttcttgcgaagccaggttctatcactcctcacaaaaagtttgccgctgaggtgtatgtattaactaaggatgaaggcggacgtcatactccgtttatcaataactaccgtcctcagttttactttagaacaactgacgtaaccggagtttgtaaccttcctaatggtgtcgaaatggttatgcctggtgataacgtttctttgacggttgaattgattagcccgatcgcaatggacaagggtcttaagttcgc

SEQ ID NO: 116 - DNA, 832 bp, Megamonas hypermegale
  ref <308>: DATABASE ACCESSION NUMBER: ATCC 25560
cggtgctatcctcgttgttagtgctgctgatggtcctatgcctcagactcgtgaacacatccttctcgctcgtcaggttggtgttccagctatcgttgtattcctcaacaaagctgaccaggttgatgaccctgaacttctcgaacttgttgaaatggaagttcgtgaacttctttccagctatgacttcccaggcgatgacgttccagtaatcactggttccgctcttcaggctctcgaaggcgacgaagaagctaaaaagaaaattcttgaattaatggatgctgttgatgattacatcccaactccaacacgtgacactgataaacctttcttaatgccagttgaagacgtattcacaattactggtcgtggtactgttgctacaggccgtgttgaacgtggcgaacttaaacttggtgacagcgttgaaatcgttggtctttccgatgaaaagaaatccactactgtaactggtatcgaaatgttccgcaaaatgcttgatagcgctgttgctggtgataacatcggtgcacttcttcgtggtattgaccgtaaagaaatcgaacgtggtcaagttcttgctaaacctggcacaattcatccacacaaaaaattcaaagctcaggtttacgtattaactaaagaagaaggtggacgtcatactccattcttctccaactatcgtccacagttctatttccgtactactgacgttactggtgttgtaactcttccagaaggtactgaaatggttatgcctggcgataacattgaaatgagcatcgaactcatcactccaatcgctattgaaaaaggtcttcgcttcgct

SEQ ID NO: 117 - DNA, 820 bp, Mitsuokella multacida
  ref <308>: DATABASE ACCESSION NUMBER: ATCC 27723
tggtgctatcctcgtcgtttccgctgctgatggcccgatgccgcagacgcgtgagcacatcctgctcgctcgccaggtcggtgttccggcaatcgttgtcttcctcaacaaggttgaccaggttgacgatccggagctcctcgagctcgtcgagatggaagttcgcgagctgctctccagctacgacttcccgggcgatgacatccctgtaatcgctggttccgctctgaaggccctcgaaggcgacgaagagcagaagaagaacatcctcaagctcatggaagctgtcgatgagtacatcccgacgccggtccgcgacaacgctaagccgttcctgatgccggtcgaggatgtcttcacgatcacgggccgtggtacggttgcaacgggccgcgttgagcgtggtgagctcaagatgaacgatacggttgagatcgttggtctgcaggacgagccgcgtcagacggttgtcacgggcatcgagatgttccgcaagatgcttgatttcgctgaggctggcgataacatcggtgctctgctccgtggtatcgaccgcaaggagatcgagcgtggccaggttctcgcaaagccgggcacgattcatccgcacacgaagttcaaggctcaggtctatgtcctgacgaaagaagaaggcggccgtcatacgccgttcttcacgaactatcgcccgcagttctacttccgcacgacggacgtaactggcgtagtcaaactgccggaaggcacggagatggttatgcctggcgataacgtcgagatggaagttgagctcatcaccccgatcgctatcgagaagggc

SEQ ID NO: 118 - DNA, 831 bp, Mobiluncus curtisii subsp. holmesii
  ref <308>: DATABASE ACCESSION NUMBER: ATCC 35242
cggcgctatcctcgtggtggctgctactgacggtccgatggctcagaccaaggaacacatcctgttggctaagcaggttggcgtgccctccatcctggtcgctctgaacaagtgcgattcttccgatgtggacgaagacatgctcgaaatcgtcgaggacgaaatccgcgatgacctggagaagcagggcttcgatcgtgactgcccgattatccacgtttccgctctgaaggccctggaaggcgaccccgagtggaccaagaagattgaagagctcatggaagcggtcgatacctacattcctgagcctgttcgtgacctcgacaagccgttcttgatgcctatcgaagacgtcttcaccattactggtcgcggtaccgtagtgaccggtcgtgtggaacgcggcaagctaccgttgaacgccgaagtggaaatcgtaggtattcgtcctacgcaaaagaccaccgttaccggtatcgaaatgttccacaagtccatggacgaagcctacgccggcgagaactgtggtctgttgctgcgtggcaccaagcgtgaggacgttgagcgcggtcaggttgtctgcattcctggctccgtgaccccgcacaccaagttcgagggcaaggtctacatcttgaagaaggacgaaggtggacgtcacaagtcgttctacgacggctaccgcccgcagttcttcttccgcaccaccgacgtgaccggtgttattcacctgcccgaaggcaccgaaatggttatgcctggcgacaccaccgaaattagcgttgagctgattcagcctatcgctatggaggaaggtctcggcttcgctat

SEQ ID NO: 119 - DNA, 825 bp, Moellerella wisconsensis
  ref <308>: DATABASE ACCESSION NUMBER: ATCC 35017
ggtgcaattctggttgttgctgcaactgatggccctatgccacagactcgtgagcacatcctgttaggtcgtcaggttggcgttccatacatcatcgttttcctgaacaaatgtgacatggtagacgacgaagagctgttagaactggttgaaatggaagtccgtgagctgctgtctcagtacgatttcccaggcgatgacactccagtaatccgtggttcagcgctgaaagctctggaaggcgaagctgagtgggaagctaaaatcattgaactggcagaagcactggattcttatatcccagagccagagcgtgacattgataagccattcctgttaccaatcgaagacgtattctcaatttcaggccgtggtacagttgttactggtcgtgttgagcgtggtatcgttaaagtcggtgaagaagttgaaatcgttggtatcaaagataccgtgaaaacaacatgtactggcgttgaaatgttccgtaaactgctggacgaaggccgtgctggtgagaacgttggtgttctgctgcgtggtactaaacgtgatgatatcgaacgtggtcaagtattggctaaaccaggttcaatcactccgcatacaactttcgaatcagaagtttacatcctgagcaaagatgaaggtggccgtcatactccattcttcaaaggttaccgtccacagttctacttccgtacaactgacgtaaccggtactatcgaactgccagaaggcgttgagatggtaatgccaggtgataacatcaaaatgatcgttactctgatccacccaattgcaatggatgcaggtctgcgtttt

SEQ ID NO: 120 - DNA, 827 bp, Branhamella catarrhalis
  ref <308>: DATABASE ACCESSION NUMBER: ATCC 43628
tggtgctatcttggttgtttctgcaactgatggtcctatgccacaaactcgtgagcatatcctactatctcgtcaggttggtgtaccatacatcatggtattcatgaacaagtgcgatatggttgatgatgaagagctactagaattggttgaaatggaagttcgtgaacttctatctgactatgatttccctggtgatgataccccaatcatcaaaggttcagcactagaagcattgaatggttctgatggtaaatatggcgagcctgcagttctagaactgctagacacactagacagctatatcccagagcctgagcgtgatatcgataagtcattcttgatgccaattgaagatgtcttctcgatctcaggtcgtggtacagttgtgactggtcgtgttgaatcaggtattattaaagttggtgatgaaattgaaatcatcggtatcaaaccaactgctaaaaccacctgtactggtgttgaaatgttccgtaaactgttagacgaaggtcgtgcaggtgagaactgtggtatcttgttgcgtggtactaagcgtgaagaagttcaacgcggtcaagtacttgcaaaaccaggttcaatcaccccacatactaagtttgatgctgaagtttatgtactgtcaaaagaagaaggtggtcgtcacaccccattcttaaatggctatcgcccacagttctacttccgtaccacagatgtgactggtgccatcactctacaagaaggtaccgaaatggttatgcctggtgacaatgttgagatgagtgttgagcttatccacccaatcgccaggataaaggtctacg

SEQ ID NO: 121 - DNA, 806 bp, Morganella morganii subsp. morganii
  ref <308>: DATABASE ACCESSION NUMBER: ATCC 25830
cggcgctatcctggttgttgctgcaactgatggccctatgccacagacccgtgagcacatcctgttaggtcgtcaggttggcgttccttacatcatcgtattcctgaacaaatgtgacatggttgatgatgaagagctgctggaactggttgaaatggaagttcgtgaacttctgtctcagtacgatttccctggcgacgacacgccaatcgttcgcggttcagcgctgaaagcactggaaggcgagccagagtgggaagctaaratcgttgaactggcaggtttcctggattcttacatccctgagccagagcgtgcaattgacaagccgttcctgctgccaatcgaagacgtattctcaatctccggccgtggtaccgttgttaccggtcgtgttgagcgcggtatcatcaaggttggtgaggaagttgaaatcgtgggtatcaaagatactgcgaaaaccacctgtaccggtgttgaaatgttccgcaaactgctggacgaaggccgtgcmggtgagaacgtcggtgttctgctgcgtggtaccaagcgtgaagaaatcgaacgtggtcaggttctggctaaaccaggttcaatcaaaccacayaccaaatttgaatcagaagtttatattctgagcaaagatgaaggtggtcgtcatactccattcttcaaaggytaccgtccacagttctacttccgtaccacagacgtaacaggtactatcgaactgccggaaggcgttgaaatggtaatgccgggcgacaacatcaaaatgatcgtcaccctgatccacccaatcgcaa

SEQ ID NO: 122 - DNA, 825 bp, Mycobacterium tuberculosis
  strain TB 299
ggtgcgatcctggtggtcgccgccaccgacggcccgatgccccagacccgcgagcacgttctgctggcgcgtcaagtgggtgtgccctacatcctggtagcgctgaacaaggccgacgcagtggacgacgaggagctgctcgaactcgtcgagatggaggtccgcgagctgctggctgcccaggaattcgacgaggacgccccggttgtgcgggtctcggcgctcaaggcgctcgagggtgacgcgaagtgggttgcctctgtcgaggaactgatgaacgcggtcgacgagtcgattccggacccggtccgcgagaccgacaagccgttcctgatgccggtcgaggacgtcttcaccattaccggccgcggaaccgtggtcaccggacgtgtggagcgcggcgtgatcaacgtgaacgaggaagttgagatcgtcggcattcgcccatcgaccaccaagaccaccgtcaccggtgtggagatgttccgcaagctgctcgaccagggccaggcgggcgacaacgttggtttgctgctgcggggcgtcaagcgcgaggacgtcgagcgtggccaggttgtcaccaagcccggcaccaccacgccgcacaccgagttcgaaggccaggtctacatcctgtccaaggacgagggcggccggcacacgccgttcttcaacaactaccgtccgcagttctacttccgcaccaccgacgtgaccggtgtggtgacactgccggagggcaccgagatggtgatgcccggtgacaacaccaacatctcggtgaagttgatccagcccgtcgccatggacgaaggtctgcgtttc

SEQ ID NO: 123 - DNA, 806 bp, Neisseria cinerea
  ref <308>: DATABASE ACCESSION NUMBER: ATCC 14685
cggtgcgatcttggtatgttccgcagctgacggtcctatgccgcaaactcgcgaacacatcctgttggcccgccaagtaggtgtaccttacatcatcgtgttcatgaacaaatgcgacatggttgacgatgccgagctgttggagctggttgaaatggaaatccgtgacttgctgtcaagctacgacttcccaggtgacgactgcccgatcgtacaaggttctgcactgaaagccttggaaggcgacgcagcttacgaagaaaaaatcttcgaattggctgctgcattggacagctacatcccaacacctgagcgtgcagtggacaaacctttcttgttgcctatcgaagacgtattctctatttccggtcgcggtacagtagtaaccggtcgtgtagagcgcggtatcatccacgttggtgacgagatcgaaatcgtaggtctgaaagaaactcaaaaaaccacttgtaccggtgttgaaatgttccgcaaactgctggacgaaggtcaagctggtgacaacgtaggtgtattgctgcgtggtactaaacgtgaagacgtagagcgtggtcaagtattggctaaaccgggtactatcactcctcacaccaagttcaaagcagaagtatacgtactgagcaaagaagagggtggtcgtcacactccgttcttcgctaactaccgtccacaattctacttccgtactaccgacgtaaccggcgcggttactttggaagaaggtgtagaaatggtaatgccgggtgagaacgtaaccattactgtagaactgattgcgcctatcgcta

SEQ ID NO: 124 - DNA, 822 bp, Neisseria elongata subsp. elongata
  ref <308>: DATABASE ACCESSION NUMBER: ATCC 25295
cggcgcaatcttggtatgttccgctgcygacggtcctatgccgcaaactcgcgaacacatcctgttggcccgccaagtaggcgtaccttacatcatcgtgttcatgaataaatgcgacatggttgaygatgccgaactgctggaactggttgaaatggaaatccgtgacttgctgtcaagctacgacttcccaggcgacgactgcccgatcgtacaaggttccgcactgaaagccttggaaggcgacgcagcttacgaagaaaaaatcttcgaactggctgctgcattggacagctacatcccgacacctgagcgtgccgtggacaaaccgttcctgttgcctatcgaagacgtattctctatctccggccgtggtacagtagtaaccggtcgtgtagagcgcggtatcatccacgtcggtgacgagatcgaaatcgtaggtctgaaagaaacccaaaaaaccacttgtaccggtgttgaaatgttccgcaaactgctggacgaaggtcaagcaggtgacaacgtaggcgtattgctgcgcggtaccaaacgtgaagaagtggaacgcggtcaagtattggctaaaccgggtaccatcactcctcacaccaaattcaaagcagaagtttacgtattgagcaaagaagagggtggtcgtcatactccgttcttcgctaactaccgtccacaattctacttccgtactaccgacgtaaccggtgcggttactttggaagaaggtgtagaaatggttatgcctggtgagaacgtggccatcactgtagaactgattgcacctatcgctatggaagaaggtctgcg

SEQ ID NO: 125 - DNA, 820 bp, Neisseria flavescens
  ref <308>: DATABASE ACCESSION NUMBER: ATCC 13120
cggcgcgacttggtatgttccgcagctgacggtcctatgccgcaaacccgcgaacacatcctgttggctcgccaagtaggtgtaccttacatcatcgtattcatgaacaaatgcgacatggtagacgatgccgagctgttggaactggttgaaatggaaattcgtgacttgttgtcaagctacgacttcccaggcgacgactgcccaatcgtacaaggttctgcactgaaagctttggaaggtgatgctgcttacgaagaaaaaatcttcgaattggctgctgccttggacagctacatcccaacacctgagcgtgctgtggacaaacctttcttgttgcctatcgaagacgtattctctatctctggtcgtggtacagtagtaaccggtcgcgtagagcgcggtatcatccacgttggtgacgagatcgaaatcgtaggtctgaaagaaactcaaaaaaccacttgtaccggcgttgaaatgttccgcaaactgctggacgaaggtcaagcaggtgacaacgtaggcgtattgctgcgtggtactaaacgtgaagacgtagagcgtggtcaagtattggctaaaccaggtaccatcactcctcacaccaaattcaaagcagaagtatacgtactgagcaaagaagagggtggtcgtcacactccatttttcgctaactaccgtccacaattctacttccgtactaccgacgtaactggtgcagttactttggaagaaggcgtagaaatggtaatgccaggtgagaacgtaaccattactgtagaactgattgcgccaatcgctatggaagaagtctgcg

SEQ ID NO: 126 - DNA, 830 bp, Neisseria gonorrhoeae
  ref <308>: DATABASE ACCESSION NUMBER: ATCC 49226
ggtgcaatcctggtatgttctgctgccgacggccctatgccgcaaacccgcgaacacatcctgctggcccgtcaagtaggcgtaccttacatcatcgtgttcatgaacaaatgcgacatggtcgacgatgccgagctgttggaactggttgaaatggaaatccgcgacctgctgtccagctacgacttccccggcgacgactgcccgatcgtacaaggttccgcactgaaagccttggaaggcgatgccgcttacgaagaaaaaatcttcgaactggctaccgcattggacagctacatcccgactcccgagcgtgccgtggacaaaccattcctgctgcctatcgaagacgtgttctccatttccggccgcggtaccgtagtcaccggccgtgtagagcgaggtatcatccacgttggtgacgagattgaaatcgtcggtctgaaagaaacccaaaaaaccacctgtaccggcgttgaaatgttccgcaaactgctggacgaaggtcaggcgggcgacaacgtaggcgtattgctgcgcggtaccaaacgtgaagacgtagaacgcggtcaggtattggccaaaccgggtactatcactcctcacaccaagttcaaagcagaagtgtacgtattgagcaaagaagagggcggccgccataccccgtttttcgccaactaccgtccccaattctacttccgtaccactgacgtaaccggcgcggttactttggaaaaaggtgtggaaatggtaatgccgggtgagaacgtaaccattactgtagaactgattgcgcctatcgctatggaagaaggtctgcgctttgcgat

SEQ ID NO: 127 - DNA, 816 bp, Neisseria lactamica
  ref <308>: DATABASE ACCESSION NUMBER: ATCC 23970
cggcgcaatcttggtatgttccgccgccgacggccctatgccgcaaacccgcgaacacattctgttggcccgccaagtaggtgtaccttacatcatcgtattcatgaacaaatgcgatatggtcgacgatgccgagctgttggaactggttgaaatggaaatccgcgacctgctgtcaagctacgacttcccaggcgacgactgcccaatcgtacaaggttccgcactgaaagctttggaaggcgatgccgcttacgaagaaaaaatcttcgaactggctgccgcattggacagctacatcccgactcccgagcgtgccgtggacaaaccgttcctgctgcctatcgaagacgtattctccatctccggccgcggtacggtagtaaccggccgtgtagagcgcggtgtcatccacgttggcgacgagatcgaaatcgtcggtctgaaagaaacccaaaaaaccacctgtaccggtgtcgagatgttccgcaaactgctggacgaaggtcaggcaggcgacaacgtaggcgtattgctgcgcggtaccaaacgtgaagaagtggaacgcggtcaggtattagccaaaccgggtaccatcactccgcacaccaagttcaaagcagaagtgtatgtattgagcaaagaagagggcggtcgtcacactccgttcttcgccaactaccgtccgcaattctacttccgtaccaccgacgtaaccggcgcggttactttggaagaaggcgtggaaatggtaatgcccggtgagaacgtaaccattactgtagaactgattgcgcctatcgctatggaagaagg

SEQ ID NO: 128 - DNA, 831 bp, Neisseria meningitidis
  ref <308>: DATABASE ACCESSION NUMBER: ATCC 13077
cggtgcaatcctggtatgttccgcagccgacggtcctatgccgcaaacccgcgaacacatcctgctggcccgtcaagtaggcgtaccttacatcatcgtgttcatgaacaaatgcgacatggtcgacgatgccgagctgttggaactggttgaaatggaaatccgcgacctgctgtccagctacgacttccccggcgacgactgcccgatcgtacaaggttccgcactgaaagccttggaaggcgatgccgcttacgaagaaaaaatcttcgaattggctgctgcattggacagctacatcccgactcccgagcgtgccgtggacaaacctttcttgttgcctatcgaagacgtattctctatttccggtcgtggtacagtagtaaccggtcgtgtagagcgcggtatcatccacgtcggtgacgagatcgaaatcgtcggtctgaaagaaactcaaaaaaccacttgtaccggtgttgaaatgttccgcaaactgctggacgaaggtcaagcaggcgacaacgtaggcgtattgctgcgcggtaccaaacgtgaagacgtagagcgtggtcaagtattggctaaaccgggtacaatcactcctcacaccaagttcaaagcagaagtatacgtactgagcaaagaagagggcggccgccataccccgttcttcgccaactaccgtccccaattctacttccgtaccaccgacgtaaccggcgcggttactttggaagaaggtgtggaaatggtaatgccgggcgagaacgtaaccatcaccgtagaactgattgcgcctatcgctatggaagaaggtttgcgctttgcgat

SEQ ID NO: 129 - DNA, 815 bp, Neisseria mucosa
  ref <308>: DATABASE ACCESSION NUMBER: ATCC 19696
cggcgcaatcttggtatgttctgctgcygacggtcctatgccgcaaacccgygaacacatcctgttggcccgtcaagtaggygtaccttacatcatcgtgttcatgaacaaatgcgacatggttgacgatgccgaaytgttggaactggttgaaatggaaatccgtgacttgctgtcaagctacgacttccctggygacgactgcccgattgtacaaggttctgcactgaaagccttggaaggcgatgccgcttacgaagaaaaaatcttcgaactggctgccgcattggacagctacatcccgactcccgagcgtgccgtagacaaaccgttcctgttgcctatcgaagacgtattctccatctccggtcgtggtacagtagtaaccggccgtgtagagcgcggtgttatccacgttggtgacgagatcgaaatcgtaggtctgaaagaaacccaaaaaaccacatgtaccggtgttgaaatgttccgcaaactgctggacgaaggtcaagccggtgacaacgtaggcgtattgctgcgcggtaccaaacgtgaagaagtggaacgcggtcaagtattggctaaaccgggtaccatcactccgcacaccaaattcaaagcagaagtgtacgtattgagcaaagaagagggtggtcgtcatactccgttcttcgctaactaccgtcctcaattctacttccgtactaccgacgtaaccggtgcggttactttggaagaaggtgtagaaatggttatgcctggtgagaaygtagccatyactgtagaactgattgcgcctatygctatggaagaag

SEQ ID NO: 130 - DNA, 829 bp, Neisseria sicca
  ref <308>: DATABASE ACCESSION NUMBER: ATCC 9913
ggcgcaatcttggtatgttccgctgctgacggtcctatgccgcaaacccgcgaacacatcctgttggcccgccaagtaggcgtaccttacatcatcgtgttcatgaacaaatgcgacatggttgacgatgccgagctgttggaactggttgaaatggaaatccgtgacttgctgtcaagctacgacttccctggtgacgactgcccgatcgtacaaggttctgcactgaaagccttggaaggcgacgccgcttacgaagaaaaaatcttcgaactggctgctgcattggacagctacatcccgactcctgagcgtgccgtggacaaaccgttcctgttgcctattgaagacgtattctccatctccggtcgcggtaccgtagtaaccggccgtgtagagcgcggtgttatccacgttggtgacgagattgaaatcgtaggtctgaaagaaacccaaaaaaccacttgtaccggtgttgaaatgttccgcaaactgctggacgaaggtcaagccggtgacaacgtaggcgtattgctgcgcggtaccaaacgtgaagaagtggaacgcggtcaagtattggctaaaccgggtaccatcactcctcacactaaattcaaagcagaagtttacgtattgagtaaagaagagggtggtcgtcatactccgttcttcgctaactaccgtcctcaattctacttccgtactaccgacgtaaccggcgcggttactttggaagaaggtgtagaaatggttatgcctggtgagaacgtagccatcactgtagaactgattgcaccgatcgctatggaagaaggtctgcgctttgcga

SEQ ID NO: 131 - DNA, 814 bp, Neisseria subflava
  ref <308>: DATABASE ACCESSION NUMBER: ATCC 14221
cggcgcgacttggtatgttccgcagctgatggtcctatgcctcaaactcgcgaacacatcctgttggctcgccaagtaggtgtaccttacatcatcgtattcatgaacaaatgcgacatggttgacgatgccgagctgttggaactggttgaaatggaaatccgtgacctgttgtcaagctacgacttcccaggcgacgactgcccaatcgtacaaggttctgcactgaaagctttggaaggtgacgctggttacgaagagaaaatcttcgaattggctgctgctctggacagctacatcccaacacctgagcgtgctgtggacaaacctttcttgttgcctatcgaagacgtattctctatctctggccgtggtacagtagtaactggtcgtgtagagcgcggtatcatccacgttggtgacgagatcgaaatcgtaggtctgaaagaaacccaaaaaaccacttgtaccggcgttgaaatgttccgcaaactgctggacgaaggtcaagctggtgacaacgtaggcgtattgctgcgtggtaccaaacgtgaagacgtagagcgtggtcaagtattggctaaaccaggtaccattactcctcacaccaaattcaaagcagaagtatacgtactgagcaaagaagagggtggtcgtcacactccattcttcgctaactaccgtccacaattctacttccgtactactgacgtaactggtgcagttactttggaagaaggcgtagaaatggtaatgccaggtgagaacgtaaccattactgtagaactgattgcgcctatcgctatggaagaag

SEQ ID NO: 132 - DNA, 818 bp, Neisseria weaveri
  ref <308>: DATABASE ACCESSION NUMBER: ATCC 51223
gccatcttggtatgttctgctgctgacggtcctatgccgcaaacccgtgagcacatcctgttggctcgtcaagtaggtgtaccctacatcatcgtattcatgaacaaatgcgatatggttgatgatgcagagctgctggaattggtagaaatggaaatccgtgatctgctgagcagctacgatttccctggcgatgattgyccaatcgtgcaaggttctgctttgaaagctttggaaggtgatgccgcttacgaagaaaaaatctttgaattagctgctgcattggatagctatattccaacwcctgagcgygctgttgataaaccattcctgttgccgattgaagatgtattctcaatttcaggtcgtggtacagtagtaactggtcgtgtagagcgcggtattattcacgtaggcgatgaaattgaaattgtaggtttgaaagaracycaaaaaactacttgtaccggcgttgaaatgttccgtaaattgctggatsaaggtcaggctggtgataacgtaggcgtattgttgcgtggtaccaaacgtgaagacgttgagcgtggtcaagtattggctaagcctggtwctattactccgcayaccaaattcaaagcagargtktatgtwttgagyaaggaagaaggcggtcgtcatactccgttcttcgctaactatcgtccgcaattctatttccgtactacagacgttaccggtgckgtractttagaagaaggtgtggaaatggtaatgcctggtgagaaygttgccattactgtwgarytgatygctccgattgckatggaagaaggytgcgt

SEQ ID NO: 133 - DNA, 836 bp, Ochrobactrum anthropi
  ref <308>: DATABASE ACCESSION NUMBER: ATCC 49188
cggcgcaattctggttgtttcggccgctgacggcccgatgccgcagacccgtgagcacatcctgctcgctcgtcaggttggcgttccggcaatcgtcgtgttcctgaacaagtgcgaccaggttgacgatgcagaactgctcgaactggttgaactggaagttcgcgaacttctgtcgaaatacgatttcccgggcgacgaagttccgatcatcaagggctcggctcttgctgctctggaagattcttcgaaggaactgggcgaagacgccgttcgttcgctgatggccgctgttgacgactacattccgaccccggaacgtccgatcgaccagccgttcctgatgccgatcgaagacgttttctcgatctcgggccgtggtacggttgtgacgggtcgcgttgagcgcggtatcgtcaaggttggtgaagaagttgaaatcgtcggcatcaaggcgacggcgaagacgacggtaaccggcgttgaaatgttccgcaagctgctcgaycagggccaggctggcgacaacatcggcgctctgatccgcggcgttggccgtgaagacgttgaacgcggccaggttctctgcaagccgggttctgtgaagccgcacaccaagttcaaggcagaagcctacattctgaccaaggacgaaggtggccgtcatacgccgttctttacgaactaccgtccgcagttctacttccgcacgacggacgtgaccggtgttgtcacgctgccggaaggcacggaaatggttatgcctggcgacaacgtcgctatggacgtcaccctgatcgtgccgatcgccatggaagagaagctccgcttcgcta

SEQ ID NO: 134 - DNA, 805 bp, Pantoea agglomerans
  ref <308>: DATABASE ACCESSION NUMBER: ATCC 27155
cctggttgttgctgcgactgatggcccaatgccacagacccgtgagcacatcctgctgggtcgtcaggttggcgttccttacatcatcgtgttcctgaacaagtgtgacatggttgatgatgaagagctgctggaactggtagagatggaagtacgtgacctgctgtcacagtacgacttcccaggcgatgacaccccgatcgttcgtggttctgctctgaaagcgctggaaggcgttcctgagtgggaagcaaaaatcgttgagctggctgaacacctggacaactacatcccggatccagtccgtgcgatcgacatgccgttcctgctgccaatcgaagacgtattctcaatctctggccgtggtaccgttgttaccggtcgtgttgagcgcggcatcgttaaagtcggcgacgaagttgaaatcgtgggtatcaaagatactgcgaaatcaacctgtaccggtgttgagatgttccgtaagctgctggaccagggtcaggcaggcgaaaactgtggtgttctgctgcgcggtatcaagcgtgaagacatccagcgtggccaggttctggctaagccaggctcaatcaagccgcacacccagttcgagtcagaagtttacgttctgtctaaagacgaaggtggccgccatactccgttcttcaaaggctatcgtccacagttctacttccgtacaactgatgtaaccggttcagtagagctgccagaaggcgttgagatggtcatgccaggcgacaacatcaaaatggttgttaccctgatccacccaatcgcaatggacgaa

SEQ ID NO: 135 - DNA, 825 bp, Pantoea dispersa
  ref <308>: DATABASE ACCESSION NUMBER: ATCC 14589
cgcgatcctggttgttgctgcgactgatggcccaatgcctcagacccgtgagcacatcctgctgggccgtcaggttggcgttccttacatcatcgtgttcctgaacaagtgtgacatggttgatgacgaagagctgctggaactggttgagatggaagttcgcgatctgctgtctcagtacgacttcccaggcgacgataccccaatcgtacgcggttctgcgctgaaagcgctggaaggcgacgctgagtgggaagcgaaagtcgttgagctggctggtcacctggatacttacattccagatccagtacgtgctatcgatctgccgttcctgctgccaatcgaagacgtattctcaatctctggccgtggtaccgttgttaccggtcgtgttgagcgcggcatcgtgaaagtgggcgacgaagtagaaatcgttggtatcaaagcgactgccaagtctacctgtaccggtgttgaaatgttccgcaaactgctggaccagggtcaggcaggcgagaactgtggtgttctgctgcgcggtatcaagcgtgaagagatccagcgtggtcaggttctggctaagccaggcaccatcaagccacacaccaagttcgtatcagaagtgtacgtactgtctaaagacgaaggcggccgtcatactccgttcttcaaaggctaccgtccacagttctacttccgtacyactgatgtgaccggcamcatmgaactgccagaaggcgttgagatggtaatgccaggcgacaacatcaaaatgrccgttgagctgatccacccaatcgcgatggaccagggtctgcgtttcgc

SEQ ID NO: 136 - DNA, 762 bp, Pasteurella multocida
  NCTC 10322
cacaaacacgtgagcacatccttttaggtcgccaagtaggcgttccttacatcatcgtattcttaaacaaatgcgacatggtggatgatgaagaattattagaattagttgaaatggaagtgcgtgaacttctttctcaatatgatttcccaggtgatgatacaccaatcgtacgtggttcagcgttacaagcgttaaacggygtagctgagtgggaagagaaaattcttgagttagccaaccacttagatacttacattccagagccacaacgtgcaatcgaccaaccgttccttcttccgattgaagacgtgttctcaatttctggtcgtggtacagtagtaacaggtcgtgttgagcgtggtatcatccgtacaggtgaagaggttgaaattgttggtattaaagcgacaacgaagaccacagtaacaggtgttgagatgttccgtaaattattagacgaaggtcgtgcgggtgagaacgttggtgctttattacgtggtactaarcgtgaagaaatcgaacgtggtcaagtgttagcgaaaccgggttcaatyacgccacacactgattttgaatcagaagtttacgtgttatcaaaagaagaaggtggtcgtcatacaccattcttcaaaggttaccgtccacagttctacttccgtacaacggacgtaacaggtacaatcgaattaccggaaggtgttgagatggtgatgcctggtgataacatcaagatgactgtaagtttgattcacccaatcg

SEQ ID NO: 137 - DNA, 832 bp, Peptostreptococcus anaerobius
  ref <308>: DATABASE ACCESSION NUMBER: ATCC 27337
tggagctatcttagttgtatcagcagcggatggaccaatgccacaaacaagagaacacatcttattatcaagacaagtaggagtaccatatatcgtagtatatttgaataaagcagatatggtagaagatgaagaattattagaattagtagaaatggaagtaagagaattactatctgaatatggattcccaggagatgaaattccaatcataacaggatcatccttaggagcattaaatggagaacaaaaatggatagatcaaatcatggcattgatgaaagccgtagatgaatatattccaacaccggaaagagcagtagatcaaccattcttgatgccaatcgaagacgtatttacaattacaggaagaggaactgtagtaacaggaagagttgaaagaggagttgtaaaagtwggagaagaagttgaaatcgtaggaatcaaagcgacaacaaagacaacttgtacyggagtagaaatgttccgaaaattattggatcaaggacaagcaggagataacatcggagctttattragaggaaccaagaaagaagatgtagaaagaggacaagtattggcaaaaccaggaacaattcatcctcatacaaacttcagtggagaagtatatgtattgacaaaagaagaaggaggaagacatactccattcttctcaggatacagaccacaattttactttagaaccacagatattacaggagcagtaacattaccagaaggagtagaaatggtaatgccrggagataatatcacaatgacagtagaattgattcacccaattgcaatggaaacaggattacgatttgcaatt

SEQ ID NO: 138 - DNA, 823 bp, Peptostreptococcus asaccharolyticus
  strain LSPQ 2639
tagtatgttcagcagcagayggtccaatgccacaaacaagagaacacattctactagcaagacaagttggtgtaccaaagatagtagtattcctaaacaaagaagaccaagtagacgatccagaactaattgaattagtagagatggaaatcagagacctactatcagaatatgacttcgayggagacaacacaccaatcgtagtaggatcagcattaaaagccctagacgatccagacggagaatggggagacaaaatcgtaaaactaatggaagmagtagacgaatacatcccaacaccagtaagagatacagaacacccattcctaatgccaatcgaagacrtattctcaatyacaggaagaggaacagtagcaacaggaagagtagaacaaggtgtagtaaaagtaggmgacacagtagaactagtaggcttaacagacgaaagcagacaagtagtagtaacaggtgtagaaatgtttagaaaacaactagacctagcagaagcmggagacaacattggagccctactaagaggagtacaaagagaagaaatccaaagaggacaagtactagcagcaccaggaacaatcaaaccacacacaaaatttgaagcagaagtatacgtactaacaaaagaagaaggtggaagacacacaccattctttaacggatacagaccacaattctacttcagaacaacagacgtaacaggagacatccaactagcagacggagtagaaatggtaatgccaggagacaactcaacatttacagtaacactaatcacaccaatcgcaatggacgaaggactaagattcgc

SEQ ID NO: 139 - DNA, 832 bp, Peptostreptococcus prevotii
  ref <308>: DATABASE ACCESSION NUMBER: ATCC 9321
ctatcatcgtagtatctgcagcagacggtccaatgcccaaacagagagaacacatcctactagcaagacaagtaggcgttccaaaaatcgcagtattcctaaacaaagaagaccaagtagacgatccagaactaatcgaattagtagaaatggaaatcagagacctactttcagaatacgacttcgatggagacaacgctccagtagtagtaggatctgctcttaaatcactagaagaaggcggagaaggcccatggtcagacaaaatccttgacctaatggcacaagtagacgaatacttcgacatcccagaaagagacaacgaccaaccattcctaatgccagtagaagacgtaatgacaatctcaggacgtggaacagtagcaacaggaagagttgaaagaggaacactaaaagttggtgatacagtagaaatcgtaggactaacagaagatacaaaagaaacagtagtaactggagtagaaatgttccacaaatcmctagaccaagcagaatctggagataacgtaggactactactaagaggagtaacaagagatcaaatctcaagaggacaagtactagcaaaaccaggwtcagtaaacccacacacagaattcgaaggtcaagtatacgtactaacaaaagaagaaggtggacgtcacacaccattcttcagtggatatagaccacaattcttctttagaacaacagacgtaacaggagacatcgaactagaagaaggcgtagaaatggtaatgccaggagacaacgcaacattcaaaatcacactccaaaaaccaatcgctctagaagaaggactaagattcgc

SEQ ID NO: 140 - DNA, 831 bp, Porphyromonas asaccharolytica
  ref <308>: DATABASE ACCESSION NUMBER: ATCC 25260
cggtgctatcatcgtagttgctgcaactgatggtcctatgcctcagacgcgtgagcacatcctactagcacgtcaggtcaacgtacctcgtctagttgtctttatgaacaagtgcgaccttgttgatgacgaggagatgctcgagctcgtagagatggatatgcgtgagctactaagcttctatgactttgacggcgacaacactcctgtcatccgtggttctgctcttggtgctctcaatggtgagcctaagtgggtagagaaggttatggagctcatggaggctgtagacacttggatcccactacctgagcgcgacatcgacaagcctttcctaatgcctgtagaggacgtattctctatcacaggtcgtggtactgtcgctactggtcgtatcgagactggtgtcgttaaggtcaacgatgaggttcagatcatcggtctaggtgctgagggtaagaagagcgtcgtaactggcgtggaaatgttccgcaagatccttgatgagggtgaagctggtgataacgtaggtctcctactccgtggtatcgacaaggacgagatcaagcgcggtatggtcctagcacacccaggtcaggtcaagcctcacgatcacttcaaggctgaggtctatatcctgaagaaggaagagggtggtcgtcacacaccattccacaacaagtaccgtcctcagttctacatccgtacgctagacgtaacgggcgagatcacactcccagagggtgtagagatggttatgcctggtgataacgtcaccatcgatgtcaagctcatctctccagtagcttgtagcgtaggtctacgcttcgc

SEQ ID NO: 141 - DNA, 818 bp, Porphyromonas gingivalis
  ref <308>: DATABASE ACCESSION NUMBER: ATCC 33277
cggtgctataatcgttgtagcagctacagacggtcctatgcctcagactcgcgagcacatccttttggctcgccaggtaaacgttcctcgtctggttgttttcatgaacaaatgtgacatggtagacgatgaagagatgctcgagcttgttgaaatggacatgcgcgaactcctttctttctacgatttcgatggtgacaatacccctatcatccgtggttctgctctgggcgctttgaatggagagcctcagtgggaagacaaggtgatggagcttatggaagctgttgacaactgggttcccctgcctgagcgcgatatcgacaaaccgttcttgatgccggttgaagacgtgttctctatcacgggtcgtggtacggtcgctacaggacgtatcgaaaccggtattgtgaagaccggtgacgaagttcaaatcatcggcctcggtgcagaaggaatgaagtcggttgttacgggtgttgaaatgttccgtaagattcttgacgaaggtcaggctggtgacaacgttggtctcctcctgcgtggtatcgataaggatcagatcaagcgtggtatggttatctctcacccgggtaagattactcctcacaagagatttaaggccgaggtttatatcttgaagaaagaagaaggtggtcgccacactcctttccacaacaaatatcgtccgcagttctacatccgtacgcttgacgtgaccggtgaaatcactcttcccgaaggaacagaaatggttatgcccggtgacaacgtaacgatcactgtagaactcatctacccggttgcatgtaatgtag

SEQ ID NO: 142 - DNA, 830 bp, Pragia fontium
  ref <308>: DATABASE ACCESSION NUMBER: ATCC 49100
cggcgctattctggttgttgctgcaactgatggtcctatgcctcaaactcgtgagcacatcctgttaggycgccaggttggcgtaccatacatcattgtgttcctgaacaagtgtgacatggttgaygatgaagagctgttagaactggttgaaatggaagttcgtgagcttctgtctcagtacgatttcccaggtgatgatactccagttgttcgtggttctgcgctgaaagcgttrgaaggcgaagctgagtgggaagctaaaatcattgaattggctgactccctggayagctacattccacagccagagcgtgcaattgataagccgttcctgctgccaatcgaagacgttttctcaatctctggccgtggtacagtagtaaccggtcgtgtagagcgcggtatcgttaaagttggtgaagaagttgaaatcgttggtatcaaagatactgtgaaaacaacttgtactggcgttgaaatgttccgtaarttactggatgaaggccgtgcgggtgagaacgttggtgttctgctgcgtggtactaagcgtgatgaaatcgaacgtggtcaagtattagcaaaaccaggttcaatcaacccgcatactaacttcgtatcagaagtttatatcctgagcaaagatgaaggtggtcgtcatactccattcttcaaaggctaccgtccacagttytacttccgtacaactgacgtgaccggtaccatcgaactgccagaaggcgtagagatggtaatgccaggtgataacattcagatgactgtaactctgattgccccaatcgcgatggacgaaggtttacgcttcgcta

SEQ ID NO: 143 - DNA, 821 bp, Prevotella melaninogenica
  ref <308>: DATABASE ACCESSION NUMBER: ATCC 25845
tggtgctatcttggttgtagctgctactgatggtcctatgcctcagactcgtgagcacgtattgctcgctcgtcaggtaaacgtacctcgcttggttgtattcttgaacaagtgtgatatggttgacgatgctgagatgcttgacctcgttgagatggaggttcgtgagatcctcgagcagtacggttatgaggaggatactcctattattcgtggttctgcactcggtgctttgaacggtgttgagaagtgggtagactctgtaatggagctcatggatactgttgacacttggattgaagagccagagcgtgagattgacaagccattcttgatgcctgttgaggacgtattctctatcacaggtcgtggtactgtagctactggtcgtatcgagactggtatctgtaaggtaggtgatgaggttcagttgctcggtctcggtgaggacaagaagtctgttatcactggtgttgagatgttccgtaagaaccttccaacaggtcaggctggtgacaacgtaggtctcctccttcgtggtatcgataaggctgaggttaagcgtggtatggttgttgtgcacccaggtgctattactcctcacgatcacttcaaggcatctatctatgtattgaagaaggaagagggtggtcgtcatactccattcggtaacaagtatcgtccacagttctacctccgtacaatggactgtacaggtgaaatccacctcccagagggcgttgagatggttatgccaggtgacaacgtagagattgaagttgtattgatctataaggttgctttgaacgagggtcttcgtt

SEQ ID NO: 144 - DNA, 827 bp, Prevotella oralis
  ref <308>: DATABASE ACCESSION NUMBER: ATCC 33269
tggtgctattcttgtagtagctgctactgacggtcctatgcctcaaactcgtgaacacgtgcttcttgctcgtcaggtgaacgtacctcgtttggtcgttttcttgaacaagtgcgatatggttgacgatgaagaaatgcttgagctcgtagaaatggagcttcatgaacttctcgagcagtatgaatatgaggaggatactcctattgttcgtggttcggcacttggcgctctgaatggagtagagaagtgggttgacagcgtgatgaagttgatggataccgttgatgaatggatacaggaaccaccgcgtgatcttgataagcctttcttgatgccggtagaggatgtattttctattactggtcgtggaacggttgttacaggccgtattgaaactggtaaggttaaggtgggcgatgaagttcaacttcttggtctcggtgaagataagaagtccgttgtgacaggcgttgagatgttccgtaagattcttgacgaaggtgaagctggtgataatgtaggcttgctgcttcgtggtatcgataagacggaagtaaagcgtggtatggttgtcgtacatccgggggctattactcctcacgatcatttcaaggcttcagtttacgtattgaagaaagaagaaggcggtcgccatactccgtttggtamcaagtatcgtccacagttctatcttcgtaccatggactgtactggtgaaattactcttccggaaggagttgagatggtaatgccgggtgataacgtcgaaattgaagttaagttgatctatccggtagctttgaacgagggacttcgtttcgcta

SEQ ID NO: 145 - DNA, 833 bp, Propionibacterium acnes
  ref <308>: DATABASE ACCESSION NUMBER: ATCC 6919
cggcgccatcctcgtggttgctgctaccgacggcccgatgcctcagactcgcgagcacgttctgctcgctcgtcaggtgggcgtgcccgccatcgtcgtcgccctcaacaagtgcgacatggttgacgatgaggagctcattgagctcgtcgagatggaggtccgcgagctgctgacctcgcaggagttcgacggcgacaactgccctgtcgttcgcatctccgccttccaggccctccagggtgatgagaagtggacccagtcgatcctcgacctcatggacgccgtggacgagtacatcccgcagcctgagcgcgatctcgacaagcccttccttatgccgatcgaggacgtcttcaccatcaccggccgtggcaccgttgtcaccggtcgtgtcgagcgcggcgtcgtcaagactggcgaagaggtcgagatcgtcggtatccacgagaagacccagaagaccaccgttaccggtgtcgagatgttccgcaagatcctcgacgagggccgcgctggtgagaacgtcggcgttctgctccgtggcaccaagaaggaggatgtcgttcgcggcatggtcctctccaagcctggttccaccaccccccacaccgacttcgagggccaggtctacgtcctcaagaaggatgagggtggccgccacaagccgttcttctcccactacagcccccagttctacttccgtaccacggacgtgactggcactgttgagctccccgagggcaccgagatggtcatgcctggcgacaacaccgacatgactgtgcacctgattcacccggttgccatggaggatcagctcaagttcgcta

SEQ ID NO: 146 - DNA, 745 bp, Proteus mirabilis
  ref <308>: DATABASE ACCESSION NUMBER: ATCC 35659
cacaaactcgtgagcacatcctgttaggtcgtcaggttggtgttccttacatcatcgtattcctgaacaaatgtgacatggtagatgatgaagagctgttagaattagttgaaatggaagttcgtgaacttctgtctcaatacgatttcccaggtgatgacactccagtaatccgtggttcagcgctgaaagcactggaaggcgaagcagagtgggaagcaaaaattgttgaattagcagaagcactggattcttatatcccagagccagagcgtgcaattgacaaaccattcctgttaccaatcgaagatgtattctcaatctcaggccgtggtacagtagttactggtcgtgtagagcgtggtatcatcaaagtaggtgatgaagttgagattgttggtatcaaagaaaccgccaaaacaacttgtactggcgttgaaatgttccgtaaattacttgacgaaggtcgtgcaggtgagaacgtaggtgttctgctgcgtggtacaaaacgtgaagaaatcgaacgtggacaagtactggcraaaccaggctcaatcaacccacacaacaaatttgaatcagaagtttatattctgagcaaagatgaaggtggtcgtcacactccattcttcaaaggctaccgtccacagttctacttccgtacaactgacgtaactggtactatcgaattaccagaaggcgtagaaatggtaatgccaggcgacaacgtgaacatgatcgttga

SEQ ID NO: 147 - DNA, 829 bp, Proteus penneri
  ref <308>: DATABASE ACCESSION NUMBER: ATCC 33519
ggagctatcctggttgttgctgcgacagatggcccaatgccacaaactcgtgagcacatcctgttaggtcgtcaggttggtgttccttacatcatcgtattcctgaacaaatgtgacatggtagatgatgaagagttactggaattagtmgaaatggaagttcgtgaacttctgtctcagtacgatttcccaggtgatgacactccagtaatccgtggttcagcgctgaaagcactggaaggcgaagcagagtgggaagcaaaaattgttgaattagcagaagcactggattcatacatcccagarccagagcgtgcaattgacaaaccattcctgttaccaattgaagacgtattctcaatttcaggccgtggtacagtagtaacaggtcgtgttgagcgtggcgtaatcaaagttggtgaagaagttgaaatcgttggtattaaaccaacagcgaaaacaacttgtactggcgttgaaatgttccgtaaattacttgacgaaggtcgtgcaggtgagaacgtaggtgttcttctgcgtggtactaaacgtgaagaaatcgaacgtggacaagtactggcgaaaccaggttcaatcaacccacacactaaatttgaatcagaagtttatattctgagcaaagatgaaggtggtcgtcatactccattcttcaaaggctaccgtccacagttctacttccgtacaactgacgtaactggtactatcgaattaccagaaggcgtagaaatggtaatgccaggtgacaacatcaacatgatcgttgaactgattcacccaatcgcgatggacgacggtttacgtttcgcta

SEQ ID NO: 148 - DNA, 824 bp, Proteus vulgaris
  ref <308>: DATABASE ACCESSION NUMBER: ATCC 13315
cggagctattctggttgttgctgcgactgatggcccaatgccacaaactcgtgagcacatcctgttaggtcgccaggttggtgtaccttacatcatcgtattcctgaacaaatgtgacatggttgatgatgaagaactgctggaattagtagaaatggaagttcgtgaacttctgtctcagtacgatttcccaggtgatgacactccagtaatccgtggttcagcgctgaaagcactggaaggcgaagctgagtgggaagcaaaaattgttgaattagcagaagcactggattcttacatcccagaaccagagcgtgcaattgacaaaccattcctgctgcctatcgaagacgtattctcaatctctggtcgtggtacagtagtaacaggccgtgtagagcgtggtgttgttaaagttggtgaagaagttgagattgttggtattaaagacacagttaaaacaacttgtactggcgttgaaatgttccgtaaattacttgacgaaggtcgtgcaggtgagaacgtaggtgttcttctgcgtggtactaaacgtgaagaaatcgaacgtggacaagtactggctaaaccaggttcaatcaagccacacactaaattcgaatcagaagtttatatcctgagcaaagatgaaggtggtcgtcacactccattcttcaaaggttaccgtccacagttctacttccgtacaactgacgtaactggtactatcgaattaccagaaggcgtagaaatggtaatgccaggtgacaacatcaacatgatcgttgaactgattcaccctatcgcgtaggacgacggtttacgtt

SEQ ID NO: 149 - DNA, 745 bp, Providencia alcalifaciens
  ref <308>: DATABASE ACCESSION NUMBER: ATCC 9886
cacaaactcgtgagcacatcctgttaggtcgccaagtaggtgttccttacatcatcgttttcctgaacaaatgtgacatggtagacgacgaagaactgttagaattagttgaaatggaagttcgtgaacttctgtctcagtacgatttcccaggcgatgacactccagttgttcgcggttcagcactgaaagcgctggaaggcaacccagagtgggaagcaaaaattgttgaattagcaggttacctggattcttacatcccagaaccagagcgtgcaattgacaagccattcctgctgccaatcgaagacgtattctcaatctctggtcgtggtacagtagtaacaggccgtgttgagcgtggtatcatcaaagttggtgaagaagttgaaatcgttggtattcaagcgactgcgaaaacaacttgtactggcgttgaaatgttccgtaaactgctggatgaaggtcgtgcgggtgagaacgttggtgttctgctgcgtggtactaaacgtgaagaaattcaacgtggtcaagtactggctaaaccaggttcaatcaagccacacactcaattcgaatcagaagtatatattctgagcaaagatgaaggtggtcgtcatactccattcttcaaaggctaccgtccacagttctacttccgtacaactgacgtaaccggtactatcgaactgccagaaggcgtagagatggtaatgccaggcgacaacatcaacatgatcgtgac

SEQ ID NO: 150 - DNA, 830 bp, Providencia rettgeri
  ref <308>: DATABASE ACCESSION NUMBER: ATCC 9250
cggtgcaatcctggttgttgctgcgactgatggcccaatgccacaaactcgtgagcacatcctgttaggycgccaagtaggtgtwccttacatcatcgttttcctgaacaaatgtgacatggtagacgacgaagaactgttagaattagttgaaatggaagttcgtgaacttctgtctcaatacgatttcccaggcgacgacactccagttgtccgtggttcagctctgaaagcgctggaaggcaacccagagtgggaagcgaaaattgttgaattagcaggtcacttggattcttacatcccagaaccagagcgtgcaattgacaaaccattcctgctgccaatcgaagacgtattctcaatctctggtcgtggtacagtagtaacaggccgtgttgagcgtggtatcatcaaagttggtgaagaagttgaaatcgttggtatccaagacacggttaaaacaacttgtactggcgttgaaatgttccgtaaactgctggacgaaggtcgtgcgggtgagaacgttggtgttctgctgcgtggtactaaacgtgaagaaattcaacgtggtcaagtactggcaaaaccaggttcaatcaagccacacactaaattcgaatcagaagtctatattctgagcaaagatgaaggtggtcgtcacactccattcttcaaaggttaccgtccacagttctacttccgtacaactgacgtaacaggtactatcgaactgccagaaggcgtagagatggtaatgccaggtgataacatcaacatgatcgttaccctgatccacccaatcgcgatggacgacggtttacgtttcgcaa

SEQ ID NO: 151 - DNA, 826 bp, Providencia rustigianii
  ref <308>: DATABASE ACCESSION NUMBER: ATCC 33673
cggtgcaatcctggttgttgctgcgactgatggcccaatgccacaaactcgtgagcacatcctgttaggtcgccaagtaggtgttccttacatcatcgttttcctgaacaaatgtgacatggttgacgacgaagaactgttagaattagttgaaatggaagttcgtgaacttctgtctcagtacgatttcccaggcgacgacactccagttgttcgyggttcagcactgaaagcgctggaaggtatccctgagtgggaagcgaaaattgttgaattagccggttacctggacagctacatcccagaaccagagcgcgcaattgaccgtccattcctgctgccaatcgaagacgtattctcaatctctggtcgtggtacagtagtaacaggscgtgttgagcgtggtatcgttaaagttggtgaagaagttgaaatcgttggtatccaagacacrgttaaaacaacttgtactggcgttgaaatgttccgtaaactgcttgacgaaggtcgtgctggtgagaacgttggtgttttactgcgtggtactaagcgtgaagaaattcaacgtggtcaagtactggctaaaccaggttcaatcaagccacacactacttttgaatcagaagtttatattctgagcaaagatgaaggtggtcgtcatactccattcttcaaaggctaccgtccacagttctacttccgtacaactgacgtaaccggtactatcgaactgccagaaggcgtagagatggtaatgccaggcgacaacatcaacatgatcgtgacactgattcacccaatcgcgatggatgatggtttacgtttc

SEQ ID NO: 152 - DNA, 830 bp, Providencia stuartii
  ref <308>: DATABASE ACCESSION NUMBER: ATCC 33672
cggtgcaatcctagttgttgcggcaacagatggcccaatgccacaaactcgtgagcacatcctgttaggtcgtcaggttggcgttccttacatcatcgtgttcctgaacaaatgtgacatggtagacgacgaagagctgctggaactggttgaaatggaagttcgtgaacttctgtctcaatacgatttcccaggtgatgacactccagttatccgtggttcagcgctgaaagcgttggaaggcaacccagagtgggaagcgaaaatcgttgaactagcagaagcactggacagctacatcccagagccagagcgtgcaattgacaagccattcctgctgccaatcgaagacgtattctcaatctcaggtcgtggtacagtagtcacaggccgtgttgagcgtggtatcatcaaagttggtgaagaagttgaaatcgtaggtatcaaagagactgcgaaaaccacttgtactggcgttgaaatgttccgtaaactgctggacgaaggccgtgcgggtgagaacgtaggtgttctgctgcgtggtactaagcgtgaagaaatcgaacgtggtcaagttctggcgaaaccaggttcaatcaagccacacacaactttcgaatcagaagtttatattctgagcaaagatgaaggtggtcgtcacacgccattcttcaaaggytaccgtccacagttctacttccgtacaactgacgtaacaggtactatcgaactgccagaaggcgtagagatggtaatgccaggcgacaacgtgaacatgaaagtaactctgattcacccaatcgcgatggacgatggtttgcgtttcgcaa

SEQ ID NO: 153 - DNA, 827 bp, Pseudomonas aeruginosa
  ref <308>: DATABASE ACCESSION NUMBER: ATCC 35554
cctggtttgctcggctgccgacggccccatgccgcagacccgcgagcacatcctgctgtcccgccaggtaggcgttccctacatcgtcgtgttcctgaacaaagccgacatggtcgacgacgccgagctgctggaactggtcgagatggaagttcgcgatctgctgaacacctacgacttcccgggcgacgacactccgatcatcatcggttccgcgctgatggcgctggaaggcaaggatgacaacggcatcggcgtaagcgccgtgcagaagctggtagagaccctggactcctacattccggagccggttcgtgccatcgaccagccgttcctcatgccgatcgaagacgtgttctcgatctccggtcgcggtaccgtggtaaccggtcgtgtagagcgcggcatcatcaaggtccaggaagaagtggaaatcgtcggcatcaaggcgaccaccaagaccacctgcaccggcgttgaaatgttccgcaagctgctcgacgaaggtcgtgctggtgagaacgttggtatcctgctgcgtggcaccaagcgtgaagacgtagagcgtggccaggtactggccaagccgggcaccatcaagccgcacaccaagttcgagtgcgaagtgtacgtgctgtccaaggaagaaggtggtcgtcacaccccgttcttcaagggctaccgtccgcagttctacttccgtaccackgacgtgaccggtamctgcgagctgccggaaggcgtagagatggtaatgccgggcgacaacatcaagatggttgtcaccctgatcgctccgatcgccatggaagatggctgcgttcgcg

SEQ ID NO: 154 - DNA, 841 bp, Pseudomonas fluorescens
  ref <308>: DATABASE ACCESSION NUMBER: ATCC 13525
cggcgcaatcctggtttgctcggccgctgatggtccgatgccacaaacccgtgaacacatcctgctgtcccgtcaggttggcgttccgtacatcgtggtttacctgaacaaggctgacctggtagacgacgctgagctgctggaactggttgagatggaagtgcgcgatctgctgagcacttacgacttcccaggcgacgacactccgatcatcatcggttctgctcgtatggctctggaaggcaaagacgacaacgaaatgggcaccacgtccgttcgtaaactggttgaaactctggacagctacatcccagatccagttcgtgttatcgacaagccgttcctgatgccaatcgaagacgtgttctcgatctccggtcgcggtactgttgtgactggtcgtatcgagcgcggtatcgttaaggttcaagatccactggaaatcgttggtctgcgtgacactaccgtcaccacctgcaccggtgttgaaatgttccgtaagctgctcgacgaaggtcgtgctggcgagaactgcggcgttctgctgcgtggtaccaagcgtgacgacgttgagcgtggccaggttctggttaagccaggttcggttaagccgcacaccaagttcgaagctgaagtctacgtactgagcaaagaagaaggcggtcgtcacactccgttcttcaaaggctaccgtccacagttctacttccgtactactgacgtgactggtaactgcgagctgccggaaggcgttgaaatggttatgccaggcgacaacatcaaaatggttgttaccctgatcaaaaccatcgcaatggaagacggtctgcgtttcgctatt

SEQ ID NO: 155 - DNA, 841 bp, Pseudomonas stutzeri
  ref <308>: DATABASE ACCESSION NUMBER: ATCC 17588
cggcgcgatcctggtctgctcggctgctgacggccccatgccgcagactcgcgagcacatcctgctgtcccgtcaggttggtgttccgtacatcgtcgtgttcctgaacaaggccgacatggttgatgacgccgagctgctcgagctggtcgagatggaagttcgygacctgctgtcgacctacgacttcccgggtgaygacactccgatcatcatcggctccgcgctgatggcgctgaacggcgaagacgacaacgagctcggcaccactgcggtgaagaagctggtcgagaccctggacagctacattcccgagccggttcgtgccatcgacaagccgttcctgatgccgatcgaagacgtgttctcgatctccggtcgcggcacsgtggtaaccggtcgcgtagagcgcggcatcgtcaaggttcaggaagagatcgagatcgtcggtctgcgtccgaccaccaagactacctgcaccggcgttgagatgttccgcaagctgctcgaygarggtcgtgctggcgagaactgcggygtgctgctgcgtggcaccaagcgtgacgaagtggagcgtggtcaggttctggccaagccgggcaccatcaagccgcacaccaagttcgaagccgaagtgtacgtgctgtccaaggaagaaggtggtcgtcacaccccgttcttyaagggctaccgtcckcagttctacttccgtaccactgaygtgacyggwtcgtgcgarctgccggaaggcgtcgagatggtaatgccgggcgacaacgtgaagatggttgtcaccctgatcaagccgatcgccatggaagacggcctgcgcttcgcgatt

SEQ ID NO: 156 - DNA, 833 bp, Psychrobacter phenylpyruvicus
  ref <308>: DATABASE ACCESSION NUMBER: ATCC 23333
gctattctagtagtatcagcaactgacggtccaatgccacaaacacgtgagcacattctattatcacgtcaggttggtgtaccatacatcatcgtattcatgaacaaatgtgacatggtagatgacgaagagttactagagctagtagaaatggaagtgcgtgaattactttcagactacgacttcccaggtgatgacactccaatcatcaaaggttcagctttagaagcgttaaatggtaacgacggtaagtacggtgagccagcagttatcgaactactaaacactctagacacttacattccagagccagagcgtgacatcgataagccattcctaatgccaatcgaagacgtattctcaatctcaggtcgtggtacagtagtaacaggccgtgttgaatctggtatcatcaaagttggtgacgaaatcgaaatcgttggtatcaaagacacagttaaaacaacttgtactggtatcgagatgttccgtaagttactagacgaaggtcgtgctggtgagaactgtggtgtactattacgtggtactaagcgtgaagacgtacaacgtggtcaagtacttgctaagccaggttcaatcactccacacaccaacttcgacgcagaagtatacgtactatcaaaagaagaaggtggtcgtcacactccattcttaaatggttaccgtccacagttctacttccgtactactgacgtaacaggtgcaatcacgttacaagaaggtactgaaatggtaatgccaggcgataacgttgagatgagcgtagagctaatccacccaatcgctaggacaaaggtttacgtttcgcaatc

SEQ ID NO: 157 - DNA, 825 bp, Rahnella aquatilis
  ref <308>: DATABASE ACCESSION NUMBER: ATCC 33071
ggcgctatcctggttgttgctgcaactgacggccctatgcctcagactcgtgagcacatcctgctgggtcgccaggttggcgttccatacatgatcgtgttcatgaacaaatgcgacatggtagatgacgaagagctgctggaactggtagaaatggaagttcgcgaacttctgtctgcttacgaattcccaggcgacgacatcccggtcatcaaaggttcagcgctgaaagcactggaaggcgatgctacttgggaagcgaaaatcatcgaactggcagaagcactggacagctacattccattgccagagcgtgctatcgataagccattcctgctgccaatcgaagacgtattctccatctccggtcgtggtacagtggttaccggtcgtgtagagcgcggtatcgttaaagtgggcgaagaagttgaaatcgtcggtatcaaggacactgttaagtctacttgtactggcgttgaaatgttccgcaaactgctggacgaaggccgtgcgggcgagaacgtgggtgttctgctgcgtggtatcaagcgtgaagacatcgaacgtggtcaggttctggctaaaccaggttcaatcaaaccacacaccaagtttgattccgaagtgtacatcctgagcaaagatgaaggtggtcgtcacactccattcttcaaaggctaccgtccacagttctacttccgtacaactgacgtgaccggtactatcgaactgccagaaggcgttgagatggttatgcctggtgacaacgtgaacatggttgttaccctgatccacccaatcgcgatggatgacggtctgcgtttc

SEQ ID NO: 158 - DNA, 830 bp, Salmonella choleraesuis subsp. arizonae
  ref <308>: DATABASE ACCESSION NUMBER: ATCC 13314
cggcgcgatcctggttgttgctgcgactgacggcccgatgccgcagacccgtgagcacatcctgctgggccgtcaggtaggcgttccgtacatcatcgtgttcctgaacaaatgcgacatggttgatgacgaagagctgctggaactggttgaaatggaagttcgtgaacttctgtctcagtacgacttcccgggcgacgatacgccgatcgttcgtggttctgctctgaaagcgctggaaggcgacgcagagtgggaagcgaaaatcatcgaactggctggcttcctggactcttacatcccggaaccagagcgtgcgattgacaagccgttcctgctgccgatcgaagacgtattctccatctccggtcgtggtaccgttgttaccggtcgtgtagaacgcggtatcatcaaagtgggcgaagaagttgaaatcgttggtatcaaagagactcagaagtctacctgtactggcgttgaaatgttccgcaaactgctggacgaaggccgtgccggtgagaacgtaggtgttctgctgcgtggtatcaaacgtgaagaaatcgaacgtggtcaggtactggctaagccgggcaccatcaagccgcacaccaagttcgaatctgaagtgtacattctgtccaaagatgaaggcggccgtcatactccgttcttcaaaggctaccgtccgcagttctacttccgtactactgacgtgactggcaccatcgaactgccggaaggcgtggagatggtaatgccgggcgacaacatcaaaatggttgttaccctgatccacccgatcgcgatggacgacggtctgcgtttcgcaa

SEQ ID NO: 159 - DNA, 832 bp, Salmonella choleraesuis subsp. choleraesuis
  ref <308>: DATABASE ACCESSION NUMBER: ATCC 7001
cggcgcgatcctggttgttgctgcgactgacggyccgatgccgcagacccgtgagcacatcctgctgggtcgtcaggtaggcgttccgtacatcatcgtgttcctgaacaaatgcgacatggttgatgacgaagagctgctggaactggttgaaatggaagttcgtgaacttctgtctcagtacgacttcccgggcgacgacacgccgatcgttcgtggttctgctctgaaagcgctggaaggtgacgcagagtgggaagcgaaaatcatcgaactggctggcttcctggattcttacattccggaaccagagcgtgcgattgacaagccgttcctgctgccgatcgaagacgtattctccatctccggtcgtggtaccgttgttaccggtcgtgtagagcgcggtatcatcaaagtgggygaagaagttgaaatcgttggtatcaaagagactcagaagtctacctgtactggcgttgaaatgttccgcaaactgttggacgaaggccgtgccggtgagaacgtaggtgttctgctgcgtggtatcaaacgtgaagaaatcgaacgtggtcaggtactggctaagccgggcaccatcaagccgcacaccaagttcgaatctgaagtgtacattctgtccaaagatgaaggcggccgtcatactccgttcttcaaaggctaccgtccgcagttctacttccgtactactgacgtgactggcaccatcgaactgccggaaggcgtagagatggtaatgccgggcgacaacatcaaaatggttgttaccctgatccacccgatcgcaatggacgacggtctgcgtttcgcaatc

SEQ ID NO: 160 - DNA, 807 bp, Salmonella choleraesuis subsp. diarizonae
  ref <308>: DATABASE ACCESSION NUMBER: ATCC 43973
cctggttgttgctgcgactgacggcccgatgccgcagacccgtgagcacatcctgctgggtcgtcaggtaggcgttccgtacattatcgtgttcctgaacaaatgcgacatggttgatgacgaagagctgctggaactggtagaaatggaagttcgtgaacttctgtctcagtacgacttcccgggcgacgacacgccaatcgttcgtggttctgctctgaaagcgctggaaggcgacgcagagtgggaagcgaaaatcatcgaactggctggcttcctggattcttacatcccggaaccagagcgtgcgattgacaagccgttcctgctgccgatcgaagacgtattctccatctccggtcgtggtaccgttgttaccggtcgtgtagagcgcggtatcatcaaagtgggcgaagaagttgaaatcgttggtatcaaagagactcagaagtctacctgtactggcgttgaaatgttccgcaarctgctggacgaaggccgtgcwggtgagaacgtaggtgttctgctgcgtggtatcaaacgtgaagaaatcgaacgtggtcaggtactggctaagccgggcaccatcaagccgcacaccaagttcgaatctgaagtgtatattctgtccaaagatgaaggcggccgtcatactccgttcttcaaaggctaccgtccgcagttctacttccgtaccactgacgtgactggcaccatcgaactgccggaaggcgtggagatggtaatgccgggcgacaacatcaaaatggttgttaccctgatccacccgatcgcgatggacgacgg

SEQ ID NO: 161 - DNA, 832 bp, Salmonella choleraesuis subsp. choleraesuis
  ref <308>: DATABASE ACCESSION NUMBER: ATCC 8326
cggcgcgatcctggttgttgctgcgactgacggcccgatgccgcagacccgtgagcacatcctgctgggtcgtcaggtaggcgttccgtacatcatcgtgttcctgaacaaatgcgacatggttgatgacgaagagctgctggaactggttgaaatggaagttcgtgaacttctgtctcagtacgacttcccgggcgacgacactccgatcgttcgtggttctgctctgaaagcgctggaaggcgacgcagagtgggaagcgaaaatcatcgaactggctggcttcctggattcttacatcccggaaccagagcgtgcgattgacaagccgttcctgctgccgatcgaagacgtattctccatctccggtcgtggtaccgttgttaccggtcgtgtagaacgcggtatcatcaaagtgggcgaagaagttgaaatcgttggtatcaaagagactcagaagtctacctgtactggcgttgaaatgttccgcaaactgctggacgaaggccgtgccggtgagaacgtaggtgttctgctgcgtggtatcaaacgtgaagaaatcgaacgtggtcaggtactggctaagccgggcaccatcaagccgcacaccaagttcgaatctgaagtgtacattctgtccaaagatgaaggcggccgtcayactccgttcttcaaaggctaccgtccgcagttctacttccgtactactgacgtgactggcaccatcgaattgccggaaggcgtagagatggtaatgccgggcgacaacatcaaaatggttgttaccctgatccacccgatcgcgatggacgacggtctgcgtttcgcaatc

SEQ ID NO: 162 - DNA, 807 bp, Salmonella choleraesuis subsp. houtenae
  ref <308>: DATABASE ACCESSION NUMBER: ATCC 43974
cctggttgttgctgcgactgacggcccgatgccgcagacccgtgagcacatcctgctgggtcgtcaggtaggcgttccgtacatcatcgtgttcctgaacaaatgcgacatggttgatgacgaagagctgctggaactggtagaaatggaagttcgtgaacttctgtctcagtacgatttcccgggcgacgacacgccgatcgtgcgtggttctgctctgaaagcgctggaaggcgacgcagaatgggaagcgaaaatcatcgaactggctggctacctggattcttacatcccggaaccagagcgtgcgattgacaaaccgttcctgctgccgatcgaagacgtattctctatctccggtcgtggtaccgttgttaccggtcgtgtagagcgcggtatcatcaaagtgggcgaagaagttgaaatcgttggtatcaaagagactcagaagtcgacctgtactggcgttgaaatgttccgcaaactgctggacgaaggccgtgctggcgagaacgtaggtgttctgctgcgtggtatcaaacgtgaagaaatcgaacgtggtcaggtactggctaagccgggcaccatcaagccgcacaccaagttcgaatctgaagtgtacattctgtccaaagatgaaggcggccgtcatactccgttcttcaaaggctaccgtccgcaattctacttccgtacgactgacgtgactggcaccatcgaactgccggaaggcgtggagatggtaatgccgggcgacaacatcaaaatggttgttaccctgatccacccgatcgcgatggacgacgg

SEQ ID NO: 163 - DNA, 827 bp, Salmonella choleraesuis subsp. indica
  ref <308>: DATABASE ACCESSION NUMBER: ATCC 43976
cgcgatcctggttgttgctgcgactgacggcccgatgccgcagacccgtgagcacatcctgctgggtcgtcaggtaggcgttccgtacatcatcgtgttcctgaacaaatgcgacatggttgatgacgaagagctgctggaactggttgaaatggaagttcgtgaacttctgtctcagtacgacttcccgggtgacgacacgccgatcgtgcgtggttctgctctgaaagcgctggaaggcgacgcagagtgggaagcgaaaatcatcgaactggctggcttcctggattcttacattccggaaccagagcgtgcgattgacaagccgttcctgctgccgatcgaagacgtattctccatctccggtcgtggtacygttgttaccggtcgtgtagagcgcggtatcatcaaagtgggcgaagaagttgaaatcgttggtatcaaagagactcagaagtctacctgtactggcgttgaaatgttccgcaaactgctggacgaaggccgtgccggtgagaacgtaggtgttctgctgcgtggtatcaaacgtgaagaaatcgaacgtggtcaggtactggctaagccgggcaccatcaagccgcacaccaagttcgaatctgaagtgtacattctgtccaaagatgaaggcggccgtcatactccgttcttcaaaggctaccgtccgcagttctacttccgtactactgacgtgactggcaccatcgaactgccggaaggcgtagagatggtaatgccgggcgacaacatcaaaatggttgttaccctgatccatccgatcgcratggacgacggtctgcgtttcgcaa

SEQ ID NO: 164 - DNA, 807 bp, Salmonella choleraesuis subsp. salamae
  ref <308>: DATABASE ACCESSION NUMBER: ATCC 43972
cctggttgttgctgcgactgacggcccgatgccgcagacccgtgagcacatcctgctgggtcgtcaggtaggcgttccgtacatcatcgtgttcctgaacaaatgcgacatggttgatgacgaagagctgctggaactggtagaaatggaagttcgtgaacttctgtctcagtacgacttcccgggcgacgacacgccgatcgtgcgtggttccgctctgaaagcgctggaaggcgamgctgagtgggaagmgaaaatcatcgaactggctggctwcctggattcttacattccggaaccagagcgtgcgattgacaagccgttcctgctgccgatcgaagacgtattctccatctccggtcgtggtaccgttgttaccggtcgtgtagagcgcggtatcatcaaagtgggcgaagaagttgaaatcgttggtatcaaagagactcagaagtctacctgtactggcgttgaaatgttccgcaaactgctggacgaaggccgtgccggtgagaacgtaggtgttctgctgcgtggtatcaaacgtgaagaaatcgaacgtggtcaggtactggctaagccgggcaccatcaagccgcacaccaagttcgaatctgaagtgtacattctgtccaaagatgaaggcggccgtcatactccgttcttcaaaggctaccgtccgcagttctacttccgtaccactgacgtgactggcaccatcgaactgccggaaggcgtggagatggtaatgccgggcgacaacatcaaaatggttgttaccctgatccacccgatcgcgatggacgacgg

SEQ ID NO: 165 - DNA, 832 bp, Salmonella choleraesuis subsp. choleraesuis
  misc_feature (1)...(832): n=a,t,c or g
  ref <308>: DATABASE ACCESSION NUMBER: ATCC 10749
cggcgcgatcctggttgttgctgcgactgacggcccgatgccgcagacccgtgagcacatcctgctgggtcgtcaggtaggcgttccgtacatcatcgtgttcctgaacaaatgcgacatggttgatgacgaagagctgctggaactggttgaaatggaagttcgtgaacttctgtctcagtacgacttcccgggcgacgacacgccgatcgttcgtggttctgctctgaaagcgctggaaggcgacgcagagtgggaagcgaaaatcatcgaactggctggcttcctggattcttacatcccggaaccagagcgtgcgattgacaagccgttcctgctgccgatcgaagacgtattctccatctccggtcgtggtaccgttgttaccggtcgtgtagaacgcggtatcatcaaagtgggcgaagaagttgaaatcgttggtatcaaagagactcagaagtctacctgtactggcgttgaaatgttccgcaaactgctggacgaaggccgtgcnggtgagaacgtaggtgttctgctgcgtggtatcaaacgtgaagaaatcgaacgtggtcaggtactggctaagccgggcaccatcaagccgcacacyaagttcgaatctgaagtgtacattctgtccaaagatgaaggcggccgtcatactccgttcttcaaaggctaccgtccgcagttctacttccgtactactgacgtgactggcaccatcgaactgccggaaggcgtagagatggtaatgccgggcgacaacatcaaaatggttgttaccctgatccacccgatcgcaatggacgacggtctgcgtttcgcaatc

SEQ ID NO: 166 - DNA, 817 bp, Serratia fonticola
  DSM 4576
cggcgctatcctggttgtagctgcgactgacggccctatgcctcagactcgtgagcacatcctgctgggtcgtcaggttggcgttccttacatcatcgtattcatgaacaaatgcgacatggttgatgatgaagagctgctggaactggtagaaatggaagttcgtgaacttctgtctgcttatgacttccctggtgatgacctgccggttgttcgtggttcagcgctgaaagcactggaaggcgaagctgagtgggaagctaaaatcatcgagctggccggtcacctggattcctacatcccagaaccagagcgtgctatcgatcagccgttcctgctgccaatcgaagacgtattctccatctccggtcgtggtaccgtagttaccggtcgtgttgagcgcggtatcgttaaagttggcgaagaagttgaaatcgttggtatcaaagacaccgttaagtctacctgtactggcgttgaaatgttccgcaaactgctggacgaaggccgtgctggtgagaacgttggtgttctgctgcgtggtatcaagcgtgaagacatcgaacgtggtcaggtactggctaaaccaggttccatcaagccgcacactcagttcgattcagaagtgtatatcctgagcaaagaagaaggtggtcgtcatactccattcttcaaaggctaccgtccacagttctacttccgtacaactgacgtgaccggtaccatcgaactgccagaaggcgtagagatggtaatgccaggcgataacgtgaacatggttgttaccctgatccacccaatcgctatggaccaaggc

SEQ ID NO: 167 - DNA, 787 bp, Serratia liquefaciens
  ref <308>: DATABASE ACCESSION NUMBER: ATCC 27592
gctgcgactgacggcccaatgcctcagacccgtgagcacatcctgctgggtcgtcaggttggcgttcctttcatcatcgtattcatgaacaaatgcgacatggttgatgatgaagagctgctggaactggtagaaatggaagttcgtgaacttctgtctgcttacgacttccctggtgatgacctgccggttgttcgtggttcagcgctgaaagcactggaaggcgaagctgagtgggaagctaaaatcatcgagctggccggttacctggattcttacatcccagaaccagagcgtgctatcgacaagccgttcctgctgccaatcgaagacgtcttctccatctccggtcgtggtaccgttgttaccggtcgtgttgagcgcggtatcgttaaagttggcgaagaagttgaaatcgttggtatcaaagacaccgttaagtctacctgtactggcgttgaaatgttccgcaaactgctggacgaaggccgtgctggtgagaacgttggtgttctgctgcgtggtatcaagcgtgaagacatcgaacgtggtcaggtactggctaaaccaggttcaatcaagccacacaccaagttcgactcagaagtgtacatcctgagcaaagaagaaggtggtcgtcatactccattcttcaaaggctaccgtccacagttctacttccgtacaactgacgtgaccggtaccatcgaactgccagaaggcgttgaaatggtaatgccaggtgacaacgtgaacatggttgttaccctgatccacccaatcgcga

SEQ ID NO: 168 - DNA, 745 bp, Serratia marcescens
  ref <308>: DATABASE ACCESSION NUMBER: ATCC 13880
gcctcagactcgtgagcacatcctgctgggtcgtcaggttggcgttcctttcatcatcgtattcatgaacaaatgcgacatggttgatgatgaagagctgytggaactggtagaaatggaagttcgcgaactgctgtccgcttacgacttccctggcgacgacctgccggtaatccgcggttccgcgctgaaagcgctggaaggcgaagctgagtgggaagcgaaaatcatcgaactggccgaagccctggacagctacatcccagagccagagcgtgctatcgacaagccgttcctgctgccaatcgaagacgtattctccatctccggtcgtggtaccgttgttaccggtcgtgttgagcgcggcatcatcaaagttggcgaagaagttgaaatcgttggtatcaaagacaccgttaagtctacctgtactggcgttgaaatgttccgcaaactgctggacgaaggccgtgctggtgagaacgtaggtgttctgctgcgtggtatcaaacgtgaagaaatcgaacgtggtcaggtactggctaagccaggctccatcaagccgcacacccagttcgaatctgaagtgtacatcctgagcaaagatgaaggtggtcgtcacackccattcttcaaaggctaccgtccacagttctacttccgtaccactgacgtgaccggtaccatcgaactgccagaaggcgtagagatggtaatgccaggcgacaacgtgaacatggttgta

SEQ ID NO: 169 - DNA, 829 bp, Serratia odorifera
  ref <308>: DATABASE ACCESSION NUMBER: ATCC 33077
ggcgcaatcctggttgttgctgcgactgacggccctatgcctcagacccgtgagcacatcctgctgggtcgccaggttggcgttcctttcatcatcgtgttcatgaacaaatgtgacatggttgatgacgaagagctgctggaactggtagaaatggaagttcgcgagctgctgtctgcttacgatttccctggcgacgacctgccagtaatccgcggttctgcgctgaaagcgctggaaggcgaagcagagtgggaagctaagattgtagaactggctgaagcgctggattcttacatcccagaaccagagcgtgctatcgacaagccgttcctgctgccaatcgaagacgtattctccatctccggtcgtggtaccgttgttaccggtcgtgttgagcgcggtatcatcaaagttggcgaagaagttgaaatcgttggtatcaaagacaccgttaagtctacctgtaccggtgtagaaatgttccgcaaactgctggacgaaggccgtgctggtgagaacgttggtgttctgctgcgtggtatcaagcgtgaagacatcgaacgtggtcaggttctggctaaaccaggttctatcaagccgcacaccaaattcgactcagaagtgtacatcctgagcaaagaagaaggtggtcgtcacacgccattcttcaaaggctaccgtccacagttctacttccgtactactgacgtgaccggtaccatcgaactgccagaaggcgtagagatggtaatgccaggcgataacgtgaacatggttgttaccctgattcacccaatcgcaatggacgacggtctgcgtttcgcaa

SEQ ID NO: 170 - DNA, 830 bp, Serratia plymuthica
  DSM 4540
cggcgcaatcctggttgttgctgcgactgacggcccaatgcctcagacccgtgagcacatcctgctgggtcgtcaggttggcgttcctttcatcatcgtattcatgaacaaatgcgacatggttgatgatgaagagctgctggaactggtagaaatggaagttcgtgaacttctgtctgcttacgacttccctggtgatgacctgccggttgttcgtggttcagcgctgaaagcactggaaggcgaaccagagtgggaagctaaaatcatcgagctggctggtttcctggattcttacatcccagaaccagagcgtgctatcgacaagccgttcctgctgccaatcgaagacgtattctccatctccggtcgtggtaccgttgttaccggtcgtgttgagcgcggtatcgttaaagttggcgaagaagttgaaatcgtgggtatcaaagacaccgttaagtctacctgtaccggcgttgaaatgttccgcaaactgctggacgaaggccgtgctggtgagaacgtgggtgttctgctgcgtggtatcaagcgcgaagatatcgaacgtggtcaggtcctggctaaaccaggttcaatcaagccacacaccaagtttgactcagaagtgtacatcctgagcaaagaagaaggtggtcgtcatactccattcttcaaaggctaccgtccacagttctacttccgtacaactgacgtgaccggtaccatcgaactgccagaaggcgtagagatggtaatgccaggtgacaacgtgaacatggttgtaaccctgatccacccaatcgcgatggacgacggcctgcgtttcgcaa

SEQ ID NO: 171 - DNA, 829 bp, Serratia rubidaea
  ref <308>: DATABASE ACCESSION NUMBER: ATCC 27593
ggcgcaatcctggtagtagcagcgactgacggcccaatgcctcagacccgtgagcacatcctgctgggccgccaggtaggcgtaccttacatcatcgtattcatgaacaaatgcgacatggtagatgatgaagagctgctggaactggtagagatggaagttcgcgaactgctgtctgcttacgacttcccaggcgacgacctgccggtaatccgtggttccgcgctgaaagcgctggaaggcgaagccgagtgggaagcgaaaatcgttgagctggcagaagcgctggacagctacatcccagagccagagcgtgctgtagacaagccgttcctgctgccaatcgaagacgtattctccatctccggtcgtggtaccgttgttaccggtcgtgtagagcgcggtatcatcaaagttggtgaagaagtagaaatcgtaggtatcaaagacaccgttaagtctacctgtactggcgtagaaatgttccgcaaactgctggacgaaggccgtgctggtgagaacgtaggtgttctgctgcgtggtatcaagcgtgaagaaatcgaacgtggtcaggtactggcgaagccaggttcaatcaagccgcacacccagttcgaatctgaagtgtacattctgtccaaagacgaaggcggccgtcatactccgttcttcaaaggctaccgtccacagttctacttccgtacaactgacgtgaccggtaccatcgaactgccagaaggcgtagagatggtaatgccaggcgacaacgtgaacatgaaagttactctgattcacccaatcgcaatggacgacggtctgcgtttcgcaa

SEQ ID NO: 172 - DNA, 826 bp, Shigella boydii
  ref <308>: DATABASE ACCESSION NUMBER: ATCC 9207
cggcgcgatcytggtagttgctgcgactgacggcccgatgccgcagactcgtgagcacatcctgctgggtcgtcaggtaggcgttccgtacatcatcgtgttcctgaacaaatgcgacatggttgatgacgaagagctgctggaactggttgaaatggaagttcgtgaacttctgtctcagtacgacttcccgggcgacgacactccgatcgttcgtggttctgctctgaaagcgctggaaggcgacgcagagtgggaagcgaaaatcctggaactggctggcttcctggattcttacattccggaaccagagcgtgcgattgacaagccgttcctgctgccgatcgaagacgtattctccatctccggtcgtggtaccgttgttaccggtcgtgtagaacgcggtatcatcaaagttggtgaagaagttgaaatcgttggtatcaaagagactcagaagtctacctgtactggcgttgaaatgttccgcaaactgctggacgaaggccgtgctggtgagaacgtaggtgttctgctgcgtggtatcaaacgtgaagaaatcgaacgtggtcaggtactggctaagccgggcaccatcaagccgcacaccaagttcgaatctgaagtgtacattctgtccaaagatgaaggcggccgtcatactccgttcttcaaaggctaccgtccgcagttctacttccgtactactgacgtgactggtaccatcgaactgccggaaggcgtagagatggtaatgccgggcgacaacatcaaaatggttgttaccctgatccacccgatcgcgatggacgacggtctgcgtttc

SEQ ID NO: 173 - DNA, 818 bp, Shigella dysenteriae
  ref <308>: DATABASE ACCESSION NUMBER: ATCC 11835
tggtagttgctgcgactgacggcccgatgccgcagactcgtgagcacatcctgctgggtcgtcaggtaggcgttccgtacatcatcgtgttcctgaacaaatgcgacatggttgatgacgaagagctgctggaactggttgaaatggaagttcgtgaacttctgtctcagtacgacttcccgggcgacgacactccgatcgttcgtggttctgctctgaaagcgctggaaggcgacgcagagtgggaagcgaaaatcctggaactggctggcttcctggattcytayattccggaaccagagcgtgcgattgacaagccgttcctgctgccgatcgaagacgtattctccatctccggtcgtggtaccgttgttaccggtcgtgtagaacgcggtatcatcaaagttggtgaagaagttgaaatcgttggtatcaaagagacycagaagtctacctgtactggcgttgaaatgttccgcaaactgctggacgaaggccgtgctggtgagaacgtaggtgttctgctgcgtggtatcaaacgtgaagaaatcgaacgtggtcaggtactggcgaagccrggcaccatcaagccgcacaccaagttcgaatctgaagtgtacattctgtccaaagatgaaggcggccgtcatactccgttcttcaaaggctaccgtccgcagttctacttccgtactactgacgtgactggtaccatcgaactgccggaaggcgtagagatggtaatgccgggcgacaacatcaaaatggttgttaccctgatccacccgatcgcgatggacgacggtctgcgtttcgca

SEQ ID NO: 174 - DNA, 806 bp, Shigella flexneri
  ref <308>: DATABASE ACCESSION NUMBER: ATCC 12022
cctggtagttgctgcgactgacggcccgatgccgcagactcgtgagcacatcctgctgggtcgtcaggtaggcgttccgtacatcatcgtgttcctgaacaaatgcgacatggttgatgacgaagagctgctggaactggttgaaatggaagttcgtgaacttctgtctcagtacgacttcccgggcgacgacactccgatcgttcgtggttctgctctgaaagcgctggaaggcgacgcagagtgggaagcgaaaatcctggaactggctggcttcctggattcttacattccggaaccagagcgtgcgattgacaagccgttcctgctgccgatcgaagacgtattctccatctccggtcgtggtaccgttgttaccggtcgtgtagaacgcggtatcatcaaagttggtgaagaagttgaaatcgttggtatcaaagagactcagaagtctacctgtactggcgttgaaatgttccgcaaactgctggacgaaggccgtgctggtgagaacgtaggtgttctgctgcgtggtatcaaacgtgaagaaatcgaacgtggtcaggtactggctaagccgggcaccatcaagccgcacaccaagttcgaatctgaagtgtacattctgtccaaagatgaaggcggmcgtcatactccgttcttcaaaggctaccgtccgcagttctacttccgtactactgacgtgactggtaccatcgaactgccggaaggcgtagagatggtaatgccgggcgacaacatcaaaatggttgttaccctgatccacccgatcgcgatggacgacg

SEQ ID NO: 175 - DNA, 832 bp, Shigella sonnei
  ref <308>: DATABASE ACCESSION NUMBER: ATCC 29930
cggcgcgatcctggtagttgctgcgactgacggcccgatgccgcagactcgtgagcacatcctgctgggtcgtcaggtaggcgttccgtacatcatcgtgttcctgaacaaatgcgacatggttgatgacgaagagctgctggaactggttgaaatggaagttcgtgaacttctgtctcagtacgacttcccgggcgacgacactccgatcgttcgtggttctgctctgaaagcgctggaaggcgacgcagagtgggaagcgaaaatcctggaactggctggcttcctggattcttacattccggaaccagagcgtgcgattgacaagccgttcctgctgccgatcgaagacgtattctccatctccggtcgtggtaccgttgttaccggtcgtgtagaacgcggtatcatcaaagttggtgaagaagttgaaatcgttggtatcaaagagactcagaagtctacctgtactggcgttgaaatgttccgcaaactgctggacgaaggccgtgctggtgagaacgtaggtgttctgctgcgtggtatcaaacgtgaagaaatcgaacgtggtcaggtactggctaagccgggcaccatcaagccgcacaccaagttcgaatctgaagtgtacattctgtccaaagatgaaggcggycgtcatactccgttcttcaaaggctaccgtccgcagttctacttccgtactactgacgtgactggtaccatcgaactgccggaaggcgtagagatggtaatgccgggcgacaacatcaaaatggttgttaccctgatccacccgatcgcgatggacgacggtctgcgtttcgcaatc

SEQ ID NO: 176 - DNA, 716 bp, Staphylococcus aureus
  ref <308>: DATABASE ACCESSION NUMBER: ATCC 13301
tctgctgctgacggtccaatgccacaaactcgtgaacacattcttttatcacgtaacgttggtgtaccagcattagtagtattcttaaacaaagttgacatggttgacgatgaagaattattagaattagtagaaatggaagttcgtgacttattaagcgaatatgacttcccaggtgacgatgtacctgtaatcgctggttcagcattaaaagctttagaaggcgatgctcaatacgaagaaaaaatcttagaattaatggaagctgtagatacttacattccaactccagaacgtgattctgacaaaccattcatgatgccagttgaggacgtattctcaatcactggtcgtggtactgttgctacaggccgtgttgaacgtggtcaaatcaaagttggtgaagaagttgaaatcatcggtttacatgacacatctaaaacaactgttacaggtgttgaaatgttccgtaaattattagactacgctgaagctggtgacaacattggtgcattattacgtggtgttgctcgtgaagacgtacaacgtggtcaagtattagctgctcctggttcaattacaccacatactgaattcaaagcagaagtatacgtattatcaaaagacgaaggtggacgtcacactccattcttctcaaactatcgtccacaattctatttccgtactactgacgtaactggtgttgttcacttacc

SEQ ID NO: 177 - DNA, 719 bp, Staphylococcus aureus
  ref <308>: DATABASE ACCESSION NUMBER: ATCC 29247
ttcttttatcacgtaacgttggtgtaccagcattagtagtattcttaaacaaagttgacatggttgacgatgaagaattattagaattagtagaaatggaagttcgtgacttattaagcgaatatgacttcccaggtgacgatgtacctgtaatcgctggttcagcattaaaagctttagaaggcgatgctcaatacgaagaaaaaatcttagaattaatggaagctgtagatacttacattccaactccagaacgtgattctgacaaaccattcatgatgccagttgaggacgtattctcaatcactggtcgtggtactgttgctacaggccgtgttgaacgtggtcaaatcaaagttggtgaagaagttgaaatcatcggtttacatgacacatctaaaacaactgttacaggtgttgaaatgttccgtaaattattagactacgctgaagctggtgacaacattggtgcattattacgtggtgttgctcgtgaagacgtacaacgtggtcaagtattagctgctcctggttcaattacaccacatactgaattcaaagcagaagtatacgtattatcaaaagacgaaggtggacgtcacactccattcttctcaaactatcgtccacaattctatttccgtactactgacgtaactggtgttgttcacttaccagaaggtmctgaaatggtaatgcctggtgataacgttgaaatg

SEQ ID NO: 178 - DNA, 625 bp, Staphylococcus aureus
  ref <308>: DATABASE ACCESSION NUMBER: ATCC 33591
gtgaacacattcttttatcacgtaacgttggtgtaccagcattagtagtattcttaaacaaagttgacatggttgacgatgaagaattattagaattagtagaaatggaagttcgtgacttattaagcgaatatgacttcccaggtgacgatgtacctgtaatcgctggttcagcattaaaagctttagaaggcgatgctcaatacgaagaaaaaatcttagaattaatggaagctgtagatacttacattccaactccagaacgtgattctgacaaaccattcatgatgccagttgaggacgtattctcaatcactggtcgtggtactgttgctacaggccgtgttgaacgtggtcaaatcaaagttggtgaagaagttgaaatcatcggtttacatgacacatctaaaacaactgttacaggtgttgaaatgttccgtaaattattagactacgctgaagctggtgacaacattggtgcattattacgtggtgttgctcgtgaagacgtacaacgtggtcaagtattagctgctcctggttcaattacaccacatactgaattcaaagcagaagtatacgtattatcaaaagacgaaggtggacgtcacactccattcttctc

SEQ ID NO: 179 - DNA, 704 bp, Staphylococcus aureus
  ref <308>: DATABASE ACCESSION NUMBER: ATCC 43300
gttggtgtaccagcattagtagtattcttaaacaaagttgacatggttgacgatgaagaattattagaattagtagaaatggaagttcgtgacttattaagcgaatatgacttcccaggtgacgatgtacctgtaatcgctggttcagcattaaaagctttagaaggcgatgctcaatacgaagaaaaaatcttagaattaatggaagctgtagatacttacattccaactccagaacgtgattctgacaaaccattcatgatgccagttgaggacgtattctcaatcactggtcgtggtactgttgctacaggccgtgttgaacgtggtcaaatcaaagttggtgaagaagttgaaatcatcggtttacatgacacatctaaaacaactgttacaggtgttgaaatgttccgtaaattattagactacgctgaagctggtgacaacattggtgcattattacgtggtgttgctcgtgaagacgtacaacgtggtcaagtattagctgctcctggttcaattacaccacatactgaattcaaagcagaagtatacgtattatcaaaagacgaaggtggacgtcacactccattcttctcaaactatcgtccacaattctatttccgtactactgacgtaactggtgttgttcacttaccagaaggtactgaaatggtaatgcctggtgataacgttgaaatgac

SEQ ID NO: 180 - DNA, 730 bp, Staphylococcus aureus subsp. aureus
  ref <308>: DATABASE ACCESSION NUMBER: ATCC 6538
gtgaacacattcttttatcacgtaacgttggtgtaccagcattagtagtattcttaaacaaagttgacatggttgacgatgaagaattattagaattagtagaaatggaagttcgtgacttattaagcgaatatgacttcccaggtgacgatgtacctgtaatcgctggttcagcattaaaagctttagaaggcgatgctcaatacgaagaaaaaatcttagaattaatggaagctgtagatacttacattccaactccagaacgtgattctgacaaaccattcatgatgccagttgaggacgtattctcaatcactggtcgtggtactgttgctacaggccgtgttgaacgtggtcaaatcaaagttggtgaagaagttgaaatcatcggtttacatgacacatctaaaacaactgttacaggtgttgaaatgttccgtaaattattagactacgctgaagctggtgacaacattggtgcattattacgtggtgttgctcgtgaagacgtacaacgtggtcaagtattagctgctcctggttcaattacaccacatactgaattcaaagcagaagtatacgtattatcaaaagacgaaggtggacgtcacactccattcttctcaaactatcgtccacaattctatttccgtactactgacgtaactggtgttgttcacttaccagaaggtactgaaatggtaatgcctggtgataacgttgaaatgac

SEQ ID NO: 181 - DNA, 834 bp, Staphylococcus auricularis
  ref <308>: DATABASE ACCESSION NUMBER: ATCC 33753
cggtgcgatcttagttgtatctgcagctgatggtccaatgccacaaactcgtgaacacatcttattatcacgtaacgttggtgtaccagcattagttgtattcttaaacaaagttgaccaagttgacgacgaagaattattagaattagtagaaatggaagttcgtgacttattaagcgaatacgactacccaggtgacgatgtacctgtaatctctggttctgcgttgaaagcattagaaggcgacaaagaatacgaacaaaaaatcttagacttaatgcaacaagttgacgattacattccaactccagaacgtgactctgataaaccattcatgatgccagttgaagacgtattctcaatcactggtcgtggtactgttgcaacaggccgtgttgaacgtggtcaaatcaaagtcggtgaagaagttgaaatcatcggtatgaaagacggttcacaaaaaacaacagttactggtgtagaaatgttccgtaaattattagactacgctgaagctggtgacaacatcggtgctttattacgtggtatttcacgtgaagaagtacaacgtggtcaagttttagctgctcctggttcaattacaccacacactaaattcactgcagaagtttacgtattatctaaagatgaaggtggacgtcacactccattcttctctaactaccgtccacaattctatttccgtactactgacgtaacaggtgttgttactttaccagaaggtacagaaatggtaatgcctggcgataacgttaaaatggaagttgaattaatttctccaatcgctatcgaagacggtactcgtttctcaat

SEQ ID NO: 182 - DNA, 835 bp, Staphylococcus capitis subsp. capitis
  ref <308>: DATABASE ACCESSION NUMBER: ATCC 27840
cggcggtatcttagtagtatctgctgctgacggtccaatgccacaaactcgtgaacacatcttattatcacgtaacgttggtgtaccagcattagttgtattcttaaacaaagttgacatggtagacgacgaagaattattagaattagttgaaatggaagttcgtgacttattaagcgaatatgacttcccaggtgatgatgtacctgtaatcgctggttcagcattaaaagctttagaaggcgatgctcaatacgaagaaaaaatcttagaattaatgcaagcagttgatgattacattccaactccagaacgtgattctgacaaaccattcatgatgccagttgaggacgtattctcaatcactggtcgtggtactgttgctacaggccgtgttgaacgtggtcaaatcaaagttggtgaagaagttgaaatcatcggtatccacgaaacttctaaaacaactgttactggtgtagaaatgttccgtaaattattagactacgctgaagctggtgacaacatcggtgctttattacgtggtgttgctcgtgaagacgtacaacgtggtcaagtattagctgctcctggttcaatcacaccacacactaaattcaaagcggaagtttacgttttatctaaagacgaaggtggacgtcacactccattcttcagtaactaccgcccacaattctatttccgtactactgacgtaactggtgttgttaacttaccagaaggtactgaaatggttatgcctggcgacaacgttgaaatgacagttgaattaatcgctcctatcgctattgaagacggtactcgtttctcaatcgga

SEQ ID NO: 183 - DNA, 804 bp, Macrococcus caseolyticus
  ref <308>: DATABASE ACCESSION NUMBER: ATCC 13548
gtatcttagtagtatctgctgctgacggtccaatgccacaaactcgtgaacacatccttttatcacgtaacgttggtgtaccagcattagtagtattcttgaacaaagttgacatggttgacgatgaagaattattagaattagttgaaatggaagttcgtgacttattatctgaatatgacttccctggtgacgatgtacctgtaatcgctggatctgctttaaaagcattagaaggcgttgaagaatacgaagacaaaatcatggaattaatggacgcagttgatgagtacatcccaactccagaacgtgattctgacaaaccattcatgatgccagttgaggacgtattctcaatcactggtcgtggtacagttgcaactggacgtgttgagcgtggacaagttaaagttggtgaagaagttgaaatcattggtttaactgaagaaccagcaaaaactacagttacaggtgtagaaatgttccgtaaattattagattacgctgaagctggagataacatcggtgctttattacgtggtgtttctcgtgaagacgtacaacgtggacaagtattagctaaaccaggttcaattactccacatactaaattcaaagctgaagtttacgtattatctaaagaagaaggtggacgtcatactccattcttcactaactaccgccctcagttctacttccgtacaactgacgtaactggtgtagttaacttaccagaaggtactgaaatggtaatgcctggagataacatcgaaatgaacgttgaattaatttctccaatcgcga

SEQ ID NO: 184 - DNA, 832 bp, Staphylococcus cohnii
  DSM 20260
cggagctatcttagtagtatctgctgctgatggcccaatgccacaaactcgtgaacatatccttttatcacgtaacgttggtgttccagcattagttgtattcttaaacaaagttgacatggttgacgatgaagaattattagaattagtagaaatggaagttcgtgacttattaagcgaatatgacttcccaggtgacgatgtacctgtaatctctggttcagcattaaaagctcttgaaggcgacgctgactatgagcaaaaaatcttagacttaatgcaagctgttgatgacttcattccaacaccagaacgtgattctgacaaaccattcatgatgccagttgaggacgtattctcaatcactggtcgtggtactgttgctacagggcgtgttgaacgtggtcaaatcaaagtcggtgaagaagttgaaatcatcggtatgcaagaagattcaagcaaaacaactgttactggtgtagaaatgttccgtaaattattagactacgctgaagctggtgacaacattggtgcgttattacgtggtgttgcacgtgaagacatccaacgtggtcaagttttagctgctcctggttcaattacaccacacacaaactttaaagcggaagtttacgttttatcaaaagatgaaggtggccgtcatacgccattcttcagtaactatcgcccacaattctatttccgtactactgacgtaacaggtgttgttactttaccagaaggtactgaaatggttatgcctggcgacaacgtagaaatggaagttgaactaatttctccaatcgctatcgaagacggtacacgtttctct

SEQ ID NO: 185 - DNA, 699 bp, Staphylococcus epidermidis
  strain CSG 269
atctgctgctgacggtccaatgccacaaactcgtgaacacatcttattatcacgtaacgttggtgtaccagcattagttgtattcttaaacaaagttgacatggtagacgacgaagaattattagaattagttgaaatggaagttcgtgacttattaagcgaatatgacttcccaggtgacgatgtacctgtaatcgctggttctgcattaaaagcattagaaggcgatgctgaatacgaacaaaaaatcttagacttaatgcaagcagttgatgattacattccaactccagaacgtgattctgacaaaccattcatgatgccagttgaggacgtattctcaatcactggtcgtggtactgttgctacaggccgtgttgaacgtggtcaaatcaaagttggtgaagaagttgaaatcatcggtatgcacgaaacttctaaaacaactgttactggtgtagaaatgttccgtaaattattagactacgctgaagctggtgacaacatcggtgctttattacgtggtgttgcacgtgaagacgtacaacgtggtcaagtattagctgctcctggttctattacaccacacacaaaattcaaagctgaagtatacgtattatctaaagatgaaggtggacgtcacactccattcttcactaactatcgcccacaattctatttccgtactactgacgtaac

SEQ ID NO: 186 - DNA, 829 bp, Staphylococcus haemolyticus
  ref <308>: DATABASE ACCESSION NUMBER: ATCC 29970
cggcggtatcttagtagtatctgctgctgacggtccaatgccacaaactcgtgaacacattcttttatcacgtaacgttggtgtaccagcattagtagtattcttaaataaagttgacatggttgacgatgaagaattattagaattagttgaaatggaagtacgtgacttattatctgaatacgacttcccaggtgacgatgtacctgtaatcgctggttcagcattaaaagctttagaaggcgatgctcaatacgaagaaaaaatcttagaattaatgcaagcagttgatgactacattccaactccagaacgtgattctgacaaaccattcatgatgccagttgaggacgtattctcaatcactggtcgtggtactgttgctacaggccgtgttgaacgtgggcaaatcaaagttggtgaagaagttgaaatcattggtatccatgacacttctaaaacaactgttactggtgtagaaatgttccgtaaattattagactacgctgaagctggtgacaacatcggtgcattattacgtggtgttgctcgtgaagacgtacaacgtggtcaagtattagctgctccaggttcaatcacacctcacacaaaatttaaagcagacgtatacgttttatctaaagacgaaggtggacgtcacactccattcttcacaaactatcgtccacaattctatttccgtactactgacgtaactggtgttgttaacttaccagaaggtactgaaatggttatgcctggcgacaacgttgaaatgacagtagaattaatcgctcctatcgcgattgaagacggtactcgtttctca

SEQ ID NO: 187 - DNA, 705 bp, Staphylococcus warneri
  strain CSG 123
cacaaactcgtgaacacattcttttatcacgtaacgttggtgtaccagctttagttgtattcttaaacaaagttgatatggtagacgacgaagaattattagaattagtagaaatggaagttcgtgacttattatctgaatatgacttcccaggtgacgacgtacctgtaatcgctggttcagcattaaaagctttagaaggcgacgaaaaatacgaagaaaaaatcttagaattaatgcaagcagttgatgactacattccaactccagaacgtgattctgacaaaccattcatgatgccagttgaggacgtattctcaatcactggtcgtggtactgttgctacaggccgtgttgaacgtggtcaaatcaaagttggtgaagaagttgaaatcatcggtttacatgacacttctaaaacaactgttactggtgtagaaatgttccgtaagttattagactacgctgaagctggtgacaacatcggtgctttattacgtggtgttgctcgtgaagacgtacaacgtggtcaagtattagctgctcctggttcaattacaccacatacaaaattcaaagcggaagtttacgttttatctaaagacgaaggtggacgtcacactccattcttcagtaactaccgcccacaattctatttccgtactactgacgtaactggcgttgttcaattaccagaaggtactg

SEQ ID NO: 188 - DNA, 678 bp, Staphylococcus haemolyticus
  strain CSG 23
ttttatcacgtaacgttggtgtaccagcattagtagtattcttaaacaaagttgacatggttgacgatgaagaattattagaattagttgaaatggaagtacgtgacttattatctgaatacgacttcccaggtgacgacgtacctgtaatcgctggttcagctttaaaagctttagaaggcgatgctcaatacgaagaaaaaatcttagaattaatgcaagcagttgatgattacattccaactccagaacgtgactctgataaaccattcatgatgccagttgaggacgtattctcaatcactggtcgtggtactgttgctacaggtcgtgttgaacgtggtcaaatcaaagttggtgaagaagttgaaattattggtatcaaagaaacttctaaaacaactgttactggtgtagaaatgttccgtaaattattagactacgctgaagctggtgacaacatcggtgctttattacgtggtgttgctcgtgaagatgtacaacgtggtcaagtattagctgctccaggttcaattacacctcacacaaaattcaaagcagacgtatacgttttatcaaaagatgaaggtggacgtcatactccattcttcactaactatcgtccacaattctatttccgtactactgacgtaactggtgttgttaacttaccagaag

SEQ ID NO: 189 - DNA, 668 bp, Staphylococcus haemolyticus
  strain CSG 33
accagcattagtagtattcttaaataaagttgacatggttgacgatgaagaattattagaattagttgaaatggaagtacgtgacttattatctgaatacgacttcccaggtgacgatgtacctgtaatcgctggttcagcattaaaagctttagaaggcgatgctcaatacgaagaaaaaatcttagaattaatgcaagcagttgatgactacattccaactccagaacgtgattctgacaaaccattcatgatgccagttgaggacgtattctcaatcactggtcgtggtactgttgctacaggccgtgttgaacgtggtcaaatcaaagttggtgaagaagttgaaatcattggtatccatgacacttctaaaacaactgttactggtgtagaaatgttccgtaaattattagactacgctgaagctggtgacaacatcggtgcattattacgtggtgttgctcgtgaagacgtacaacgtggtcaagtattagctgctccaggttcaatcacacctcacacaaaatttaaagcagacgtatacgttttatctaaagacgaaggtggacgtcacactccattcttcacaaactatcgtccacaattctatttccgtactactgacgtaactggtgttgttaacttaccagaaggtactgaaatgg

SEQ ID NO: 190 - DNA, 593 bp, Staphylococcus haemolyticus
  strain CSG 8
aaagttgacatggttgacgatgaagaattattagaattagttgaaatggaagtacgtgacttattatctgaatacgacttcccaggtgacgatgtacctgtaatcgctggttcagcattaaaagctttagaaggcgatgctcaatacgaagaaaaaatcttagaattaatgcaagcagttgatgattacattccaactccagaacgtgattctgacaaaccattcatgatgccagttgaggacgtattctcaatcactggtcgtggtactgttgctacaggccgtgttgaacgtggtcaaatcaaagttggtgaagaagttgaaatcattggtatccatgacacttctaaaacaactgttactggtgtagaaatgttccgtaaattattagactacgctgaagctggtgacaacattggtgcattattacgtggtgttgctcgtgaagacgtacaacgtggtcaagtattagctgctccaggttcaatcacacctcacacaaaatttaaagcagacgtatacgttttatctaaagacgaaggtggacgtcacactccattcttcacaaactatcgtccacaattctatttccg

SEQ ID NO: 191 - DNA, 828 bp, Staphylococcus hominis subsp. hominis
  ref <308>: DATABASE ACCESSION NUMBER: ATCC 27844
cggcgctatcttagtagtatctgctgctgatggtccaatgccacaaactcgtgaacacattcttttatcacgtaacgttggtgtaccagcattagtagtattcttaaacaaagttgacatggttgacgatgaagaattattagaattagttgaaatggaagtacgtgacttattatctgaatacgacttcccaggtgacgacgtacctgtaatcgctggttcagctttaaaagctttagaaggcgatgctcaatacgaagaaaaaatcttagaattaatgcaagcagttgatgattatattccaactccagaacgtgactctgataaaccattcatgatgccagttgaggacgtattctcaatcactggtcgtggtactgttgctacaggccgtgttgaacgtggtcaaatcaaagttggtgaagaagttgaaattattggtatcaaagaaacttctaaaacaactgttactggtgtagaaatgttccgtaaattattagactacgctgaagctggtgacaacatcggtgctttattacgtggtgttgctcgtgaagatgtacaacgtggtcaagtattagctgctccaggttcaattacacctcacacaaaattcaaagcagacgtatacgttttatcaaaagatgaaggtggacgtcatactccattcttctctaactatcgtccacaattctatttccgtactactgacgtaactggtgttgttaacttaccagaaggtactgaaatggtaatgcctggtgacaacgttgaaatgacagtagaattaatcgctcctatcgcgattgaagacggtactcgtttctc

SEQ ID NO: 192 - DNA, 620 bp, Staphylococcus warneri
  ref <308>: DATABASE ACCESSION NUMBER: ATCC 35982
atggtccaatgccacaaactcgtgaacacattcttttatcacgtaacgttggtgtaccagctttagttgtattcttaaacaaagttgatatggtagacgacgaagaattattagaattagtagaaatggaagttcgtgacttattatctgaatatgacttcccaggtgacgacgtacctgtaatcgctggttcagcattaaaagctttagaaggcgacgaaaaatacgaagaaaaaatcttagaattaatgcaagcagttgatgactacattccaactccagaacgtgattctgacaaaccattcatgatgccagttgaggacgtattctcaatcactggtcgtggtactgttgctacaggccgtgttgaacgtggtcaaatcaaagttggtgaagaagttgaaatcatcggtttacatgacacttctaaaacaactgttactggtgtagaaatgttccgtaagttattagactacgctgaagctggtgacaacatcggtgctttattacgtggtgttgctcgtgaagacgtacaacgtggtcaagtattagctgctcctggttcaattacaccacatacaaaattcaaagcggaagtttacgttttatctaaagacgaa

SEQ ID NO: 193 - DNA, 692 bp, Staphylococcus hominis
  strain CSG 170
ccagcattagtagtattcttaaacaaagttgacatggttgacgatgaagaattattagaattagttgaaatggaagtacgtgacttattatctgaatacgacttcccaggtgacgacgtacctgtaatcgctggttcagctttaaaagctttagaaggcgatgctcaatacgaagaaaaaatcttagaattaatgcaagcagttgatgattatattccaactccagaacgtgactctgataaaccattcatgatgccagttgaggacgtattctcaatcactggtcgtggtactgttgctacaggccgtgttgaacgtggtcaaatcaaagttggtgaagaagttgaaattattggtatcaaagaaacttctaaaacaactgttactggtgtagaaatgttccgtaaattattagactacgctgaagctggtgacaacatcggtgctttattacgtggtgttgctcgtgaagatgtacaacgtggtcaagtattagctgctccaggttcaattacacctcacacaaaattcaaagcagacgtatacgttttatcaaaagatgaaggtggacgtcatactccattcttctctaactatcgtccacaattctatttccgtactactgacgtaactggtgttgttaacttaccagaaggtactgaaatggtaatgcctggtgacaacgttgaaat

SEQ ID NO: 194 - DNA, 684 bp, Staphylococcus hominis
  strain CSG 36
cattcttttatcacgtaacgttggtgtaccagcattagtagtattcttaaacaaagttgacatggttgacgatgaagaattattagaattagttgaaatggaagtacgtgacttattatctgaatacgacttcccaggtgacgacgtacctgtaatcgctggttcagctttaaaagctttagaaggcgatgctcaatacgaagaaaaaatcttagaattaatgcaagcagttgatgattatattccaactccagaacgtgactctgataaaccattcatgatgccagttgaggacgtattctcaatcactggtcgtggtactgttgctacaggccgtgttgaacgtggtcaaatcaaagttggtgaagaagttgaaattattggtatcaaagaaacttctaaaacaactgttactggtgtagaaatgttccgtaaattattagactacgctgaagctggtgacaacatcggtgctttattacgtggtgttgctcgtgaagatgtacaacgtggtcaagtattagctgctccaggttcaattacacctcacacaaaattcaaagcagacgtatacgttttatcaaaagatgaaggtggacgtcatactccattcttctctaactatcgtccacaattctatttccgtactactgacgtaactggtgttgttaacttaccagaagg

SEQ ID NO: 195 - DNA, 685 bp, Staphylococcus hominis
  strain CSG 6
accagcattagtagtattcttaaacaaagttgacatggttgacgatgaagaattattagaattagttgaaatggaagtacgtgacttattatctgaatacgacttcccaggtgacgacgtacctgtaatcgctggttcagctttaaaagctttagaaggcgatgctcaatacgaagaaaaaatcttagaattaatgcaagcagttgatgattacattccaactccagaacgtgactctgataaaccattcatgatgccagttgaggacgtattctcaatcactggtcgtggtactgttgctacaggccgtgttgaacgtggtcaaatcaaagttggtgaagaagttgaaattattggtatcaaagaaacttctaaaacaactgttactggtgtagaaatgttccgtaaattattagactacgctgaagctggtgacaacatcggtgctttattacgtggtgttgctcgtgaagatgtacaacgtggtcaagtattagctgctccaggttcaattacacctcacacaaaattcaaagcagacgtatacgttttatcaaaagatgaaggtggacgtcatactccattcttcactaactatcgtccacaattctatttccgtactactgacgtaactggtgttgttaacttaccagaaggtactgaaatggtaatgcctggcgacaac

SEQ ID NO: 196 - DNA, 611 bp, Staphylococcus hominis
  strain CSG 62
gacttattatctgaatacgacttcccaggtgacgacgtacctgtaatcgctggttcagctttaaaagctttagaaggcgatgctcaatacgaagaaaaaatcttagaattaatgcaagcagttgatgattacattccaactccagaacgtgactctgataaaccattcatgatgccagttgaggacgtattctcaatcactggtcgtggtactgttgctacaggccgtgttgaacgtggtcaaatcaaagttggtgaagaagttgaaattattggtatcaaagatacttctaaaacaactgttactggtgtagaaatgttccgtaaattattagactacgctgaagctggtgacaacatcggtgctttattacgtggtgttgctcgtgaagatgtacaacgtggtcaagtattagctgctccaggttcaatcacacctcacacaaaattcaaagcagacgtatatgttttatcaaaagatgaaggtggacgtcatactccattcttcactaactatcgtccacaattctatttccgtactactgacgtaactggtgttgttaacttaccagaaggtactgaaatggtaatgcctggcgacaacgttgaaat

SEQ ID NO: 197 - DNA, 828 bp, Staphylococcus lugdunensis
  ref <308>: DATABASE ACCESSION NUMBER: ATCC 43809
cggcggtatcttagtagtttctgctgcagatggtccaatgccacaaactcgtgaacacattcttttatcacgtaacgttggtgtgccagcattagtagtattcttaaacaaagttgacatggttgacgatgaagaattattagaattagtagaaatggaagttcgtgatttattaactgaatatgacttcccaggtgacgatgtgcctgtaatcgctggttcagcattaaaagctttagaaggcgacgaaaaatacgaagctaaaatcttagaattaatggatgcagttgataactacattccaactccagaacgtgactctgacaaaccattcatgatgccagttgaggacgtattctcaatcactggtcgtggtactgttgctacaggccgtgttgaacgtggtcaaatcaaagtcggtgaagaagttgaaattattggtatccacgatactactaaaacaactgttactggtgtagaaatgttccgtaaattattagactacgctgaagctggtgacaacatcggtgcgttattacgtggtgttgctcgtgaagatgtacaacgtggacaagtattagctgctccaggttcaattacacctcacactaaatttaaagctgacgtatatgttttatctaaagatgaaggtggacgtcatacaccattcttctcaaactaccgcccacaattctatttccgtactacagacgtaactggtgttgttaacttaccagaaggtacagaaatggttatgcctggcgacaacgttgaaatgacagttgaattaatcgctccaatcgctatcgaagacggaactcgtttctc

SEQ ID NO: 198 - DNA, 690 bp, Staphylococcus saprophyticus
  ref <308>: DATABASE ACCESSION NUMBER: ATCC 35552
agtagtatctgctgctgatggcccaatgccacaaactcgtgaacacattcttttatcacgtaacgttggtgttccagcattagttgtattcttaaacaaagttgacatggttgacgatgaagaattattagaattagtagaaatggaagttcgtgacttattaagcgaatatgacttcccaggtgacgatgtacctgtaatctctggttctgcattaaaagctttagaaggcgacgctgactatgagcaaaaaatcttagacttaatgcaagctgttgatgacttcattccaacaccagaacgtgattctgacaaaccattcatgatgccagttgaggacgtattctcaatcactggtcgtggtactgttgctacaggccgtgttgaacgtggtcaaatcaaagtcggtgaagaaatcgaaatcatcggtatgcaagaagaatcaagcaaaacaactgttactggtgtagaaatgttccgtaaattattagactacgctgaagctggtgacaacattggtgcattattacgtggtgtttcacgtgatgacgtacaacgtggtcaagttttagctgctcctggtactattacaccacatacaaaattcaaagcggatgtttacgttttatctaaagatgaaggtggtcgtcatacaccattcttcactaactaccgcccacaattctattt

SEQ ID NO: 199 - DNA, 723 bp, Staphylococcus saprophyticus
  strain CSG 83
gcattagttgtattcttaaacaaagttgacatggttgacgatgaagaattattagaattagtagaaatggaagttcgtgatttattaagcgaatatgacttcccaggtgacgatgtacctgtaatctctggttctgcattaaaagctttagaaggcgacgctgactatgagcaaaaaatcttagacttaatgcaagctgttgatgacttcattccaacaccagaacgtgattctgacaaaccattcatgatgccagttgaggacgtattctcaatcactggtcgtggtactgttgctacaggccgtgttgaacgtggtcaaatcaaagtcggtgaagaaatcgaaatcatcggtatgcaagaagaatcaagcaaaacaactgttactggtgtagaaatgttccgtaaattattagactacgctgaagctggtgacaacattggtgcattattacgtggtgtttcacgtgatgacgtacaacgtggtcaagttttagctgctcctggtactattacaccacatacaaaattcaaagcggatgtttacgttttatctaaagatgaaggtggtcgtcatacaccattcttcactaactaccgcccacaattctatttccgtactactgacgtaactggtgttgttaacttaccagaaggtactgaaatggttatgcctggcgataacgttgaaatggatgttgaattaatttctccaatcgctatt

SEQ ID NO: 200 - DNA, 697 bp, Staphylococcus saprophyticus
  strain CSsa 18
cgttggtgttccagcattagttgtattcttaaacaaagttgacatggttgacgatgaagaattattagaattagtagaaatggaagttcgtgacttattaagcgaatatgacttcccaggtgacgatgtacctgtaatctctggttctgcattaaaagctttagaaggcgacgctgactatgagcaaaaaatcttagacttaatgcaagctgttgatgacttcattccaacaccagaacgtgattctgacaaaccattcatgatgccagttgaggacgtattctcaatcactggtcgtggtactgttgctacaggccgtgttgaacgtggtcaaatcaaagtcggtgaagaaatcgaaatcatcggtatgcaagaagaatcaagcaaaacaactgttactggtgtagaaatgttccgtaaattattagactacgctgaagctggtgacaacattggtgcattattacgtggtgtttcacgtgatgacgtacaacgtggtcaagttttagctgctcctggtactattacaccacatacaaaattcaaagcggatgtttacgttttatctaaagatgaaggtggtcgtcatacaccattcttcactaactaccgcccacaattctatttccgtactactgacgtaactggtgttgttaacttaccagaaggtactgaaatggttatgcctggcgataac

SEQ ID NO: 201 - DNA, 835 bp, Staphylococcus sciuri subsp. sciuri
  ref <308>: DATABASE ACCESSION NUMBER: ATCC 29060
cggcggtatcttagtagtatctgctgctgacggtccaatgcctcaaactcgtgagcacattcttttatcacgtaacgtaggtgttcctgcattagtagtattcttaaacaaagttgacatggttgacgatgaagaattattagaattagttgaaatggaagttcgtgacttattatctgaatatgacttcccaggcgacgacgttcctgtaattgctggttcagcattaaaagcattagaaggcgacgaagcttacgaagacaaaatcatggaattaatggatgctgttgatacattcatcccaactccagaacgtgactctgacaaaccattcatgatgccagttgaggacgtattctcaatcactggtcgtggtactgttgctacaggccgtgttgaacgtggtcaaatcactgttggtgaagaagttgaaatcatcggtttaactgaagaatcttctaaaacaactgtaactggtgttgaaatgttccgtaaattattagacttcgctgaagctggagataacatcggtgcattattacgtggtgttgctcgtgaagacgttaaccgtggtcaagtattagctaaaccaggttcaatcacacctcacactaaattcaaagctgaagtttatgtattatctaaagacgaaggtggacgtcatactccattcttcacaaactaccgcccacaattctatttccgtactactgacgtaactggtgtagttaacttaccagaaggtactgaaatggttatgcctggcgacaacgttgaaatggacgttgaattaatttcaccaatcgctattgaagacggtatcgtttctcaatca

SEQ ID NO: 202 - DNA, 831 bp, Staphylococcus warneri
  ref <308>: DATABASE ACCESSION NUMBER: ATCC 27836
cggcggtatcttagttgtatctgcagctgatggtccaatgccacaaactcgtgaacacattcttttatcacgtaacgttggtgtaccagctttagttgtattcttaaacaaagttgatatggtagacgacgaagaattattagaattagtagaaatggaagttcgtgacttattatctgaatatgacttcccaggtgacgacgtacctgtaatcgctggttcagcattaaaagctttagaaggcgacgaaaaatacgaagaaaaaatcttagaattaatgcaagcagttgatgactacattccaactccagaacgtgattctgacaaaccattcatgatgccagttgaggacgtattctcaatcactggtcgtggtactgttgctacaggccgtgttgaacgtggtcaaatcaaagttggtgaagaagttgaaatcatcggtttacatgacacttctaaaacaactgttactggtgtagaaatgttccgtaagttattagactacgctgaagctggtgacaacatcggtgctttattacgtggtgttgctcgtgaagacgtacaacgtggtcaagtattagctgctcctggttcaattacaccacatacaaaattcaaagcggaagtttacgttttatctaaagacgaaggtggacgtcacactccattcttcagtaactaccgcccacaattctatttccgtactactgacgtaactggcgttgttcaattaccagaaggtactgaaatggttatgcctggtgataacgttgaaatgacagtagaattaatcgctcctatcgcgattgaagacggtactcgtttctcaac

SEQ ID NO: 203 - DNA, 829 bp, Staphylococcus warneri
  Strain CSG 50
cggcggtatcttagttgtatctgcagctgatggtccaatgccacaaactcgtgaacacattcttttatcacgtaacgttggtgtaccagctttagttgtattcttaaacaaagttgatatggtagacgacgaagaattattagaattagtagaaatggaagttcgtgacttattatctgaatatgacttcccaggtgacgacgtacctgtaatcgctggttcagcattaaaagctttagaaggcgacgaaaaatacgaagaaaaaatcttagaattaatgcaagcagttgatgactacattccaactccagaacgtgattctgacaaaccattcatgatgccagttgaggacgtattctcaatcactggtcgtggtactgttgctacaggccgtgttgaacgtggtcaaatcaaagttggtgaagaagttgaaatcatcggtttacatgacacttctaaaacaactgttactggtgtagaaatgttccgtaagttattagactacgctgaagctggtgacaacatcggtgctttattacgtggtgttgctcgtgaagacgtacaacgtggtcaagtattagctgctcctggttcaattacaccacatacaaaattcaaagcggaagtttacgttttatctaaagacgaaggtggacgtcacactccattcttcagtaactaccgcccacaattctatttccgtactactgacgtaactggcgttgttcaattaccagaaggtactgaaatggttatgcctggtgataacgttgaaatgacagtagaattaatcgctcctatcgcgattgaagacggtactcgtttctca

SEQ ID NO: 204 - DNA, 839 bp, Bifidobacterium longum
  ref <308>: DATABASE ACCESSION NUMBER: ATCC 15707
tggcgctatcctcgttgtggccgccaccgacggcccgatggcccagactcgcgagcacgtgctgctcgcccgtcaggttggcgttccgaagatcctcgtcgccctgaacaagtgcgacatggtcgacgatgaagagctcatcgagctcgtcgaagaagaggtccgcgacctcctcgacgagaacggcttcgaccgtgactgcccggtcatccacacctccgcttacggtgctctgcacgacgacgctccggaccacgagaagtgggtccagtccgttaaggacctcatggacgctgtcgacgactacatcccgaccccggttcacgacctggacaagccgttcctgatgccgatcgaggacgtcttcaccatctccggccgtggtaccgttgtcaccggtcgtgtcgagcgtggccagctggccgtcaacaccccggtcgagatcgttggtatccgtccgacccagcagaccaccgtcacctccatcgagaccttccacaagaccatggacgcctgcgaggctggcgacaacaccggtctgcttctgcgtggtctcggccgtgacgatgtcgagcgtggccaggttgtggccaagccgggctccgtcaccccgcacaccaagttcgagggcgaagtctacgtgctgaccaaggacgaaggcggccgtcactcgccgttcttctccaactaccgtccgcagttctacttccgcaccaccgacgtcaccggcgtcatcgagctgccggaaggcgtcgagatggttcagccgggcgaccacgctaccttcaccgttgagctgattcagcccatcgctatggaggaaggcctgaccttcgctg

SEQ ID NO: 205 - DNA, 754 bp, Stenotrophomonas maltophilia
  strain CDC F3338
cggcgcgatcctggtgtgctcggccgctgacggcccgatgccgcagacccgtgagcacatcctgctgtcgcgccaggtcggcgtgccgtacatcgtcgtgttcctgaacaaggccgacatggtcgacgacgccgagctgctcgagctggtcgagatggaagtgcgcgaactgctgagcaagtacgagttcccgggcgacgacaccccgatcatcgccggttcggcccgcctggcgctggaaggcgaccagagcgacatcggcgtgccggccatcctgaagctggtcgacgcgctggacagctggattccggagccggagcgtgcgatcgacaagccgttcctgatgccggtggaagacgtgttctcgatctcgggccgcggcaccgtggtgaccggtcgtatcgagcgcggcgtgatcaaggttggcgacgaaatcgaaatcgtcggcatccgtccggtgcagaagaccaccgtgaccggcgttgaaatgttccgcaagctgctggaccagggtcaggcaggcgacaacgctggcctgctgctgcgcggcaccaagcgtgatgacgtcgagcgtggccaggtgctggccaagccgggcacgatcaagccgcacaccaagttcgaaggcgaagtgtacgtcctgtcgaaggacgagggcggccgccacaccccgttcttcaacggctaccgtccgcagttctacttccgcaccaccgacatcaccggcgccgctgcactgccggaaggcgtcgaa

SEQ ID NO: 206 - DNA, 835 bp, Streptococcus acidominimus
  ref <308>: DATABASE ACCESSION NUMBER: ATCC 51726
tggtgctatccttgtagtagcttcaactgacggaccaatgccacaaactcgtgagcacatccttctttcacgtcaagttggtgttaaaaaccttatcgttttcatgaacaaagttgaccttgttgatgatgaagaattgcttgaattggttgaaatggaaatccgtgaccttctttcagaatacgatttcccaggtgatgatcttccagttgttcaaggttcagctcttaaagcgcttgaaggtgattcagcacaagaagatgttatcatggaattgatgtcaatcgttgacacatacattccagaaccagaacgtgatactgacaaaccattgcttcttccagtcgaggatgtattctcaatcactggacgtggtactgttgcttcaggacgtatcgaccgtggtactgttaaagttaatgacgaagttgaaatcgttggtatcaaagacgaaatctctaaagcagttgttactggtgttgaaatgttccgtaaacaacttgacgaaggtcttgctggagataacgttggtgttcttcttcgtggtgtacaacgtgatgaaatcgaacgtggtcaagttcttgctaaaccaggttcaatcaacccacacactaaattcaaaggtgaagtttacgttctttctaaagaagaaggtggacgtcacactccattcttcgataactaccgtcctcagttctacttccgtacaactgacgtaactggttcaatcaaattgccagaaggtactgaaatggtaatgcctggtgataacgtaactatcgaagttgagttgatccacccaatcgccgttgaacaaggtactactttctctatc

SEQ ID NO: 207 - DNA, 819 bp, Streptococcus agalactiae
  ref <308>: DATABASE ACCESSION NUMBER: ATCC 12403
ctatccttgtagttgcttcaactgatggaccaatgccacaaactcgtgagcacatccttctttcacgtcaagttggtgttaaacaccttatcgtattcatgaacaaagttgaccttgttgatgatgaagaattgcttgaattggttgaaatggaaattcgtgaccttctttcagaatacgacttcccaggtgatgaccttccagttatccaaggttcagctcttaaagcacttgaaggcgacgaaaaatacgaagacatcatcatggaattgatgagcactgttgatgagtacattccagaaccagaacgtgatactgacaaacctttacttcttccagttgaagatgtattctcaatcactggacgtggtacagttgcttcaggacgtatcgaccgtggtactgttcgtgtcaacgacgaagttgaaatcgttggtattaaagaagatatccaaaaagcagttgttactggtgttgaaatgttccgtaaacaacttgacgaaggtcttgcaggggacaacgttggtgttcttcttcgtggtgttcaacgtgatgaaatcgaacgtggtcaagttcttgctaaaccaggttcaatcaacccacacactaaatttaaaggtgaagtttacatcctttctaaagaagaaggtggacgtcatactccattcttcaacaactaccgtccacaattctacttccgtacaactgacgtaacaggttcaatcgaacttccagcaggaacagaaatggttatgcctggtgataacgttactatcgaagttgaattgattcacccaatcgccgtagaacaaggtacta

SEQ ID NO: 208 - DNA, 819 bp, Streptococcus agalactiae
  ref <308>: DATABASE ACCESSION NUMBER: ATCC 12973
ctatccttgtagttgcttcaactgatggaccaatgccacaaactcgtgagcacatccttctttcacgtcaagttggtgttaaacaccttatcgtattcatgaacaaagttgaccttgttgatgatgaagaattgcttgaattggttgaaatggaaattcgtgaccttctttcagaatacgacttcccaggtgatgaccttccagttatccaaggttcagctcttaaagcacttgaaggcgatgaaaaatacgaagacatcatcatggaattgatgagcactgttgatgagtacattccagaaccagaacgtgatactgacaaacctttacttcttccagtcgaagatgtattctcaatcactggacgtggtacagttgcttcaggacgtatcgaccgtggtactgttcgtgtcaacgacgaagttgaaatcgttggtattaaagaagatatccaaaaagcagttgttactggtgttgaaatgttccgtaaacaacttgacgaaggtcttgcaggggacaacgttggtgttcttcttcgtggtgttcaacgtgatgaaatcgaacgtggtcaagttcttgctaaaccaggttcaatcaacccacacactaaatttaaaggtgaagtttacatcctttctaaagaagaaggtggacgtcatactccattcttcaacaactaccgtccacaattctacttccgtacaactgacgtaacaggttcaatcgaacttccagcaggaacagaaatggttatgcctggtgataacgttactatcgaagttgaattgattcacccaatcgccgtagaacaaggtacta

SEQ ID NO: 209 - DNA, 822 bp, Streptococcus agalactiae
  ref <308>: DATABASE ACCESSION NUMBER: ATCC 13813
agctatccttgtagttgcttcaactgatggaccaatgccacaaactcgtgagcacatccttctttcacgtcaagttggtgttaaacaccttatcgtattcatgaacaaagttgaccttgttgatgatgaagaattgcttgaattggttgaaatggaaattcgtgaccttctttcagaatacgacttcccaggtgatgaccttccagttatccaaggttcagctcttaaagcacttgaaggcgatgaaaaatacgaagacatcatcatggaattgatgagcactgttgatgagtacattccagaaccagaacgtgatactgacaaacctttacttcttccagtcgaagatgtattctcaatcactggacgtggtacagttgcttcaggacgtatcgaccgtggtactgttcgtgtcaacgacgaagttgaaatcgttggtattaaagaagatatccaaaaagcagttgttactggtgttgaaatgttccgtaaacaacttgacgaaggtcttgcaggggacaacgttggtgttcttcttcgtggtgttcaacgtgatgaaatcgaacgtggtcaagttcttgctaaaccaggttcaatcaacccacacactaaatttaaaggtgaagtttacatcctttctaaagaagaaggtggacgtcatactccattcttcaacaactaccgtccacaattctacttccgtacaactgacgtaacaggttcaatcgaacttccagcaggaacagaaatggttatgcctggtgataacgttactatcgaagttgaattgattcacccaatcgccgtagaacaaggtactac

SEQ ID NO: 210 - DNA, 825 bp, Streptococcus agalactiae
  strain CDCss-1073
cggagctatccttgtagttgcttcaactgatggaccaatgccacaaactcgtgagcacatccttctttcacgtcaagttggtgttaaacaccttatcgtattcatgaacaaagttgaccttgttgatgatgaagaattgcttgaattggttgaaatggaaattcgtgaccttctttcagaatacgacttcccaggtgatgaccttccagttatccaaggttcagctcttaaagcacttgaaggcgacgaaaaatacgaagacatcatcatggaattgatgagcactgttgatgagtacattccagaaccagaacgtgatactgacaaacctttacttcttccagttgaagatgtattctcaatcactggacgtggtacagttgcttcaggacgtatcgaccgtggtactgttcgtgtcaacgacgaagttgaaatcgttggtattaaagaagatatccaaaaagcagttgttactggtgttgaaatgttccgtaaacaacttgacgaaggtcttgcaggggacaacgttggtgttcttcttcgtggtgttcaacgtgatgaaatcgaacgtggtcaagttcttgctaaaccaggttcaatcaacccacacactaaatttaaaggtgaagtttacatcctttctaaagaagaaggtggacgtcatactccattcttcaacaactaccgtccacaattctacttccgtacaactgacgtaacaggttcaatcgaacttccagcaggaacagaaatggttatgcctggtgataacgttactatcgaagttgaattgattcacccaatcgccgtagaacaaggtactac

SEQ ID NO: 211 - DNA, 826 bp, Streptococcus anginosus
  ref <308>: DATABASE ACCESSION NUMBER: ATCC 33397
ggagctatccttgtagtagcttcaactgacggaccaatgcctcaaactcgtgaacacatccttctttcacgccaagtaggtgttaaataccttatcgtcttcatgaataaagttgacttggttgacgatgaagaattgcttgaattggttgaaatggaaatccgtgaccttctttcagaatacgatttcccaggtgatgaaatcccagttatccaaggttcagctcttaaagctcttgaaggtgatgaaaaatatgaagacatcatcatggaattgatggatactgttgatgaatacattccagaaccagaacgtgacactgacaaaccattgcttcttccagttgaagatgtattctcaattactggacgtggtactgttgcttcaggacgtatcgaccgtggtactgttaaagtcaacgacgaagttgaaatcgttggtatccgtgatgaaatccaaaaagcagttgttactggtgttgaaatgttccgtaaacaattggacgaaggtcttgctggagataacgtaggggttcttcttcgtggtatccaacgtgacgaaatcgaacgtggacaagttcttgctaaaccaggttcaattcatccacacactaaattcaaaggtgaagtttacatccttactaaagaagaaggtggacgtcatactccattcttcaacaactaccgtcctcaattctacttccgtactacagacgttacaggttcaatcgaacttcctgcaggtactgaaatggtaatgcctggtgataacgtaacaatcgacgttgaattgatccacccaattgccgtagaacaaggaactacat

SEQ ID NO: 212 - DNA, 827 bp, Streptococcus bovis
  ref <308>: DATABASE ACCESSION NUMBER: ATCC 33317
tggtgctatccttgtagtagcttctacagatggtccaatgccacaaacacgtgaacacatccttctttcacgtcaagttggtgttaaacaccttatcgtcttcatgaacaaagttgaccttgttgatgacgaagaattgcttgaattggttgaaatggaaatccgtgaccttctttcagaatatgatttcccaggtgatgaaatccctgtaatccaaggttcagctcttaaagcccttgaaggtgacactcactacgaagacatcatcatggaattgatgaacactgtagatgaatacattccagaaccaaaacgtgatactgacaaaccattgcttcttccagtcgaagacgtattctcaatcactggtcgtggtactgtagcatcaggacgtatcgaccgtggtactgttaaagtcaacgacgaagttgaaatcgttggtatccgtgacgacatccaaaaagctgttgttactggtgttgaaatgttccgtaaacaacttgatgaaggtatcgcaggggataacgttggtgttcttcttcgtggtatccaacgtgatgaaatcgaacgtggtcaagttcttgctaaaccaggttcaatccacccacacactaaattcaaaggtgaagtttacatccttactaaagaagaaggtggacgtcacactccattcttcaacaactaccgtcctcaattctacttccgtacaactgacgttacaggttcaatcgaacttccagcaggtactgaaatggtaatgcctggtgataacgttactatcgacgttgaattgattcacccaatcgccgttgaacaaggtactacat

SEQ ID NO: 213 - DNA, 821 bp, Streptococcus anginosus
  ref <308>: DATABASE ACCESSION NUMBER: ATCC 27823
gctatcctcgtagtagcttcaactgatggaccaatgcctcaaactcgtgaacatatccttctttcacgtcaagtaggtgttaaataccttatcgtcttcatgaacaaagttgacttggttgacgatgaagaattgcttgaattggttgaaatggaaatccgtgaccttctttcagaatacgatttcccaggtgatgaaatcccagttatccaaggttcagctcttaaagctcttgaaggtgatgaaaaatatgaagacatcatcatggaattgatggatactgttgatgaatacattccagaaccagaacgtgacactgacaaaccacttcttcttccagtcgaagatgtattctcaatcactggacgtggtactgttgcttcaggacgtatcgaccgtggtactgttaaagtcaatgatgaagttgaaattgttggtattcgtgacgaaatccaaaaagcagttgttactggtgttgaaatgttccgtaaacaattggacgaaggtcttgctggagataacgtaggggttcttcttcgtggtatccaacgtgacgaaatcgaacgtggacaagttcttgctaaaccaggttcaattcatccacacactaaattcaaaggtgaagtttacatccttactaaagaagaaggtggacgtcatactccattcttcaacaactaccgtcctcaattctacttccgtactacagacgttacaggttcaatcgaacttcctgcaggtactgaaatggtaatgcctggtgataacgtaacaattgatgttgagttgatccacccaattgccgtagaacaaggaactac

SEQ ID NO: 214 - DNA, 821 bp, Streptococcus cricetus
  ref <308>: DATABASE ACCESSION NUMBER: ATCC 19642
gctatccttgtagtagcttctacagacggaccaatgccacaaactcgtgaacacatcttgctttcacgccaagttggtgttaagagccttatcgtcttcatgaacaaggttgacttggttgacgatgaagaattgcttgaattggttgaaatggaaatccgtgatcttctttcagaatacgatttcccaggtgatgatatccctgttgttcaaggttcagctcttaaagcccttgaaggtgatacagctgccgaagacaagatcatggaattgatggacatcgttgatgactacattccagaaccaaaacgtgatactgataagccattgcttcttccagtcgaagacgtattctcaatcactggacgtggtactgttgcttcaggacgtatcgaccgtggtactgttaaggtcaatgacgaagttgaaatcgttggtatcaaggacgaaatccaaaaagcggttgttaccggagttgaaatgttccgtaaacaattggatgaaggtcttgcaggggataacgttggtgtgcttcttcgtggtatccaacgtgatgaaatcgaacgtggtcaagtattggctgcacctggttcaatccatccacacactaaattcaagggtgaagtttacatcctttctaaagatgaaggtggacgtcacactccattcttcaacaactaccgtccacagttctacttccgtacaactgacgtaactggttcaatcgaattgccagcaggtactgaaatggttatgcctggtgataacgttactatcgacgttgaattgatccacccaatcgctgttgaaaaaggtactac

SEQ ID NO: 215 - DNA, 821 bp, Streptococcus cristatus
  ref <308>: DATABASE ACCESSION NUMBER: ATCC 51100
tatccttgtagtagcttcaactgacggaccaatgccacaaactcgtgagcacatccttctttcacgtcaggttggtgttaaacaccttatcgtcttcatgaacaagatcgacttggttgatgacgaagaattgcttgaattggttgaaatggaaatccgtgacctcttgtcagaatacgacttcccaggtgacgatcttccagttatccaaggttcagctcttaaagctcttgaaggtgatactaagtacgaagacatcatcatggaattgatgaacactgttgatgagtacatcccagaaccagaacgtgatactgacaaacctcttcttcttccagtcgaagacgtattctcaatcactggtcgtggtacagttgcttcaggacgtatcgaccgtggtactgttcgtgtcaacgatgaaatcgaaatcgttggtatcaaagaagaaatccaaaaagcagttgttactggtgttgaaatgttccgtaaacagcttgacgaaggtcttgcaggggacaacgtaggtgtacttcttcgtggtatccaacgtgatgaaatcgaacgtggtcaagttatcgctaaaccaggttcaatcaacccacacactaaattcaagggtgaagtttacatccttactaaagaagaaggtggacgtcacactccattcttcaacaactaccgtccacagttctacttccgtacaactgacgttacaggttcaatcgaacttccagcaggtactgaaatggtaatgcctggtgataacgtaactatcgacgttgagttgatccacccaatcgccgttgaacaaggtactcctt

SEQ ID NO: 216 - DNA, 792 bp, Streptococcus downei
  ref <308>: DATABASE ACCESSION NUMBER: ATCC 33748
agtagcttctactgatggaccaatgccacaaactcgtgaacacatcttgctttcacgtcaggttggtgttaagaaccttatcgtcttcatgaacaaggttgacttggttgacgatgaagaattgcttgaattggttgaaatggaaatccgtgacctgctttcagaatacgatttcccaggtgatgatatccctgttgttcaaggttcagctcttaaggctcttgaaggtgatacagctgccgaagacaagatcatggaattgatggacatcgttgatgactacattccagaaccaaaacgtgatactgataagcctttgcttcttccagtcgaagatgtattctcaatcactggacgtggtactgtagcttcaggacgtatcgaccgtggtactgttaaggtcaacgacgaagttgaaatcgttggtatcaaggacgaaatccaaaaagcagttgttaccggagttgaaatgttccgtaaacaattggacgaaggtcttgcaggggataacgttggtgtgcttcttcgtggtatccaacgtgatgaaatcgaacgtggtcaagtgttggctgcgcctggttcgattcacccacacactaagtttaaaggtgaagtttacatcctttctaaagaagaaggtggacgtcatactccattctttaacaactaccgtccacagttctacttccgtacaactgacgtaactggttcaatcgaattgccagcgggtactgaaatggttatgcctggtgataacgttactatcgacgttgaattgatccacccaattgc

SEQ ID NO: 217 - DNA, 795 bp, Streptococcus dysgalactiae
  ref <308>: DATABASE ACCESSION NUMBER: ATCC 43078
gtagttgcttcaacagacggaccaatgccacaaactcgtgagcacatcctcctttcacgtcaggttggtgttaaacaccttatcgtgttcatgaacaaaattgaccttgttgacgatgaagaattgcttgaattggttgaaatggaaatccgtgaccttctttcagaatacgatttcccaggtgatgaccttccagttatccaaggttcagctcttaaagctcttgaaggcgacactaaatttgaagacatcatcatggaattgatggatactgttgattcatacattccagaaccagaacgtgacactgacaaaccattgcttcttccagtcgaagacgtattctcaatcacaggtcgtggtacagttgcttcaggacgtatcgaccgtggtactgttcgtgtcaacgacgaaatcgaaatcgttggtatcaaagaagaaactaaaaaagctgttgttactggtgttgaaatgttccgtaaacaacttgacgaaggtcttgcaggagacaacgtaggtatccttcttcgtggtgttcaacgtgacgaaatcgaacgtggtcaagttattgctaaaccaggttcaatcaacccacacactaaattcaaaggtgaagtatatatcctttctaaagacgaaggtggacgtcacactccattcttcaacaactatcgtccacaattctacttccgtacaactgacgtaacaggttcaatcgaacttccagctggtacagaaatggttatgcctggtgataacgtgacaatcaacgttgagttgatccacccaatcgcc

SEQ ID NO: 218 - DNA, 828 bp, Streptococcus equi subsp. equi
  ref <308>: DATABASE ACCESSION NUMBER: ATCC 9528
cggagctatccttgtagttgcttcaactgacggaccaatgccacaaactcgtgagcacatccttctttcacgtcaggttggtgttaagcaccttatcgtgttcatgaacaaggttgaccttgttgacgatgaagaattgcttgagcttgttgaaatggaaattcgtgaccttctttcagaatatgatttcccaggtgatgaccttccagttatccaaggttcagcgcttaaggctcttgaaggcgacagcaaatacgaagatatcatcatggaattgatggatactgttgattcatacattccagaaccagaacgtgacacagacaagccattgcttcttccagtcgaggacgtattctcaatcactggacgtggtactgttgcttcaggacgtatcgaccgcggtactgttcgtgttaacgacgaaatcgaaatcgttggtatcagagacgagatcaaaaaagcagttgttactggtgtcgaaatgttccgtaaacagcttgacgaaggtcttgcaggggacaacgttggtgttcttcttcgtggtgtacaacgtgatgaaatcgaacgtggtcaagttattgctaagccaggttctatcaacccacacactaaatttaaaggtgaagtatatatccttactaaagaagaaggtggacgtcacacaccattcttcaacaactatcgtccacaattctacttccgtactactgacgtaacaggttcaatcgagcttccagcaggtacagaaatggttatgcctggtgataacgtgactattgacgttgagttgatccacccaatcgccgtagaacaaggtactacatt

SEQ ID NO: 219 - DNA, 825 bp, Streptococcus ferus
  ref <308>: DATABASE ACCESSION NUMBER: ATCC 33477
cggtgcaatccttgtagtagcttctacagatggaccaatgccacaaactcgtgagcacatccttctttcacgtcaggtaggtgttaaacaccttatcgtcttcatgaacaaagttgacttggttgacgatgaagaattgcttgaattggttgaaatggaaatccgtgacctgctttcagaatatgatttcccaggtgatgaccttccagttatccaaggttcagctcttaaagcgcttgaaggtgatactgctcaagaagatgttatcatggaattgatgaaaaccgttgatgagtacatcccagaaccagaacgtgatactgacaaaccattgcttcttccagtcgaagatgtattctcaatcacaggtcgtggtactgtagcttcaggacgtatcgatcgtggtactgtaagagtcaacgatgaagttgaaatcgttggtatcaaagacgaaatcactaaagcagttgttaccggtgttgaaatgttccgtaaacaattggacgaaggtcttgctggtgataacgttggtgtgcttctccgtggtgtgcaacgtgatgaaatcgaacgtggtcaagtattggctaaaccaggttcaatcaacccacacactaaatttaaaggtgaagtttacatccttactaaagaagaaggtggacgtcatacaccattcttcaacaactaccgtccacagttctacttccgtacaactgacgtaactggttcaatcgaattgccagcaggtactgaaatggttatgcctggtgataacgtgactatcgacgttgaattgatccacccaatcgccgttgaacaaggtactac

SEQ ID NO: 220 - DNA, 826 bp, Streptococcus gordonii
  ref <308>: DATABASE ACCESSION NUMBER: ATCC 10558
cggagctatccttgtagtagcttcaactgatggtcctatgccacaaactcgtgagcacatccttctctcacgccaagttggtgttaaacacttgatcgtgttcatgaacaaagttgacttggttgacgatgaagaattgcttgagttggttgaaatggaaatccgtgacctcttgtcagaatacgacttcccaggtgacgatcttccagttatccaaggttcagctcttaaagctcttgaaggtgactctaaatatgaagatatcatcatggaattgatgaacactgttgatgagtacatcccagaaccagaacgcgacactgacaaaccattgcttcttccagtcgaagacgtattctcaatcactggacgtggtacagttgcttcaggacgtatcgaccgtggtatcgttaaagtcaatgacgaaatcgaaatcgttggtatcaaagaagaaatccaaaaagcagttgttactggtgttgaaatgttccgtaaacagcttgacgaaggtcttgcaggggacaacgttggtgtgcttcttcgtggtatccaacgtgatgaaatcgaacgtggacaagttattgctaaaccaggttcaatcaacccacacactaaattcaaaggtgaagtttatatccttactaaagaagaaggtggacgtcacactccattcttcaacaactaccgtccacagttctacttccgtacaactgacgttacaggttcaatcgaacttccagcaggtactgaaatggtaatgcctggtgataacgtaactatcgacgttgagttgatccacccaatcgccgttgaacaaggtactact

SEQ ID NO: 221 - DNA, 799 bp, Streptococcus anginosus
  ref <308>: DATABASE ACCESSION NUMBER: ATCC 27335
tgtagtagcttcaactgacggaccaatgcctcaaactcgtgaacatatccttctttcacgtcaagtaggtgttaaataccttattgtcttcatgaacaaagttgacttggttgacgatgaagaattgcttgaattggttgaaatggaaatccgtgatcttctttcagaatacgatttcccaggtgatgatattccagtaatccaaggttcagcacttaaagctcttgaaggtgatgaaaaatatgaagacatcatcatggaattgatgaatactgttgatgaatatattccagaaccagaacgtgatactgacaaaccattgcttcttccagtcgaagatgtattctcaatcactggacgtggtactgttgcttcaggacgtatcgaccgtggtactgttaaagtcaacgatgaagttgaaatcgttggtatccgcgaggaaatccaaaaagcagttgttactggtgttgaaatgttccgtaaacaattggacgaaggtcttgctggagataacgtaggggttcttcttcgtggtatccaacgtgacgaaattgaacgtggacaagttcttgctaaaccaggttcaattcatccacacactaaattcaaaggtgaagtttacatccttactaaagaagaaggtggacgtcatactccattcttcaacaactaccgtcctcaattctacttccgtactacagacgttacaggttcaatcgaacttcctgcaggtactgaaatggtaatgcctggtgataacgtaacaattgatgttgagttgatccacccaattgccgta

SEQ ID NO: 222 - DNA, 825 bp, Streptococcus macacae
  ref <308>: DATABASE ACCESSION NUMBER: ATCC 35911
tggtgctattcttgtagtagcttcaactgacggtccaatgcctcaaacgcgtgaacatatccttctttcacgccaagtaggtgttaaaaaccttattgttttcatgaataaagttgacttagttgatgatgaagaattgcttgaattggttgaaatggaaatccgtgatcttcttacagaatatgatttcccaggcgatgaacttccagttatccaaggttcagcacttaaagctcttgaaggtgatactaagtacgaagatattatcatggaattgttggatactgtagatgattacatcccagaaccacaacgtgatactgacaagccattgcttcttccagtcgaagatgttttctctattactggacgtggtactgttgcttcaggacgtattgaccgtggtactgttaaggttaatgatgaagttgaaatcgttggtattcgtgacgatattcaaaaagcagttgttactggtgttgaaatgttccgtaaacagcttgacgaaggtcttgctggtgataacgtcggtgtccttcttcgtggtatccaacgtgatgaaattgaacgcggtcaagttcttgctaaaccaggatcaattcatccacatactaaattcaaaggtgaagtttatattcttactaaagaagaaggtggacgtcatactccattctttaacaactaccgtccacagttctacttccgtacaactgatgtaactggttcaattgatttgccagcaggtactgaaatggttatgcctggtgataatgttacgattgatgttgaactgatccacccaatcgctgttgaacaaggtacaac

SEQ ID NO: 223 - DNA, 822 bp, Streptococcus gordonii
  ref <308>: DATABASE ACCESSION NUMBER: ATCC 33399
ctatccttgtagtagcttcaactgacggaccaatgccacaaactcgtgagcacatccttctttcacgtcaggttggtgttaaacaccttatcgtcttcatgaacaaagttgacttggttgacgacgaagaattgcttgaattggttgaaatggaaatccgtgacctattgtcagaatacgacttcccaggtgacgatcttccagttatccaaggttcagctcttaaagcccttgaaggtgacactaaatacgaagacatcgttatggaattgatgaacacagttgatgagtacatcccagaaccagaacgtgacactgacaaaccattgcttcttccagtcgaagacgtattctcaatcactggtcgtggtacagttgcttcaggacgtatcgaccgtggtatcgttaaagtcaacgacgaaatcgaaatcgttggtatcaaagaagaaactcaaaaagcagttgttactggtgttgaaatgttccgtaaacaacttgacgaaggtcttgccggagataatgtaggtgtccttcttcgtggtgttcaacgtgatgaaatcgaacgtggacaagttattgctaaaccaggttcaatcaacccacacactaaattcaaaggtgaagtttacatccttactaaagaagaaggtggacgtcacactccattcttcaacaactaccgtccacaattctacttccgtactactgacgttacaggttcaatcgaacttccagcaggtactgaaatggtaatgcctggtgataacgtgacaatcgacgttgagttgatccacccaatcgccgtagaacaaggtactacat

SEQ ID NO: 224 - DNA, 827 bp, Streptococcus mutans
  ref <308>: DATABASE ACCESSION NUMBER: ATCC 25175
ccctggtgctatccttgtagtagcttcaactgatggaccaatgccacaaactcgtgaacacattcttctttcacgtcaagttggtgttaaatacctcattgtcttcatgaataaagttgatttggttgacgatgaagaattgcttgaattggttgaaatggaaatccgtgatcttctttcagaatatgatttcccaggtgatgatattccagttattcaaggttcagctcttaaagctcttgaaggcgatactgctcaagaagatatcatcatggaattaatgcatactgttgatgactacattccagatccagaacgtgatactgacaagccgctccttcttccagtcgaagatgttttctcaatcactggtcgtggtactgttgcttcaggacgtattgatcgtggtactgttaaagttaacgatgaagttgaaatcgttggtatccgtgatgacattcaaaaagctgttgttactggtgttgaaatgttccgtaaacaattggatgaaggtattgcaggggataatgttggtgttctccttcgtggtatccaacgtgatgaaatcgaacgtggtcaagttcttgctaaaccaggttcaattcacccacatactaaattcaaaggtgaagtttatatccttactaaagaggaaggtggacgtcatacaccattcttcaataactatcgtccacaattctacttccgtacaactgacgtaactggttcaattgagttgccagcaggtactgaaatggttatgcctggtgataacgttactattgacgttgaattgatccatccaatcgctgttgaacaaggtacta

SEQ ID NO: 225 - DNA, 824 bp, Streptococcus parasanguinis
  ref <308>: DATABASE ACCESSION NUMBER: ATCC 15912
agctatccttgtagtagcttcaactgacggaccaatgccacaaacacgtgaacacatccttctttcacgtcaggttggtgttaaacacttgatcgtcttcatgaacaaagttgacttggttgatgatgaagaattgcttgaattggttgaaatggaaatccgtgaccttctttcagaatacgatttcccaggtgatgaccttccagttatccaaggttcagctcttaaagctcttgaaggtgactctaaatatgaagatatcatcatggaattgatggatactgttgatgagtacatcccagaaccagaacgcgatactgacaaaccattgcttcttccagtcgaagacgtattctcaatcactggacgtggtacagttgcttcaggacgtatcgaccgtggtgttgttcgtgtcaatgatgaaatcgaaatcgttggtatcaaagaagaaatccaaaaagcagttgttactggtgttgaaatgttccgtaaacaacttgacgaaggtcttgcaggggataacgttggtgtgcttcttcgtggtatccaacgtgatgaaatcgaacgtggacaagttatcgctaaaccaggttcaatcaacccacacactaaattcaaaggtgaagtttacatccttactaaagaagaaggtggacgtcatactccattcttcaacaactaccgtccacagttctacttccgtacaactgacgtaactggatctatcgaacttccaccaggaactgaaatggtaatgcctggtgataacgtgactatcgacgttgagttgatccacccaatcgccgttgaacaaggtactacat

SEQ ID NO: 226 - DNA, 824 bp, Streptococcus ratti
  ref <308>: DATABASE ACCESSION NUMBER: ATCC 19645
tggtgctatccttgtagtagcttcaactgatggaccaatgccgcaaactcgtgaacacatcttgctttcacgtcaagttggtgttaaataccttatcgtcttcatgaacaaggttgacttggttgatgatgaagaattgcttgaattggttgaaatggaaatccgtgatcttctttcagaatacgatttcccaggtgatgacattccagttatccaaggttcagcccttaaagctcttgaaggtgacactgaacaagaagatgttatcatggaattgatgaaaacagttgatgagtacatcccagatccagaacgcgatactgataagccattgcttcttccagtcgaagacgtgttctcaatcactggacgtggtactgttgcatcaggacgtatcgaccgtggtactgttaaagtcaatgacgaagttgaaatcgttggtatccgtgatgacatccaaaaagctgttgttactggtgttgaaatgttccgtaaacagcttgacgaaggtcttgctggtgataacgttggtgtacttcttcgtggtatccaacgtgatgaaatcgaacgcggtcaagttcttgctaaaccaggttcaattcatccgcatactaaatttaaaggtgaagtttacatccttactaaagaagaaggcggacgtcacactccattcttcaacaactaccgtccacagttctacttccgtacaactgacgtaactggttcaatcgaattgccagcaggtactgaaatggttatgcctggtgataacgtgactatcgacgttgaattgatccacccaatcgctgttgaacaaggtacta

SEQ ID NO: 227 - DNA, 795 bp, Streptococcus sanguinis
  ref <308>: DATABASE ACCESSION NUMBER: ATCC 10556
tgtagtagcttcaactgacggaccaatgccacaaactcgtgagcacatcttgctttcacgtcaggttggtgttaaacacttgatcgtcttcatgaacaaagttgacttggttgacgatgaagaattgcttgaattggttgaaatggaaatccgtgacctcttgtcagaatacgacttcccaggtgacgatcttccagttatccaaggttcagctcttaaagctcttgaaggtgactctaaatatgaagacatcatcatggaattgatggacactgttgatgagtacatcccagaaccagaacgcgatactgacaagccattgcttcttccagtcgaagacgtattctcaatcactggtcgtggtacagttgcttcaggacgtatcgaccgtggtatcgttaaagtcaacgacgaaatcgaaatcgttggtatcaaagaagaaatccaaaaagcagttgttactggtgttgaaatgttccgtaaacagcttgacgaaggtcttgcaggggacaacgtaggtgtgcttctccgtggtatccaacgtgatgaaatcgaacgtggacaagttatcgctaaaccaggttcaatcaacccacacactaaattcaagggtgaagtttatatccttactaaagaagaaggcggacgtcacactccattcttcaacaactaccgtccacagttctacttccgtacaactgacgttacaggttcaatcgaacttccagcaggtactgaaatggtaatgcctggtgataacgtaacaatcgacgttgagttgatccacccaatcgc

SEQ ID NO: 228 - DNA, 795 bp, Streptococcus sobrinus
  ref <308>: DATABASE ACCESSION NUMBER: ATCC 33478
tgtagtagcttctactgacggaccaatgccacaaactcgtgaacacatcttgctttcacgccaagttggtgttaagaacctcatcgtcttcatgaacaaggttgacttggttgatgatgaagaattgcttgaattggttgaaatggaaatccgtgatcttctttcagaatacgatttcccaggtgacgacattcctgttgttcaaggttcagctcttaaggctcttgaaggtgatacagctgccgaagacaagattatggaattgatggacatcgttgatgattacattccagaaccaaaacgcgatactgataagccattgcttctcccagtcgaagacgtattctcaatcactggtcgtggtactgttgcttcaggacgtattgaccgtggtactgttaaggttaacgacgaagttgaaatcgttggtatccgtgacgatatccaaaaagcagttgttactggagttgaaatgttccgtaagcaattggacgaaggtcttgctggagataacgttggtgtgcttcttcgtggtatccaacgtgatgaaattgaacgtggtcaagtattggctgcacctggttcaatccacccacacactaagttcaagggtgaagtttacatcctttctaaagatgaaggtggacgtcacactccattcttcaacaactaccgtccacagttctacttccgtacaactgacgtaactggttcaatcgaattgccagcaggtactgaaatggttatgcctggtgataacgttactatcgacgttgaattgatccacccaatcgc

SEQ ID NO: 229 - DNA, 797 bp, Streptococcus suis
  ref <308>: DATABASE ACCESSION NUMBER: ATCC 43765
tgtagtagcttcaactgacggtccaatgccacaaactcgtgagcacatccttctttcacgtcaggttggtgttaaacaccttatcgtcttcatgaacaaagttgacttggttgacgatgaagaattgcttgagttggttgaaatggaaatccgtgaccttctttcagaatacgatttcccaggtgatgatcttccagttatccaaggttcagctcttaaagctcttgaaggtgactctaagtacgaagacatcgttatggaattgatgaacactgttgatgagtacattccagaaccagaacgcgacactgacaaaccattgttgcttccagtcgaggacgtattctcaatcactggtcgtggtactgtagcttcaggacgtatcgaccgtggtactgttcgtgtcaacgacgaaatcgaaatcgttggtcttcaagaagaaaaatctaaagcagttgttactggtgttgaaatgttccgtaaacaacttgacgaaggtcttgccggcgataacgttggtgtgcttcttcgtggtgtacaacgtgatgaaatcgaacgtggtcaagttatctctaaaccaggttctatcaacccacacactaaattcaaaggtgaagtttacatccttactaaagaagaaggtggacgtcacactccattcttcgacaactaccgtccacagttctacttccgtacaactgacgtaactggttcaatcaaattgccagaaggtactgaaatggtaatgcctggtgataacgttactatcgacgttgaattgatccacccaatcgccg

SEQ ID NO: 230 - DNA, 793 bp, Streptococcus uberis
  ref <308>: DATABASE ACCESSION NUMBER: ATCC 19436
ttgttgttgcatcaactgatggaccaatgccacaaactcgtgagcacatccttctttcacgccaagttggtgttaaacaccttatcgttttcatgaacaaaatcgaccttgttgacgatgaagaattgcttgaattagttgaaatggaaatccgtgaccttctttcagaatacgatttcccaggtgatgacctaccagttatccaaggttcagctcttaaagctcttgaaggtgattctaaatacgaagacatcatcatggaattgatgaaaactgttgatgagtatattccagaaccagaacgtgatacagacaaaccattacttcttccagtcgaagacgtattctcaatcacaggtcgtggtactgtagcttcaggacgtatcgatcgtggtactgttcgtgtcaacgacgaaattgaaatcgttggtatcaaagaagaaactaaaaaagcagttgttactggtgttgaaatgttccgtaaacaacttgacgaaggtcttgcaggagataacgtaggtatccttcttcgtggtgttcaacgtgacgaaatcgaacgtggacaagttattgctaaaccaggttcaatcaacccacacactaaattcaaaggtgaagtttacatcctttctaaagatgaaggtggacgtcatactccattcttcaacaactaccgtcctcaattctatttccgtacaactgacgtaacaggttcaatcgaacttccagctggtactgaaatggtaatgcctggtgataacgtgacaatcagcgttgagttgatccacccaat

SEQ ID NO: 231 - DNA, 798 bp, Streptococcus vestibularis
  ref <308>: DATABASE ACCESSION NUMBER: ATCC 49124
ttgtagtagcatctactgacggaccaatgccacaaactcgtgagcacatccttctttcacgtcaggttggtgttaaacaccttatcgtcttcatgaacaaagttgacttggttgacgatgaagaattgcttgaattggttgaaatggaaatccgtgaccttctttcagaatacgatttcccaggtgatgatattccagttatccaaggttcagctcttaaagctcttgaaggtgattctaaatacgaagacatcatcatggacttgatgaacactgttgacgaatacattccagaaccagaacgtgacactgacaaaccattgttgcttccagtcgaagacgtattctcaatcactggtcgtggtactgttgcttcaggacgtatcgaccgtggtgttgttcgtgttaatgacgaagttgaaatcgttggtcttaaagaagaaatccaaaaagcagttgttactggtgtagaaatgttccgtaaacaacttgacgaaggtattgccggagataacgtcggtgtccttcttcgtggtatccaacgtgatgaaattgaacgtggtcaagtattggctgcacctggttcaatcaacccacacactaaattcaaaggtgaagtttacatcctttctaaagaagaaggtggacgtcacactccattcttcaacaactaccgtccacagttctacttccgtacaactgacgtaacaggttcaatcgaacttcctgcaggtactgaaatggttatgcctggtgataacgtgactatcgacgttgagttgatccacccaatcgccg

SEQ ID NO: 232 - DNA, 829 bp, Tatumella ptyseos
  ref <308>: DATABASE ACCESSION NUMBER: ATCC 33301
ggcgctatcctggttgttgctgcaactgacggccctatgcctcagacccgtgagcacatcctgctgggccgccaggtaggcgttccttacatcatcgtgttcctgaacaaatgtgacatggttgatgatgaagagctgctggaactggtagaaatggaagtccgtgacctgctgtcacagtacgacttcccgggtgacgacacgccaatcgttcgcggttcagcgctgaaagcactggaaggtgaaggcgagtgggaagagaagattctggagctggctggcttcctggattcttacatccctgagccagagcgtgctatcgatcagccgttcctgctgccaatcgaagacgtattctcaatctccggtcgtggtacagttgttaccggtcgtgtagagcgcgggatcatcaaagtcggtgaagaagttgagatcgttggtatcaaagatactgcgaaatcaacctgtaccggtgttgaaatgttccgtaaactgctggaccagggtcaggcgggtgagaacgttggtgttctgctgcgtggtatcaagcgtgaagagatcgaacgtggtcaggttctggctaaaccaggttcaatcaaaccacacacccagttcgagtcagaagtttatattctgtctaaagacgaaggcggccgtcatactccgttcttcaaaggctaccgtccacagttctacttccgtacaactgacgtgaccggaaccatcgaactgccggaaggcgtagagatggtaatgcctggtgacaacatcaaaatggttgttaccctgatccatccaatcgcgatggacgatggtctgcgtttcgcaa

SEQ ID NO: 233 - DNA, 829 bp, Trabulsiella guamensis
  ref <308>: DATABASE ACCESSION NUMBER: ATCC 49490
ggcgcaatcctggtagtagcagcgactgacggcccgatgccgcagactcgtgagcacatcctgctgggtcgtcaggtaggcgttccgtacatcatcgtgttcctgaacaaatgcgacatggttgatgacgaagagctgctggaactggtagagatggaagttcgtgaactgctgtctcagtacgatttcccgggcgatgacacgccgatcgtacgtggttctgctctgaaagcgctggaaggcgacgcagagtgggaagcgaaaatcatcgaactggcaggtttcctggattcttacattccggaaccagagcgtgcgattgacaagccgttcctgctgccgatcgaagacgtattctccatctctggtcgtggtaccgttgttaccggtcgtgtagagcgcggtatcatcaaagtgggtgaagaagtagaaatcgttggtatcaaagagactgcgaagtcaacctgtactggcgtagaaatgttccgcaaactgctggacgaaggccgtgctggtgagaacgtaggtgttctgctgcgtggtatcaaacgtgaagaaatcgaacgtggtcaggtactggctaagccgggcaccatcaacccgcacaccaagttcgaatctgaagtgtacattctgtccaaagacgaaggcggccgtcacactccgttcttcaaaggctaccgtccgcagttctacttccgtacaactgacgtgactggcaccatcgaactgccggaaggcgtagagatggtaatgccgggcgacaacatcaaaatggttgttaccctgatccacccgatcgcgatggacgacggtctgcgtttcgcaa

SEQ ID NO: 234 - DNA, 825 bp, Veillonella parvula
  ref <308>: DATABASE ACCESSION NUMBER: ATCC 10790
cggcgctatcttggttgtatccgcagctgacggccctatgcctcaaactcgcgaacacatcttgttggctcgccaagttggtgttcctgcaatcgtagtattcttgaacaaagctgacatggttgacgatgaagaattgatcgaattggtagaaatggaagttcgtgaacttctttcttcctacgaattccctggcgacgaagtacctatcgttgtaggttccgcgttgaaagctttggaaggcgatgctcaatatgtagctaaaattgacgaattgatggacgctgtagactcctacatcccaacaccagttcgtgacactgataaaccattcttgatgcctgtggaagatgttttcacaatcactggtcgtggtacagtagcaactggccgtgttgaacgtggtcaagtaaacgttggtgatactgttgaagtagtaggcttgaaagaaaaagctgaacaatacgtagtaacaggtcttgaaatgttccgtaaagtgttggattctgcagtagcaggtgacaacgtaggtgcattgcttcgtggtgttgatcgtaaagacatygaacgtggtcaagtattggctaaaccaggttccatcaacccacayacaaaattcaaagcagaagtatacgtattgactaaagaagaaggtggtcgtcatactccattcttctccaactaccgtccacaattctacttccgtacaacagacgtaacaggtgttgtaaaccttcctgaaggtgtagaaatgtgtatgcctggcgataacgtaacaatggaaatcgaattgattactccaatcgctatcgaagaaggtcttcg

SEQ ID NO: 235 - DNA, 825 bp, Yersinia enterocolitica
  ref <308>: DATABASE ACCESSION NUMBER: ATCC 9610
cgctatcctggttgttgctgcaactgatggcccaatgccacagactcgtgagcacatcctgttgggtcgtcaggttggtgttccttacatcatcgtattcatgaacaaatgtgacatggttgacgatgaagagctgctagaactggtagaaatggaagtgcgcgatcttctgtctacctacgatttcccaggcgatgatacgccagttgttcgtggttccgcgctgaaagcattggaaggcgaacctgagtgggaagcaaaaattatcgaactggctggctacctggattcttacatcccagaaccagagcgtgctatcgataagccgttcctgctgccaatcgaagacgtattctctatctctggtcgtggtactgttgtaacgggtcgtgtagagcgcggtatcgttaaagttggtgaagaagtcgaaattgttggcctgaaagataccgttaaatctacttgtactggcgttgaaatgttccgcaaactgctggatgaaggccgtgcaggtgagaacgttggtgttctgctgcgtggtatcaagcgtgaagatatcgaacgtggtcaagttcttgctaaaccaggttcgattaaaccacacaccaaatttgaatcagaagtttatattctgagcaaagatgaaggtggtcgccatactccgttcttcaaaggctaccgtcctcagttctacttccgtacaactgatgtaaccggtactattgaactgccagaaggcgttgagatggtgatgccaggtgataacattcaaatgattgttaacctgattgctcctatcgcaatggatgacggcttgcgctttgc

SEQ ID NO: 236 - DNA, 828 bp, Yersinia frederiksenii
  ref <308>: DATABASE ACCESSION NUMBER: ATCC 33641
ggcgcgatcctggttgttgctgccactgatggcccgatgccacagactcgcgagcacattctgttagggcgtcaggtgggtgttccttacatcctggtcttcctgaacaaatgtgacatggttgacgacgaagagctgctggaactggtagaaatggaagttcgtgaacttctgtctcagtacgatttccctggcgacgacactccagttatccgtggttctgcgctgaaagcgctggaaggcgaagctgagtgggaagcaaaaatcatcgaattggctgaggcgctggatagctatattccacagccagagcgtgcgattgataaaccattcctgctgccaatcgaagacgtattctcaatctctggccgtggtactgttgtcaccggtcgtgtagagcgcggtatcgttaaagtcggcgaagaagtcgaaatcgttggtatcattgataccatcaagactacctgtactggtgttgaaatgttccgcaaattgctggacgaaggccgtgcgggtgagaacgttggtgttctgctacgtggtactaaacgtgatgacgtacaacgtggtcaggtattggcaaaaccaggttctatcaagccacacaccaaatttgaatcagaagtttatattctgagcaaagatgaaggtggtcgccatactccgttcttcaaaggttatcgtcctcagttctacttccgtacaactgacgtgaccggtactatcgaactgccagaaggcgttgagatggtgatgccaggtgataacattcaaatgattgttaacctgattgctcctatcgcaatggatgacggtctgcgctttgcg

SEQ ID NO: 237 - DNA, 813 bp, Yersinia intermedia
  ref <308>: DATABASE ACCESSION NUMBER: ATCC 29909
cttggttgtcgctgcaactgatggtcctatgccacagactcgcgagcacatcctgctaggtcgtcaggtgggtgttccttacatcctggtcttcctgaacaagtgtgacatggttgacgatgaggagttgctggaattggtagaaatggaagtccgcgaacttctgtctcaatatgatttccctggcgatgatactcctgttatccgtggttcagcgctgaaggcgttggaaggcgagcctgaatgggaagcaaaaattatcgaattagctgaggcgctggatagttatattccacagccagagcgcgcgattgatagaccattcttgctgccaatcgaagacgtattctctatctcaggtcgtggtacagtcgtcactggtcgtgtagagcgtgggatcgttaaagttggcgaagaagttgaaatcgttggtattatcgattccattagaacaacatgtactggcgttgaaatgttccgcaaattgctggacgaaggccgcgcgggtgagaacgttggtgttctactgcgtgggactaaacgtgatgacgtacagcgtggtcaggtattagctaagccaggttctatcaagccacatactaaattcgaatccgaagtttatattctgagcaaagatgaaggcgggcgtcacacgccgttcttcaaaggctaccgtcctcagttctacttccgtacaacggatgtaaccggtactattgaattgccagacggcgttgagatggtgatgccaggtgataacattcaaatgattgttaacctgattgcacctattgcgatggatgatggtctgcg

SEQ ID NO: 238 - DNA, 829 bp, Yersinia pestis
  strain KIM D27
ggagcgatcttggttgttgctgcaaccgatggccctatgccgcagactcgtgagcatatcctgctgggccgccaggttggtgtcccatacattattgtcttcctgaacaaatgtgacatggttgacgatgaagagttgctagagttggttgaaatggaggttcgtgagcttctgtctcaatacgatttcccaggcgacgacactccagtcatccgtggttcagcgttgaaagccctggaaggtgacgctgagtgggaagctaaaattatcgagttggcagaagctctggatagctatattccgcaaccagaacgcgctattgatagaccattcctattgccaattgaagacgtattctctatttctggtcgtggtactgtagttactggtcgtgtagaacgtggtattgttaaggtcggcgaagaagttgaaatcgttggtattatcgatacgattaaaacaacttgtactggcgttgaaatgttccgcaagctgctggatgaaggccgtgctggtgaaaatgttggtgttctgctgcgtggtactaagcgtgacgatgttcagcgtggtcaagtactggcgaaaccaggttctatcaagccacacacgaagtttgagtcagaagtttatattctgagcaaagatgaaggcggccgtcatacaccgttcttcaagggctaccgtcctcagttctacttccgtacaactgacgtgaccggtaccattgagctgccagaaggcgttgaaatggtcatgcctggtgacaacgtaaacatggttgttaacctaattgctcctatcgcaatggatgatggtctgcgcttcgcaa

SEQ ID NO: 239 - DNA, 817 bp, Yersinia pseudotuberculosis
  ref <308>: DATABASE ACCESSION NUMBER: ATCC 29833
tggagcgatcttggttgttgctgcaaccgatggccctatgccgcagactcgtgagcatatcctgctgggccgccaggttggtgtcccatacattattgtcttcctgaacaaatgtgacatggttgacgatgaagagttgctagagttggttgaaatggaggttcgtgagcttctgtctcaatacgatttcccaggcgacgacactccagtcatccgtggttcagcgttgaaagccctggaaggtgacgctgagtgggaagctaaaattatcgagttggcagaagctctggatagctatattccgcaaccagaacgcgctattgatagaccattcctattgccaattgaagacgtattctctatttctggtcgtggtactgtagttactggtcgtgtagaacgcggtattgttaaggtcggcgaagaagttgaaatcgttggtattatcgatacgattaaaacaacttgtactggcgttgaaatgttccgcaagctgctggatgaaggccgtgctggtgaaaatgttggtgttctgctgcgtggtactaagcgtgacgatgttcagcgtggtcaagtactggcgaaaccaggttctatcaagccacacacgaagtttgagtcagaagtttatattctgagcaaagatgaaggcggccgtcatacaccgttcttcaagggctaccgtcctcagttctacttccgtacaactgacgtgaccggtaccattgagctgccagaaggcgttgaaatggtcatgcctggtgacaacgtaaacatggttgttaacctaattgctcctatcgcaatggatgatggt

SEQ ID NO: 240 - DNA, 829 bp, Yersinia rohdei
  ref <308>: DATABASE ACCESSION NUMBER: ATCC 43380
tggcgcgatcctggttgttgctgcaactgatggcccaatgccacagactcgcgagcacatcctgttgggtcgtcaagtgggtgttccttacatcttagtcttcctgaacaagtgtgacatggttgacgacgaagagttgctggaactggttgaaatggaagttcgtgagcttctgtctcaatacgatttccctggcgatgacactccggttattcgtggttccgcgctgaaagcgctggaaggcgaggccgagtgggaagccaaaattattgaacttgctgaagcactggatagctacattccacagccagagcgcgcgattgataaaccattcttgctgccaatcgaagacgtattctctatctcaggccgtggaacagttgttaccgggcgtgttgagcgcggtatcgtcagagtgggcgaagaagttgaaatcgtgggtatcatcgacaccattaaaaccacttgtaccggtgttgaaatgttccgcaaactgctggacgaaggccgtgccggtgagaacgttggtgttctgctgcgcggtactaaacgcgatgacgtgcaacgtggtcaagtgttggctaaaccaggttctattaagccgcataccaaatttgagtcagaagtttatattctgagcaaagatgaaggtggtcgtcatactccgttcttcaaaggttaccgtccacagttctacttccgtacaactgacgtgaccggtaccatcgaactgccagacggtgttgagatggtgatgccaggtgataacattcaaatgattgttaacctgattgcgcctattgcaatggatgacggtctacgatttgca

SEQ ID NO: 241 - DNA, 804 bp, Yokenella regensburgei
  ref <308>: DATABASE ACCESSION NUMBER: ATCC 35313
tggcgcgatcctggttgttgctgcgactgacggcccgatgccgcagactcgtgagcacatcctgctgggtcgtcaggtaggcgttccgtacatcatcgtgttcctgaacaaatgcgacatggttgatgacgaagagctgctggaactggtagaaatggaagttcgtgaacttctgtctcagtacgatttcccgggcgacgacactccgatcatccgtggttctgctctgaaagcgctggaaggcgaagcagagtgggaagctaaaatcgttgagctggctggcttcctggattcttacatcccagaaccagttcgtgctatcgacctgccgttcctgctgccgatcgaagacgtattctccatctccggtcgtggcaccgttgttaccggtcgtgtagagcgcggtatcgttaaagttggcgaagaagttgaaatcgttggtatcaaagagactgctaagtctacctgtaccggcgttgaaatgttccgcaaactgctggacgaaggccgtgctggtgagaacgttggtgttctgctgcgtggtatcaaacgtgaagaaatcgaacgtggtcaggtactggctaagccgggttccatcaagccgcacaccaaattcgaatctgaagtttatatcctgtccaaagacgaaggcggccgtcatactccgttcttcaaaggctaccgtccgcagttctacttccgtacaactgacgtgactggtaccatcgaactgccggaaggcgtagagatggtaatgccgggcgacaacatcaaaatggttgttaccctgatccacccgatcgc

SEQ ID NO: 242 - DNA, 849 bp, Achromobacter xylosoxidans subsp. denitrificans
  ref <308>: DATABASE ACCESSION NUMBER: ATCC 15173
tcagttcccccgcgatcacatgcccaagatctacgaagcgcttactctggccgacgagggttcctcgttcgccgaaaagggtctgacgctggaagtgcagcaacagctgggcgacggcgtggtgcgtaccatcgcgctgggctccagcgacggcctgcgccgcggtatgaaggtcaccggtacgggcgcgccgatctcggtgccggtcggcaccggcacgctgggccgcatcatggacgtgctgggtcgtcccatcgacgaagccggcccgatccagcacgaagaaaagcgtggcattcaccagccggctccccgtttcgacgaactgtcgccgtcggtggaactgctggaaaccggcatcaaggttattgacctggtctgcccgttcgccaagggcggcaaggtcggcctgttcggcggcgccggcgtgggcaagaccgtcaacatgatggaactgatcaacaacatcgccaagcagcacagcggcttgtcggtgttcgccggcgtgggcgagcgtacccgcgaaggcaacgacttctaccacgaaatggaagagtcgaacgttctggacaaggttgcgatggtgttcggtcagatgaacgaacccccgggcaaccgtctgcgcgtggcgctgaccggcctgaccatggccgagaagttccgcgacgaaggccgcgacatcctgttcttcgtggacaacatctaccgctacaccctggccggtacggaagtgtccgcgctgctgggccgtatgccgtcggcagtgggctaccagcccacgctggccgaagaaatgggcaagctgcaagagcgcatcacctcgaccaagaccggctcgatcacctcgat

SEQ ID NO: 243 - DNA, 787 bp, Acinetobacter baumannii
  ref <308>: DATABASE ACCESSION NUMBER: ATCC 19606
tgaaactactttagaagttcagcaacaacttggtgatggtgttgttcgtaccatcgcaatgggttctacagaaggtcttaaacgtggtcttactgtaactagcacaaacgcaccgatctctgttccagttggtacagccactcttggccgtatcatggacgttttaggtcgtcctatcgatgaagcaggtcctgttgcgactgaagaacgtttgccgattcaccgtcaagcgccttcttatgctgaacaagcagcttctactgaccttttagaaactggtattaaagtcatcgacttactttgcccgtttgcgaaaggtggtaaagttggtttattcggtggtgctggtgttggtaaaaccgttaacatgatggaattgatcaacaacatcgcgaaagcacactcaggtttatctgtgtttgctggtgttggtgagcgtactcgtgaaggtaatgacttctatcacgaaatgaaagattctaacgttcttgacaaagtagcaatggtctacggtcagatgaacgagccaccaggtaaccgtttacgcgtagcgttaactggtttgactatggctgaatacttccgtgatgaaaaagacgaaaacggtaaaggtcgtgacgtattattattcgtcgacaacatctaccgttatacacttgcaggtactgaagtatcagcattgttaggtcgtatgccatctgcggtaggttaccaacctacacttgcagaagaaatgggtgttcttcaagagcgtattacatctactaaatctggttcgatcacttcg

SEQ ID NO: 244 - DNA, 825 bp, Acinetobacter lwoffii
  strain CDCF 3697
gttcctaagatctatgacgctctccacgttgatggcactgaaactacattagaagttcagcaacaacttggtgatggcgtagttcgtactattgcaatgggttctactgaaggccttaagcgtggtttgaacgtaactaacactaacgcgccgatttctgtaccagtaggtacagcgactctaggtcgtatcatggacgttcttggtcgcccaatcgacgaagctggtccagttgcgactgaagcgcgtttgccgattcaccgtcaagcaccttcttatgctgaacaagcagcttctactgaccttttagaaactggtattaaagtcatcgacttactttgcccgttcgctaaaggtggtaaagttggtctgttcggtggtgccggtgttggtaaaactgtaaacatgatggagttgatcaacaacatcgctaaagcgcactcaggtttatctgtattcgctggtgttggtgagcgtactcgtgaaggtaatgacttctatcacgagatgaaagactcaaacgttctagacaaagtagcaatggtctacggtcagatgaacgagccaccgggtaaccgtttacgcgtagcgttgactggtttgaccatggctgagtacttccgtgacgagaaagacgaaaacggcaaaggccgtgacgtactattgttcgtagataacatctaccgttatacactagcaggtactgaagtatcagcacttctaggtcgtatgccgtctgcagtaggttaccaaccgacacttgcagaagagatgggtgttcttcaagaacgtattacatcgactaagtctggttcgattacgtca

SEQ ID NO: 245 - DNA, 837 bp, Staphylococcus saprophyticus
  strain CSG 197
caatgaagttccagaaattaacaatgccttagtcgtagacgttgaaagagatgaaggtacagtatctcttacattagaagtggcattacaacttggcgatgatgtcgtacgtacaattgcaatggattctactgatggtgttaaacgtggtacagaagttcgagatagcggagatagcatcagtgttccagttggtgatgctacgttaggacgtgtgtttaatgttcttggtgatacaattgacttagacgagaagcttgatacttctgtcaaacgtgatccaattcatagagaagcacctgcattcgatcaattatcaacaaaagttgaaatcttagaaacaggtattaaagtaattgatttacttgcaccatatattaaaggtggtaaaatcggtttattcggtggcgctggtgtaggtaaaacagtattaattcaagaattaattaataatatagctcaagaacatggtggtatttcagtatttgccggcgtaggtgaacgtacgcgtgaaggtaatgacttatactacgaaatgagtgatagtggtgttattaagaaaacagctatggtcttcggacaaatgaatgagccacctggtgcgcgtatgcgtgttgctttatcaggcttaacaatggctgaacacttccgtgatgtacaaggacaagatgttttactatttattgataacatattcagatttacgcaagctggttcagaagtatcagcactattaggtcgtatgccatcagccgttggttatcaacctacccttgctactgaaatgggtcaattacaagaacgtattacatcaacaactaaaggatctgtaacgtc

SEQ ID NO: 246 - DNA, 851 bp, Alcaligenes faecalis
  ref <308>: DATABASE ACCESSION NUMBER: ATCC 15554
ttcccccgcgacagcatccctaaagtctacgaagcattgacgctcgttgacgaaagttcggctttcgcagaaaaaggcctgacttttgaagtacagcaacaattgggtgacggtgtagttcgcaccatcgccatgggttccagcgacggcctgcgccgcggtatggaagtggccggttcgggcgctcccatctccgttcccgtgggtgtcggcaccctgggtcgcattatggacgttctgggtcgccctattgacgaagtcggtcctattcagtccgacgagcgtcgcgccattcaccagcctgcgcctactttcgacgaactgtcgccttccgtagagctgctggaaaccggtattaaagtgattgacctggtttgcccgttcgccaagggtggtaaggttggtctgttcggtggtgccggtgtgggcaagaccgtgaacatgctggagctgatcaacaacatcgccaaggcacacagcggtctgtccgtgtttgccggtgtgggtgagcgtacccgtgaaggtaacgacttctaccacgaaatggccgatgctggcgttatccagatggacaacctgagcgagtccaaagtggccatggtgttcggtcagatgaacgaacctccaggcaaccgtctgcgtgtggcactgtccggcctgaccatggccgagaagttccgtgacgaaggccgtgacatcctgttctttgtggacaacatctaccgctacacgctggccggtacagaagtgtccgctctgctgggtcgtatgccttccgcagtgggttaccagcctacgctggccgaggaaatgggtaagctgcaagagcgcattacctccaccaagaccgg

SEQ ID NO: 247 - DNA, 846 bp, Bacillus anthracis
  strain 4229
gatggcggaaagctaccagaaatctacaacgcccttacggtaaaacagagcaacgaaaacggaacaagcattaacttaacatttgaagttgcacttcatttaggtgatgacacagttcgtacagttgcaatgtcttccacagatggacttgttcgtggcacagaagtagaagatactggtaaagcaatctctgtaccagttggtgatgcaacacttggtcgtgtatttaacgtattaggtgatgcaattgacttagatggtgaggttcctgcggatgtacgtcgtgatccaattcaccgtcaagcacctgcattcgaagaattatctactaaagtagaaattcttgaaactggtattaaagtagtagacttacttgctccttacattaagggtggtaagatcggtctattcggtggtgccggtgtaggtaaaacggtattaattcaggaattaatcaataacatcgcacaagaacacggtggtatctctgtattcgctggtgtaggtgagcgtactcgtgagggtaatgacttataccacgaaatgagcgattctggcgtaattaagaaaactgcgatggtattcggacaaatgaacgagccacctggagcacgtcaacgtgttgcgttaacaggtttaacaatggctgagcatttccgtgatgagcaaggacaagatgtacttctgttcatcgataatatcttccgtttcacgcaagcaggttctgaagtatctgcccttcttggccgtatgccatctgcggtaggttaccaaccaacacttgcaacagaaatgggtcaattacaagagcgtattacatctacaaataaagggtctatcacgtct

SEQ ID NO: 248 - DNA, 810 bp, Bacillus cereus
  ref <308>: DATABASE ACCESSION NUMBER: ATCC 14579
ccagaaatctacaatgcccttacggtaaaacaaagcaacgaaaacggaagcatgaacttaacatttgaagttgcacttcatttaggtgatgatacagttcgtacagttgcgatgtcttccacagatggacttgttcgtggcacagaagtagaagatactggtaaagcaatctctgtaccagttggtgatgcaacacttggacgtgtattcaacgtattaggtgatgcaattgacttagatggtgaacttcctgcggatgtacaccgtgatccaattcaccgtcaagcacctgcattcgaagaattatctactaaagtagaaattcttgaaactggtattaaagtagtagacttacttgctccttacattaagggtggtaagatcggcctattcggtggtgccggcgtaggtaaaacagtattaattcaggagttaatcaataacatcgcacaagagcacggtggtatctctgtattcgctggtgtaggtgagcgtactcgtgagggtaatgacttataccacgaaatgagcgattctggcgtaatcaagaaaactgcgatggtattcggacaaatgaacgagccacctggagcacgtcaacgtgttgcattaacaggtttaacaatggctgagcatttccgtgatgagcaaggacaagacgtacttctgttcatcgataacatcttccgtttcacgcaagcgggttctgaagtatctgcccttcttggtcgtatgccatctgcggtaggttaccaaccaacacttgcaacagaaatgggtcaattacaagagcgtattacatctacaaat

SEQ ID NO: 249 - DNA, 944 bp, Bacteroides distasonis
  ref <308>: DATABASE ACCESSION NUMBER: ATCC 8503
ctttgattatgggacagaagaaacagtaaccctcccccgtatccacgacgccatggagatttcccgcccaaacggaaagatcttgatcgtcgaagttcagcaacacatcggggaaaacaccgtccgtaccgtagcgatggatacgaccgacggattgagacgaggcatggaggccgtgtcatacggaatgcccatcaccatgccgaccggcgaccaagtcaaaggacgtttaatgaatgtcaccggcgaccctatcgatggcatggcccagcttactaaagacggggctcttcccatccatcgtgagcctcctaaattcgaggatctgacaacgacccaagaggtcttgtacacgggtattaaagtaatcgatttattggaaccttacgccaaaggaggcaagatcggacttttcggaggagccggagtcggcaaaacggtattgatcatggaattgatcaacaacatcgcaaagaaaaacaacggattctccgtcttcgccggtgtgggtgaacgtacacgtgaaggaaatgacctattgcgtgaaatgatccaatccggtgtcatccgatacggcgaggagtttaagaagagtatggaggcaggcaactgggacttgtcgaagatcgattacgatgaattggctaagtcgcaggctaccttggtattcgggcagatgaacgaaccgccgggcgcccgctcgtccgtggccttatccggtttgacgatcgccgaatccttccgtgacaaagcctctgagggagaaagaaaagatatattattcttcatcgataatatcttccgtttcacccaagccggttccgaggtttccgccttgctggggcgtatgccttccgccgtaggttaccaaccgacattggccacggaaatgggagctatgcaagagcgtatcacttcaaccaagaagggctccatcacctccg

SEQ ID NO: 250 - DNA, 939 bp, Bacteroides ovatus
  ref <308>: DATABASE ACCESSION NUMBER: ATCC 8483
ttgagggtacggatgcagaattggtgctgccaagcatccacgacgcactggagataaagaggccaaacggcaaaatactggttgtagaagttcagcaacatatcggcgaaaatacggtgcgtaccgtagcgatggacagtactgacggacttcagagaggcatgaaagtgtatcccaccggaggcccgatcacgatgccgattggcgaacagattaaaggacgactgatgaacgtagtcggtgattcgatcgacggtatgaaaggactcgaccgcaaaggtgcatattccattcatcgcgacccccctaagtttgaggatttgactactgtgcaagaggtgctcttcacaggtatcaaagtgatcgacctgctcgaaccgtatgccaaaggtggtaaaatcggtttgttcggcggtgccggtgtaggaaagactgtattgattcaggaacttatcaataatatcgccaagaaacataatggattctctgtatttgccggagtaggtgaacgtacccgtgaaggtaacgacttgctgcgcgaaatgattgaatccggtgtaatccgttacggcgaagcattcaaagaaggaatggagaaaggtcactgggatctttcgaaagtggattataacgaactggagaaatcgcaagtgtctctgattttcggtcagatgaacgagcctccgggcgcacgtgcctctgtggcattgtccggactgacggtggcggaatctttccgcgacgcaggaaaagaaggtgagaaacgcgatattctgttctttattgataatatcttccgtttcacgcaagcaggttcagaagtgtccgcccttttgggacgtatgccctccgctgttggttaccagcccacgttggctacggaaatgggtgcgatgcaggaacgtatcacgtctacccgcaaaggttctatcacctccg

SEQ ID NO: 251 - DNA, 833 bp, Leclercia adecarboxylata
  ref <308>: DATABASE ACCESSION NUMBER: ATCC 23216
cgaattccctcaggatgccgtaccgcgcgtgtacgatgctcttgaggttcagaatggtaatgagagcctggtgctggaagttcagcagcagctcggcggcggtattgtgcgtaccatcgccatgggttcttccgacggtctgcgtcgtggtctggaagttaaagacctcgagcacccaatcgaagtaccagtaggtaaagcaaccctgggccgtatcatgaacgtcctgggtcagccgatcgacatgaaaggcgacatcggcgaagaagagcgttgggctatccaccgttcagcaccttcctatgaagagctgtccagctctcaggaactgctggaaaccggcatcaaagttatcgacctgatgtgtccgttcgcgaagggcggtaaagttggtctgttcggcggtgcgggtgtaggtaaaaccgtaaacatgatggagctgatccgtaacatcgcgatcgagcactccggttactccgtgtttgcaggcgtgggtgagcgtactcgtgagggtaacgacttctaccacgaaatgaccgactccaacgttctggacaaagtatccctggtttacggccagatgaacgagccaccaggaaaccgtctgcgcgttgcgctgaccggcctgaccatggctgagaagttccgtgacgaaggtcgtgacgtactgctgttcgttgacaacatctaccgttacaccctggccggtacggaagtatccgcactgctgggtcgtatgccatcagcagtaggctaccagccgaccctggcggaagagatgggtgttctgcaggaacgtatcacctctaccaaaaccggttctatcacctccg

SEQ ID NO: 252 - DNA, 819 bp, Stenotrophomonas maltophilia
  CDC F3338
gtgtacgacgcactgaaggtggaaaacaccgagatcaccctcgaagtccagcagcagctgggcgacggcgtggtgcgtaccatcgccctcggttccaccgacggcctgaagcgcaacctggttgccgtcaacaccggccgtggcatctcggtgccggtcggcgccggcaccctgggccgcatcatggacgtgctgggccgtccgatcgacgaagccggcccggtcgctgccagcgacaactgggaaatccaccgcgctgcgccgtcgtatgaagaccagtccccggccaccgagctgctggaaaccggcatcaaggtcatcgacctgatgtgcccgttcgccaagggcggcaaggtcggcctgttcggcggcgccggcgtcggcaagaccgtcaacatgatggaactgatcaacaacatcgccaaggcgcacagcggcctgtccgtgttcgccggcgtgggtgagcgtacccgtgagggcaacgacttctaccacgagatgaaggactccaacgtcctggacaaggtggcgatggtgtacggccagatgaacgagccgccgggcaaccgtctgcgcgtcgccctgaccggcctgaccatggccgagtacttccgcgatgagaaggacgaaaacggcaagggcaaggacgtcctgctgttcgtcgacaacatctaccgctacaccctggccggtaccgaagtgtcggcactgctgggccgcatgccgtccgcggtgggttaccagccgaccctggccgaggaaatgggcgtcctgcaggagcgcatcacctcgaccaagaatggttcgatcacctcgatc

SEQ ID NO: 253 - DNA, 864 bp, Bartonella henselae
  ref <308>: DATABASE ACCESSION NUMBER: ATCC 49882
agtttgaaggccctttgccaaatattctcaatgcattagaaacagataatttgggcaatcggctagttttagaagttgctcagcatttgggtgaaaataccgtgcgtaccattgccatggatactaccgatggtcttgtccgtggtcaaaaagtttttgatacaggaacacagatcagtgttcccgtgggagaagcaacacttggtcgtattatgaatgtgattggagagccggttgataatgttggcccaattgctacaagcaaaacccgttccattcaccaagaggctcctgaatatgtggagcaatcaaccgcatcagaaatccttgtgactggtattaaagtcgttgatctgttagctccttattctaaaggggggaaggttggtttgtttggaggtgccggtgttggtaaaaccgttctcattatggagcttatcaacaatattgcaaaggcgcatggtggctattcagtgtttgccggtgttggtgaacgtacacgtgagggaaatgatctttattatgaaatgatcgaaagccgtgtgaatgtgaatccaaaagacaacaatggttcaacagaaggatcaaaatgtgcactcgtttatgggcaaatgaatgaaccaccaggggcgcgtgcacgtgtggctctttcaggattgaccattgcagaaagtttccgtgatgagggacaagatgttttgttcttcgtagataatattttccgttttacgcaagcaggcgctgaagtgtcagctcttttagggcgtattccttctgctgtagggtatcagccaactttggcaactgatatgggggctttgcaagagcgtattaccagtacaagaacaggctctattacctctg

SEQ ID NO: 254 - DNA, 866 bp, Bifidobacterium adolescentis
  ref <308>: DATABASE ACCESSION NUMBER: ATCC 15703
ttcccggtgggccacctgcccgacatttacaatgcacttaccgttgaactgkccaacaccggygtccacgaasagggcgagaccaccaagaagatcacccttgmggttgaacagcatcttggcgattccaccgtgcgtaccgtcgctctgaagccgactgacggccttgtgcgtggcgccaccgtgtatgacaccggcggcccgatctctgtgccggttggcgatgtcaccaagggccacgtattcgacgtgtccggcaacatcctcaacaagaaggccgacgagaccgttaaggttaccgaacgttggtctatccaccgtaacccgccggcattcgaccagctggagtccaagacccagatgttcgaaaccggtatcaaggtcatcgatttgctgaccccgtatgtgcagggcggcaagatcggtctgttcggcggcgcaggcgtcggcaagaccgtgctgatccaggaaatgattcagcgtgtggctcagaaccacggcggtgtgtccgtgttcgcaggcgtcggcgagcgtacccgtgagggtaacgatctgatcggcgaaatggacgaagccggcgtgctcgagaagaccgcactggtcttcggccagatggatgagcagccgggtacccgtctgcgcgtgccgctgaccgcactgaccatggcagagtacttccgtgacgtacagaatcaggacgtgctgctgttcatcgataacatcttccgtttcacccaggctggttccgaggtgtccaccctgctcggccgtatgccgtccgcagtgggctaccagccgaacctggccgatgagatgggcgcgctgcaggagcgaatcacttcgacccgtggacactccatcacctc

SEQ ID NO: 255 - DNA, 842 bp, Brucella abortus
  strain S2308
aaggccagctgccgctgatcctgaacgcgcttgaagtggacaatcagggccatcgtctggttctcgaagttgcccagcacctcggcgaagacaccgtgcgcaccatcgccatggacgcgaccgaaggtctcgttcgcggtcaggaagcacgcgacactggcgaaccgatcatggtgccggtcggcgtcgaaacgcttggccgcatcatgaacgtcatcggcgagccggttgacgaagcaggccccatcaagaccaaggcaacccgcgccatccaccagaacgcgccggaatatatcgaacagtcgaccgaagccgaaattctggtcacgggcatcaaggtcgtcgaccttctggcgccttacgccaagggcggcaagatcggcctcttcggcggtgcaggcgtcggcaagaccgttctcatcatggaactcatcaacaacgtcgccaaggcgcacggcggttattccgtgttcgcaggcgtcggtgagcgtacccgtgagggcaacgacctttaccacgaaatgatcgagtcgggcgtgaacaagctcggcggcggcgaaggctccaaggcagccctcgtttacggccagatgaacgaacccccgggtgcccgcgcccgcgttgccctttccggtctgacggttgctgaaaacttccgtgaccagggccaggacgttctgttcttcgtggacaacatcttccgcttcacgcaggcaggttcggaagtgtcggctcttctcggccgtattccttccgctgtgggttatcagccgacgctggcaaccgacatgggcgccatgcaggaacgcatcaccacgacgaccaagggttcgatcacctcg

SEQ ID NO: 256 - DNA, 833 bp, Cedecea davisae
  ref <308>: DATABASE ACCESSION NUMBER: ATCC 33431
cgagttccctcaggacggcgtaccgcgcgttkatgatgcgcttgaagtacaaaataacagcgagcagctggtgctggaagttcagcagcagctcggcggcggtatcgtgcgtaccatcgctatgggttcttccgacggtctgcgtcgtggtctggaagttaaagacctcgagcacccgatcgaagtcccggtaggtaaagcgacccttggccgtatcatgaacgtgctgggtcagccgatcgacatgaaaggcgatatcggcgaagaagaccgttgggctattcaccgcgctgcaccttcctatgaagagctgtccagctctcaggaactgctggaaaccggcatcaaagtaatcgaccttatctgtccgttcgctaagggcggtaaagtaggtctgttcggtggtgcgggcgtgggtaaaaccgtaaacatgatggagcttatccgtaacatcgcgatcgagcactccggctactccgtgtttgcgggcgtgggtgagcgtactcgtgagggtaacgacttctatcacgaaatgaccgactccaacgttctggacaaagttgccctggtttacggccagatgaacgagccaccgggtaaccgtctgcgcgtagcgctgaccggtctgaccatcgcggagaaattccgtgacgaaggtcgtgacgttctgctgttcgttgataacatctaccgttacaccctggccggtactgaagtatccgcgctgctgggtcgtatgccttctgcggtaggttaccagccaactctggcggaagagatgggtgttcttcaggagcgtattacctccaccaagaccggttccatcacctccg

SEQ ID NO: 257 - DNA, 829 bp, Cedecea lapagei
  ref <308>: DATABASE ACCESSION NUMBER: ATCC 33432
ttccctcaggacggcgtaccgcgcgtatatgacgcgcttgaggtacagaataacagcgagaagctggtgctggaagttcagcagcagctcggcggcggtatcgtacgtaccatcgcaatgggttcttccgacggtctgcgtcgtggtctggaagtgaaagacctcgagcacccgatcgaagtcccggtaggtaaagcgactctgggtcgtatcatgaacgtgctgggtcagccaattgatatgaaaggcgacatcggcgaagaagatcgttgggcgattcaccgcgcagcaccttcctatgaagagctgtccagctctcaggaactgctggaaaccggcatcaaagttatcgacctgatttgtccgttcgctaagggcggtaaagttggtctgttcggtggtgcgggcgtaggtaaaaccgtaaacatgatggagctgatccgtaacatcgcgatcgagcactccggttactccgtgtttgcaggcgtgggtgagcgtactcgtgagggtaacgacttctaccacgagatgaccgactccaacgttctggacaaagttgcactggtttacggccagatgaacgagccgccaggtaaccgtctgcgcgtagcgctgaccggtctgaccatcgcggagaaattccgtgacgaaggccgtgacgttctgctgttcgtcgataacatctatcgttataccctggccggtacagaagtttctgcactgctgggtcgtatgccatctgcggtaggttatcagcctactctggcagaagagatgggtgttcttcaggagcgtattacctccaccaagaccggttccatcacttccg

SEQ ID NO: 258 - DNA, 830 bp, Cedecea neteri
  ref <308>: DATABASE ACCESSION NUMBER: ATCC 33855
tccctcaggacggcgtaccgcgcgtttatgacgcgcttgaggtacagaacaacaatgagaagctggtgctggaagttcagcagcagctcggcggcggtatcgtgcgtaccatcgcaatgggttcttccgacggtctgcgtcgtggtctggtagtaacagacctcgagcacccgatcgaagtcccggtaggtaaagcgacccttggccgtatcatgaacgtgctgggtcagccgatcgacatgaaaggcgacatcggcgaagaagaccgttgggcgattcaccgcgcagcaccttcctacgaagagctgtccagctctcaggaattgctggaaaccggcatcaaagttatcgacctgatttgtccgttcgctaagggcggtaaagtaggtctgttcggtggtgcgggcgtaggtaaaaccgtaaacatgatggagctgatccgtaacattgcgatcgagcactccggttattccgtgtttgcgggcgtgggtgagcgtactcgtgagggtaacgacttctaccacgaaatgaccgactccaacgttctggataaagtagcactggtttacggccagatgaacgagccaccaggtaaccgtctgcgcgtagcgctgaccggtctgaccatcgcggaaaaattccgtgacgaaggccgcgacgttttgctgttcgttgataacatctaccgttataccctggccggtaccgaagtatctgcactgctgggtcgtatgccttctgcggtaggttatcagccaactctggcagaagagatgggtgttcttcaggagcgtattacctccaccaagaccggttctatcacctccgta

SEQ ID NO: 259 - DNA, 931 bp, Chryseobacterium meningosepticum
  strain CDC B7681
tttcaggaagtagaggaactaccaaacatttatgacgcacttgaagttgtcagagaaggccagaaaggtctgatcttagaagttgaacaacacatcggtgaggatacagtgagatgtatcgctatggatgcaacagacggacttcaaagaggacaatctgtaataggacatggaagacaaattactatgcctattggtgaagaagtaaatggtagattgttcaacgtggtaggagatgctatcgacggacttcaggaattatctaaagacaatggtttgccaatccacagagaagcacctaaattcgatcagttatcaacttctgctgaagtactatatacaggtatcaaagtaatcgaccttatcgagccttatgcaaaaggtggtaaaattggtttgttcggtggtgctggtgtaggtaaaacagtattgatccaggaattgattaataacattgctaaaggacacggtggtctttctgtattcgcaggagtaggtgagagaacaagagaaggaaatgaccttcttcgtgagatgttagagtctggtattattaaatatggtgacgaattcatgcattctatggagaacggtggatgggatctttctaaagttgacagtgagttgatgaaagagtctaaagctgctttcgttttcggacagatgaacgagccaccaggtgcaagagcacgtgtagccctttctggtcttactttagctgaatactaccgtgatggtggcgaaagcggacaaggtagagacgttcttttcttcgtagacaacatcttccgttttacacaggctggttctgaggtgtctgcacttctaggtcgtatgccttcagcggtaggttaccaaccaactctagcttctgagatgggtgcaatgcaggagagaattacttcaactaaaaacggatctattacatctg

SEQ ID NO: 260 - DNA, 726 bp, Citrobacter amalonaticus
  ref <308>: DATABASE ACCESSION NUMBER: ATCC 25405
gtatcgtacgtaccatcgcaatgggttcttccgacggtctgcgtcgtggtctggaagtcaaagacctcgagcacccgatcgaagtcccggtaggtaaagcaaccctgggtcgtatcatgaacgtcctgggtcacccgatcgacatgaaaggcgatatcggtgaagaagagcgttgggctatccaccgcgcagcaccgtcctatgaagagctgtccagctctcaggaactgctggaaaccggtatcaaagttatcgacctgatgtgtccgttcgcgaasggcggtaaagtgggtctgttcggtggtgcgggtgtaggtaaaaccgtaaacatgatggagcttatccgtaacatcgcgatcgagcactccggttactccgtgtttgcgggcgtaggtgaacgtactcgtgagggtaacgacttctaccacgaaatgaccgactccaacgttctggataaagtatccctggtatatggccagatgaacgagccgccgggaaaccgtctgcgcgttgcactgaccggtctgaccatggcagagaaattccgtgacgaaggtcgtgacgtactgctgttcgtcgataacatctatcgttacaccctggccggtacggaagtttccgcactgctgggtcgtatgccatcagcggtaggttaccagccgaccctggcggaagagatgggtgttctgcaggaacgtatcacttctaccaaaaccggttctatca

SEQ ID NO: 261 - DNA, 812 bp, Citrobacter braakii
  ref <308>: DATABASE ACCESSION NUMBER: ATCC 43162
gccgtaccgcgcgtgtacgatgctcttgaggttatgaatggtaaagagagcctggtgctggaagttcagcagcagctcggcggcggtatcgtacgtaccatcgccatgggttcttccgacggtctgcgtcgtggtctggaagttaaagatctcgagcacccgatcgaagtcccggtaggtaaagcaactctgggtcgtatcatgaacgtcctgggtcacccgatcgacatgaaaggcgatatcggtgaagaagagcgttgggctatccaccgcgcggcaccttcctatgaagagctgtccagctctcaggaactgctggaaaccggcatcaaagttatcgacctgatgtgtccgttcgctaagggcggtaaagttggtctgttcggtggtgcgggtgtaggtaaaaccgtaaacatgatggagctgatccgtaacatcgcgatcgaacactccggttactccgtgtttgcgggcgtgggtgaacgtactcgtgagggtaacgacttctaccacgaaatgaccgactccaacgttctggataaagtatccctggtatatggccagatgaacgagccgccgggaaaccgtctgcgcgttgctctgaccggtctgaccatggcagagaagttccgtgacgaaggtcgtgacgttctgctgttcgttgataacatctatcgttacaccctggccggtacagaagtatccgctctgctgggtcgtatgccatcagcggtaggctaccagccgaccctggcggaagagatgggtgttcttcaggaacgtatcacctctaccaaaaccggttctatcac

SEQ ID NO: 262 - DNA, 811 bp, Citrobacter koseri
  ref <308>: DATABASE ACCESSION NUMBER: ATCC 27156
gcgcgtgtacgacgcccttgaggtgcagaatggtaatgaacatctggtgctggaagttcagcagcagctcggtggcggtatcgtacgtaccatcgccatgggttcttccgacggcctgcgtcgtggtctggatgtgaaagaccttgagcacccgatcgaagtcccggtaggtaaagcaacgctgggtcgtatcatgaacgtactgggcgaaccagtagacatgaaaggcgagatcggtgaagaagagcgttgggctatccaccgtgcggcaccgtcctacgaagagttgtcaaactctcaggaactgctggaaaccggtatcaaagttatcgacctgatgtgcccgttcgcgaagggcggtaaagtgggtctgttcggtggtgcgggtgtaggtaaaaccgtaaacatgatggagctgatccgtaacatcgcgatcgaacactccggttactccgtgtttgcgggcgtaggtgaacgtactcgtgagggtaacgacttctaccacgaaatgaccgactccaacgttatcgacaaagtatccctggtttacggccagatgaacgagccgccgggaaaccgtctgcgcgttgcgctgaccggcctgaccatggcggagaaattccgtgacgaaggtcgtgacgttctgctgttcgtcgacaacatctaccgttacaccctggccggtacggaagtatccgcactgctgggtcgtatgccttcagcggtaggttaccagccgaccctggcggaagagatgggtgttttgcaggaacgtatcacctccaccaaaaccggttctatcacctccgta

SEQ ID NO: 263 - DNA, 816 bp, Citrobacter farmeri
  ref <308>: DATABASE ACCESSION NUMBER: ATCC 51112
gatgccgtaccgcgcgtgtacgatgctcttgaggttatgaatggtaaagagagtctggtgctggaagttcagcagcagctcggcggcggtatcgtacgtaccatcgcgatgggttcttccgacggtctgcgtcgtggtctggaagtaaaagacctcgaacacccgatcgaagtcccggtaggtaaagcaactctgggtcgtatcatgaacgtcctgggtcacccgatcgacatgaaaggcgatatcggtgaagaagagcgttgggctatccaccgcgcagcgccatcctatgaagagctgtccagctctcaggaactgctggaaaccggtatcaaagttatcgacctgatgtgtccgtttgcgaagggcggtaaagtcggtctgttcggtggtgcgggtgtaggtaaaaccgtaaacatgatggaactcatccgtaacatcgcgatcgagcactccggttactccgtgtttgcgggcgtaggtgaacgtactcgtgagggtaacgacttctaccacgaaatgaccgattccaacgttctggataaagtatccctggtatatggccagatgaacgagccgccgggaaaccgtctgcgcgttgcgctgaccggtctgaccatggcagagaaattccgtgacgaaggtcgtgacgtactgctgttcgtcgataacatctatcgttacaccctggccggtacggaagtatccgcactgctgggccgtatgccatcagcggtaggctaccagccaaccctggcggaagagatgggtgttctgcaggaacgtatcacttctaccaaaaccggttctattacc

SEQ ID NO: 264 - DNA, 819 bp, Citrobacter freundii
  ref <308>: DATABASE ACCESSION NUMBER: ATCC 8090
aggatgccgtaccgcgcgtgtacgatgctcttgaggttatgaatggtaaagagagcctggtgctggaagttcagcagcagctcggcggcggtatcgtacgtaccatcgccatgggttcttctgacggtctgcgtcgtggtctggaagttaaagacctcgagcacccgatcgaagtcccggtaggtaaagcaacgctgggtcgtatcatgaacgttctgggtcacccgatcgacatgaaaggcgatatcggtgaagaagagcgttgggctatccaccgtgcagcaccttcctacgaagagctgtcaagctctcaggaactgctggaaaccggtatcaaagttatcgacctgatgtgtccgttcgctaagggcggtaaagttggtctgttcggtggtgcgggtgtaggtaaaaccgtaaacatgatggagctgatccgtaacatcgcgatcgaacactccggttactccgtgtttgcgggcgtaggtgaacgtactcgtgagggtaacgacttctaccacgaaatgaccgactccaacgttctggacaaagtatccctggtatatggccagatgaacgagccgcctggaaaccgtctgcgtgttgcgctgaccggtctgaccatggctgagaagttccgtgacgaaggtcgtgacgttctgctgttcgttgataacatctatcgttacaccctggccggtacagaagtatctgcactgctgggtcgtatgccatcagcggtaggctaccagccgaccctggcggaagagatgggtgttctgcaggaacgtatcacctccaccaaaaccggttctatcacct

SEQ ID NO: 265 - DNA, 822 bp, Citrobacter koseri
  ref <308>: DATABASE ACCESSION NUMBER: ATCC 27028
gatgccgtaccgcgcgtgtacgacgcccttgaggtgcagaatggtaatgaacatctggtgctggaagttcagcagcagctcggtggcggtatcgtacgtaccatcgccatgggttcttccgacggcctgcgtcgtggtctggatgtgaaagaccttgagcacccgatcgaagtcccggtaggtaaagcaacgctgggtcgtatcatgaacgtactgggcgaaccagtagacatgaaaggcgagatcggtgaagaagagcgttgggctatccaccgtgcggcaccgtcctacgaagagttgtcaaactctcaggaactgttggaaaccggtatcaaagttatcgacctgatgtgtccgttcgcgaagggcggtaaagtgggtctgttcggtggtgcgggtgtaggtaaaaccgtaaacatgatggagctgatccgtaacatcgcgatcgaacactccggttactccgtgtttgcgggcgtaggtgaacgtactcgtgagggtaacgacttctaccacgaaatgaccgactccaacgttatcgacaaagtatccttggtttacggccagatgaacgagccgccgggaaaccgtctgcgcgttgcgctgaccggcctgaccatggcggagaaattccgtgacgaaggtcgtgacgttctgctgttcgtcgacaacatctaccgttacaccctggccggtacggaagtatccgcactgctgggtcgtatgccttcagcggtaggttaccagccgaccctggcggaagagatgggtgttttgcaggaacgtatcacctccaccaaaaccggttctatcacctccgta

SEQ ID NO: 266 - DNA, 820 bp, Citrobacter sedlakii
  ref <308>: DATABASE ACCESSION NUMBER: ATCC 51115
gatgccgtaccgcgcgtgtacgacgcccttgaggtacagaatggtaatgagcgtctggtgctggaagttcagcagcagctcggtggcggtattgtacgtaccatcgccatgggttcttccgacggtctgcgtcgtggtctggaagtaaaagaccttgagcacccgatcgaagtcccggtaggtaaagcaacgctgggtcgtatcatgaacgtactgggcgaaccagtagacatgaaaggcgacatcggtgaagaagagcgttgggctatccaccgtgccgcgccgtcctatgaagagttgtctaactctcaggaactgctggaaaccggcatcaaagttatcgacctgatgtgtccgttcgcgaagggcggtaaagtcggtctgttcggtggtgcgggcgtaggtaaaaccgtaaacatgatggagctgatccgtaacatcgcgatcgagcactccggttactctgtgtttgcgggcgtgggtgaacgtactcgtgagggtaacgacttctaccacgaaatgaccgactccaacgttatcgacaaagtatccctggtgtacggccagatgaacgagccgcctggaaaccgtctgcgcgtcgcactgaccggtctgaccatggctgagaagttccgtgacgaaggtcgtgacgttctgctgttcgtcgataacatctatcgttacaccctggccggtacggaagtatccgcactgctgggtcgtatgccttcagcggtaggttatcagccgactctggcggaagagatgggtgttctgcaggaacgtatcacctcaaccaaaaccggttctatcacctccg

SEQ ID NO: 267 - DNA, 806 bp, Citrobacter werkmanii
  ref <308>: DATABASE ACCESSION NUMBER: ATCC 51114
gccgtaccgcgcgtgtacgatgctcttgaggttatgaatggtaaagagagcctggtgctggaagttcagcagcagctcggcggcggtatcgtacgtaccatcgccatgggttcttccgacggtctgcgtcgtggtctggaagttaaagaccttgagcacccgatcgaagtcccggtaggtaaagcaaccctgggtcgtatcatgaacgtcctgggtcatccgatcgacatgaaaggcgatatcggtgaagaagagcgttgggctatccaccgcgcagcacctacctatgaagaactgtccagttctcaggaactgctggaaaccggcatcaaagttatcgacctgatgtgtccgttcgcgaagggcggtaaagttggtctgttcggtggtgcgggtgtaggtaaaaccgtaaacatgatggagctgatccgtaacatcgcgatcgaacactccggttactcagtgtttgcgggcgttggtgaacgtactcgtgagggtaacgacttctaccacgaaatgaccgactccaacgttctggacaaagtatccctggtatatggccagatgaacgagccgccgggaaaccgtctgcgcgttgcgctgaccggtctgaccatggctgagaagttccgtgacgaaggtcgtgacgttctgctgttcgttgataacatctatcgttacaccctggccggtactgaagtatctgcactgctgggtcgtatgccatcagcggtaggctaccagccaaccctggcggaagagatgggtgttctgcaggaacgtatcacctctaccaaaaccggttc

SEQ ID NO: 268 - DNA, 810 bp, Citrobacter youngae
  ref <308>: DATABASE ACCESSION NUMBER: ATCC 29935
gccgtaccgcgcgtgtacgatgctcttgaggttatgaatggtaaagagagcctggtgctggaagttcagcagcagctcggcggcggtatcgtacgtaccatcgccatgggttcttccgacggtctgcgtcgtggtctggaagttaaagacctcgagcacccgatcgaagtcccggtaggtaaagcaacgctgggtcgtatcatgaacgttctgggtcacccgatcgacatgaaaggcgatatcggagaagaagagcgttgggctattcaccgcgcagcaccttcctatgaagagctgtccagctctcaggaactgctggaaaccggcatcaaagttatcgacctgatgtgtccgttcgctaagggcggtaaagttggtctgttcggtggtgcgggtgtaggtaaaaccgtaaacatgatggagcttattcgtaacatcgcgatcgagcactccggttactctgtgtttgcgggtgtaggtgaacgtactcgtgagggtaacgacttctaccacgaaatgaccgattccaacgttctggataaagtatccctggtttatggccagatgaacgagccgccgggaaaccgtctgcgcgttgcgctgaccggtctgaccatggctgagaaattccgtgacgaaggtcgtgacgtactgctgttcgtcgataacatctatcgttataccctggccggtacggaagtatccgcactgctgggtcgtatgccatcagcggtaggttaccagccgaccctggcggaagagatgggtgttctgcaggaacgtatcacttctaccaaaaccggttctatc

SEQ ID NO: 269 - DNA, 827 bp, Clostridium innocuum
  ref <308>: DATABASE ACCESSION NUMBER: ATCC 14501
ttgagaacggagatttgccgcagctattgaccgctattgaaattcctctgaaagacagtgaatctctgattgtcgaagttgctcagcatatcggtgatgaacgtgtccgctgtatcgctatgggcggtacagatggtctggttcgtggaatggaagccattgatacaggatccgcaatccgtgtaccggtgggaaaagaaattctgggaagaatgttcaatgtcctcggacgtgaaattgatggtctgggacctgtaggaacggataacacactgccgatccacagacaggcaccgggctttgaggagcagcagacatccgcagaaatgctggaaacaggaattaaggtcattgacctgttatgtccatattccaagggtggtaagattggtttgtttggtggtgcgggagtaggtaaaaccgtactgattcaggagctgattcataatatcgccaaggaacatggtggaatgtccgtcgttaccggtgtaggggagagaacccgtgaaggaaacgacatgtatcatgaaatgaaggacagcggtgtccttgataagaccgtactggtttacggacagatgaatgaatcaccgggtgccagaatgcgtgtcggtctgaccgggctgacgatggcggaatatttccgtgatcacgaccatcaggatgtattgctgtttattgataatattttccgttttacccaggcgggaagtgaagtaagtgccctgctgggacgtatgccaagtgcagtaggctatcagccgacacttgcgacagaaatgggacagctgcaggagcgcattacatccacgaaggatggttccatt

SEQ ID NO: 270 - DNA, 829 bp, Clostridium perfringens
  ref <308>: DATABASE ACCESSION NUMBER: ATCC 13124
gcaaatgatgaacttcctaatatatttaatgcaatacacataaaaatggacgatggaaaaatcttagtttgtgaggtagagcaacacgtaggagacgatatagttagaactatagctatggaagctactgaaggactaagaagaggtgtagaagctgttgatacaggagcacctatatcagtaccagttggtgaatgcgtattaggaagaatatttaacgtattaggtaaaccactagatagtggagctgaagttaataacgaagaaaaatatccaattcatagaccagctccatcatttgaagaacaatcagttgttcctcaaatgtttgagacaggaataaaggttatcgaccttttagcaccttaccaaagagggggaaaaatcggtctatttggaggtgcaggtgttggtaaaacagttcttatccaagagcttataaacaacatagctaaagagcacggtggactttctgtattcacaggagttggagaaagatcaagagaaggtaatgacctttactatgaaatgatggaatcaggagttataaaaaatacagcattagtatttggacaaatgaacgaaccacctggagcaagaatgagagttgctttaacaggacttactatggctgagtacttcagagaccaaggtcaagacgtgttattattcatagataacatattcagattctcacaagctggatcagaggtttcagctttattaggaagaataccatcagctgttggttaccaaccaactcttgctacagagatgggagctcttcaagagagaatcacatcaactacccatggatcaattacatcag

SEQ ID NO: 271 - DNA, 22 bp, Artificial Sequence
  Synthetic DNA Sequence
ttgtccacgttggatrtcttca

SEQ ID NO: 272 - DNA, 818 bp, Corynebacterium diphtheriae
  ref <308>: DATABASE ACCESSION NUMBER: ATCC 27010
cccgcgtggcgagctgccggcactgtacaacgcgttgactgtcgaggtcaccctcgaggcagtcgctaagaccattacccttgaggttgcccagcacttgggcgacaacctcgttcgcgccgtgtccatggcccctaccgacggcctcgtccgtggtgctgttgtgaccgactcgggcaagccaatctccgtgccagttggcgacgttgttaaaggccacgttttcaacgcactgggcgattgcttggatgagccaggtctcggccgcgatggtgagcagtggggaattcaccgcgatccaccaccattcgatcagctcgaaggtaagaccgaaatcctcgagaccggtattaaggtcatcgacttgctcaccccttacgttaagggcggcaagattggtctgttcggtggtgcaggtgtgggtaagaccgtgctcatccaggagatgatcactcgtattgctcgcgagttctccggtacctccgtcttcgctggcgttggtgagcgtacccgtgagggcaccgacctcttcctcgaaatggaagaaatgggcgttcttcaggacaccgctctcgtgttcggccagatggacgagccaccaggagtccgtatgcgcgttgctctgtccggtctgaccatggcggagtacttccgcgatgttcagcaccaggacgtgcttctgttcatcgataacattttccgtttcacccaggccggttccgaggtttcgacccttcttggtcgtatgccttccgccgtgggttaccagccaaccttggctgacgagatgggtgttctccaggagcgtattacctcta

SEQ ID NO: 273 - DNA, 833 bp, Corynebacterium pseudodiphtheriticum
  ref <308>: DATABASE ACCESSION NUMBER: ATCC 10700
cgatgcctgctctgtacaacgcgctgactgtcgaggtcaccctcgaggcagtcgccaagaccatcacgcttgaggttgcacagcacctcggcgataacctgatccggaccattgcgttggcacctacggacggtctcgtccgtggcgctgaggttatcgacactggtaagccaattactgttcccgtcggcgatgccgtcaaaggacacgtcttcaatgcgctcggtgagtgtttggacgaaccaggattgggccgcgacggcgaacagtggggaatccaccgcgatccgccaccattcgatgcgctggagggcaaaaccgagattctggagactggaatcaaggttatcgacctccttaccccttacgttaagggtggcaaaattggtctgttcggtggcgccggcgtcggcaagaccgttcttatccaggaaatgatcactcgtatcgctcgtaacttctccggtacttccgtgttcgccggcgtcggtgagcgtacccgtgagggtactgacctgttcctggaaatggaagagatgggcgtgttgcaagacaccgcccttgtcttcggtcaaatggacgaaccaccaggggttcgtatgcgcgtggccttgtctggtctaaccatggctgaatatttccgcgacgttcaaaaccaggacgttttgttgttcattgacaacatcttccgttttactcaggcaggttccgaggtttccacgctgttgggccgtatgccttccgccgtgggttatcagccaacattggctgatgagatgggtgttttgcaggaacggattacctctacacgtggtaagtcaattacttccctg

SEQ ID NO: 274 - DNA, 417 bp, Corynebacterium ulcerans
  NCTC 8665
ccgtgctcatccaggagatgatcacccgtgtggcccgcaacttcggcggcacctctgtgttcgccggcgtcggcgagcgcacccgtgagggcaacgacctctgggtcgagatggacgaggccgacgtgctcaaggacaccgccctggtgttcggccagatggacgagccgccgggaacccgtctgcgcgtggccctgtccgcgctgaccatggcggagtacttccgcgatgtgcagaaccaggacgtgctgctgttcatcgacaacatcttccgcttctcccaggccggctccgaggtctccaccctgctgggccgcatgccctccgcggtgggctaccagccgaacctggcggacgagatgggtgtgctgcaggagcgcatcacctcgactcgcggccactccatcacctcgatgc

SEQ ID NO: 275 - DNA, 835 bp, Corynebacterium urealyticum
  ref <308>: DATABASE ACCESSION NUMBER: ATCC 43042
gggcagcagccagcactattcaacgcgctgcacgtcgaggttgacctcgaggcagttgcgaagaccattaccctggaggtcgcacagcacctgggtgacaacctggtgcgcaccgtctccatggccccgaccgacggcctggtccgcggtgcagaggtcaaggacaccggtaagccgatctctgtgccagtcggcgatgttgtcaaggggcacgtcttcaacgccctgggcgactgcctggatgagccaggtctcggccgcgacggcgagcagtggggcatccaccgcgagccaccggcattcgacgagctcgagggtaagaccgagatcctggagaccggcgttaaggtcatcgacctgctgaccccttacgtcaagggcggcaagattggcctcttcggtggtgcaggtgtgggtaagaccgtcctgattcaggagatgattacccgtatcgcccgcgagttctccggtacctccgtgttcgccggcgtcggcgagcgtacccgtgagggtacggacctcttcctcgagatggaggagatgggcgtgctccaggacaccgcgctggtgttcggtcagatggatgagccgccgggagtccgtatgcgcgtggctctgtccggtctgaccatggcggagtacttccgcgatgttcagggccaggacgtgctgctgttcatcgacaacatcttccgtttcacccaggcaggttctgaggtctccacgctgctcggccgcatgccgtccgcagtgggttaccagccgaccctggctgacgagatgggtgttctgcaggagcgcattacctccacgaagggtaagtccattacctccc

SEQ ID NO: 276 - DNA, 818 bp, Coxiella burnetii
  strain Nine Mile phase II
cccgtcacgctgtcccgaaagtgtacgatgctttgcaggtggatgaaaataatttaacgctcgaagtccaacagcaactcggggacggtgtcgtgcgcacaattgccatgggcagcactgagggcttaaaacgcgatatcgccgtaaaaaatacggaaaaaccgattgaagttcccgtaggaaaagaaactttaggtcgtatcatgaacgtgctgggtgagccgatcgatgagttaggtcccattaattcaaaagaaaaactccctattcatcgtcctgcgccgagctttattgagcaatctggcgctaccgaattattagaaaccggtattaaagtggtcgatttgctttgcccctttgctaagggaggcaaagtgggtctttttggaggcgcgggcgttggaaaaacggttaatatgatggaattaatccgtaatatcgccattgaacacagcggttattctgtttttgcgggtgtgggagaaagaacgcgagaaggcaatgatttttatcatgaaatgaaagaatccaatgtcttggataaagtggcgttggtgtacggacaaatgaacgagccgccagggaaccgcttgcgggtgggtttgacggggcttacgctggcggaagccttccgtgacgaaggacgcgacgttctgttatttatcgataatatctttcgttacactttggcaggggttgaagtctctgccctcctcggtcggatgccatcggctgtgggttatcagccgacgttggccgaagagatgggggccctgcaagaacgcattacttccactaaaaaagggtccattacgtcg

SEQ ID NO: 277 - DNA, 829 bp, Edwardsiella hoshinae
  ref <308>: DATABASE ACCESSION NUMBER: ATCC 33379
ttcccgcaggacgccgtgccgaaggtgtataacgcactggaagtaaaaggcggtgccacgaaactggtactggaagtgcagcagcagctgggtggcggcgtagttcgctgcatcgcgatgggctcttccgacggtctgcgccgtgggctagaggttgaagaccaagaccatccgatcgaggttcctgttggcaaggcgactctgggccgtatcatgaacgtactgggtgatccggtcgacatgaagggcgagatcggtgaagaagagcgttgggctatccatcgtgctgcaccgagctatgaagatctgtctaactctcaggaactgctggagaccggcattaaggttatcgacctgatttgcccgttcgctaaaggcggtaaagtgggcctgttcggtggggccggtgtgggtaagaccgttaacatgatggagcttatccgtaacatcgctatcgagcactccggttactcagtcttcgccggtgtgggtgagcgtacccgtgagggtaacgacttctaccacgagatgaccgattccaacgtattggataaagtttctctggtgtatggtcagatgaacgagccaccgggaaaccgtctgcgcgtggcgctgaccggtctgaccatggcggagaaattccgtgatgaaggtcgtgatgtactgttgttcatcgataacatctaccgttataccttggccggtactgaagtctccgctctgctgggccgtatgccgtcggcggtaggttatcagccgactctggcggaggaaatgggggtgctgcaagagcgtattacctccactaagaccgggtccatcacctctg

SEQ ID NO: 278 - DNA, 809 bp, Edwardsiella tarda
gccgtgccgaaggtgtataacgcactggaagtaaaaggcggtgccacgaaactggtactggaagtgcagcagcagctgggtggcggcgtcgttcgctgcatcgcgatgggctcctccgacggtctgcgccgtgggctggtggttgaagaccaagaccatccgatcgaggttccggtcggtaaggcgaccctgggccgtatcatgaacgtactgggtgatccggtcgacatgaagggcgagatcggcgaagaagagcgttgggctatccaccgcgcggcgccgagctatgaagatctgtccaactctcaggagctgctggagaccggcatcaaggttatcgacctgatttgcccgttcgccaaaggcggtaaagttggcctgttcggtggtgccggtgtgggtaagaccgttaacatgatggagcttatccgtaacatcgctatcgagcactccggttactccgtatttgccggtgtaggcgagcgtacccgtgagggtaacgacttctaccacgagatgaccgactccaacgtattggataaagtttctctggtatacggccagatgaatgagccgccgggaaaccgtctgcgtgtggcgttgaccggtctgaccatggcggagaaattccgtgatgaaggtcgcgatgtgttgttgttcatcgataacatttatcgttataccttggctggtaccgaagtttctgctctgctgggtcgtatgccgtcggcggtaggttatcagccgaccctggcggaagagatgggtgtgttgcaagagcgtatcacctcaacgaagacgggctctat

SEQ ID NO: 279 - DNA, 840 bp, Eikenella corrodens
  ref <308>: DATABASE ACCESSION NUMBER: ATCC 23834
tttccgcgtaccgccattccgcgtgtttacgatgcactcaaactggttgatactgatttgacgctggaagtacagcagcagcttggtgacggcgttgtccgtaccattgcgatgggtagtacagacggtttgaaacgtggcttggctgtgcaaaatactggtgcaccgattactgtgccggtggggaaagccaccctaggccgcatcatggacgttctgggcaaccccgtggacgaacaaggtccgatcggttctgaccaaacccgtgctattcatcaatttgcacctaagttcgacgaactctccagcactaccgaattgttggaaacaggcattaaagtgatcgatttgctttgtccgtttgctaaaggtggtaaagtgggtctgtttggcggtgccggtgtgggcaaaaccgtgaacatgatggagctgattaacaacattgccaaagcgcacagtggtctttccgtattcgccggtgtgggtgagcgtactcgtgaaggtaacgacttctaccacgaaatgaaagactccaacgtgttggataaagtggcaatggtgtatggccagatgaacgagccgcctggtaaccgcttgcgtgttgctctaactggtttgtcgatggctgaatacttccgtgacgaaaaagacgaaaacggcaaaggccgtgacgtattattctttgtggataatatctaccgctatactctggcgggtaccgaagtgtcggctctgcttggccgtatgccttctgctgtgggttatcagccaactttggctgaagaaatgggtcgtttgcaggagcgtattacctccacccaaactggttccattacctct

SEQ ID NO: 280 - DNA, 803 bp, Enterobacter agglomerans
  ref <308>: DATABASE ACCESSION NUMBER: ATCC 27989
gccgtaccacgagtgtacgatgcacttgaggtaaagaatggtgaagagcgtctggtgctggaagttcagcaacagctcggcggtggcgttgtacgtaccatcgcaatgggttcttctgatggtctgcgtcgtggtctggaagtaacggacctggctcacccgatcgaagtcccggtaggtaaagcaacactgggtcgtatcatgaacgtactgggcgaaccagtagacatgaaaggcgacatcggtgaagaagagcgttgggcgatccaccgtgcagcaccgtcctacgaagagttgtcaaactctcaggaactgctggaaaccggtatcaaagttatcgacctgatgtgtccgttcgctaagggcggtaaagtgggtctgttcggtggtgcgggtgtaggtaaaaccgtaaacatgatggagcttattcgtaacatcgcgatcgagcactccggttactctgtgtttgcgggcgtaggtgaacgtactcgtgagggtaacgacttctaccacgaaatgaccgactccaacgttatcgacaaagtatccctggtgtatggtcagatgaacgagccgccgggaaaccgtctgcgcgttgcgctgaccggtctgaccatggctgagaagttccgtgacgaaggtcgtgacgtactgttgttcgttgacaacatctaccgttacaccctggccggtacggaagtatccgcactgctgggccgtatgccttctgcggtaggttatcagccgacgctggcggaagagatgggcgttctgcaggaacgtatcacctccaccaaaaccgg

SEQ ID NO: 281 - DNA, 833 bp, Enterobacter amnigenus
  ref <308>: DATABASE ACCESSION NUMBER: ATCC 33072
cgaattccctcaggatgccgtaccgcgcgtgtacgatgctcttgaggtacagaatggtaacgagagtctggtgctggaagttcagcagcagctcggtggtggtatcgtacgtactatcgccatgggttcttccgacggtctgcgtcgtggtctggctgttaaagatctcgaacacccgatcgaagtcccggtaggtaaagcaacactgggtcgtatcatgaacgttttgggtcaaccaatcgacatgaaaggcgacatcggtgaagaagaccgttgggcaatccaccgtgcagcaccttcctatgaagagctgtctagctctcaggaactgctggaaaccggcatcaaagttatcgacctgatgtgtccgttcgctaagggcggtaaagttggtctgttcggcggtgcgggcgtgggtaaaactgtaaacatgatggagctgatccgtaacatcgcgatcgagcactccggttactccgtgtttgcaggcgtgggtgagcgtactcgtgagggtaacgacttctaccacgaaatgaccgattccaacgttctggataaagtatccctggtttatggccagatgaacgagccaccaggaaaccgtctgcgcgttgcgctgaccggtctgactatggctgagaagttccgtgacgaaggtcgtgacgtactgctgttcgtagataacatctaccgttacaccctggccggtactgaagtatctgcgctgctgggccgtatgccttcagcggtaggttaccagccgaccctggcggaagagatgggcgttctgcaggaacgtatcacttctaccaaaaccggttctatcacctccg

SEQ ID NO: 282 - DNA, 810 bp, Enterobacter asburiae
  ref <308>: DATABASE ACCESSION NUMBER: ATCC 35953
gccgtaccacgcgtgtacgacgcgcttgaggtacagaatggtaacgagagcctggtgctggaagttcagcagcagctcggcggcggtatcgtgcgtaccatcgcgatgggttcttccgacggtctgcgtcgtggtctggaagtcaaagaccttgagcacccgatcgaagtcccggtaggtaaagcaacactgggtcgtatcatgaacgtattgggtcaaccaatcgacatgaaaggcgacatcggtgaagaagagcgttgggctatccaccgcgcggcaccttcctacgaagagctgtccagctctcaggaactgctggaaaccggtatcaaagttatcgacctgatgtgtccgttcgcgaagggcggtaaagtcggtctgttcggtggtgcgggtgttggtaaaaccgtaaacatgatggagctgatccgtaacatcgcgatcgagcactccggttactccgtgtttgcgggcgtaggtgaacgtactcgtgagggtaacgacttctaccacgaaatgaccgactccaacgttctggacaaagtatccctggtttacggccagatgaacgagccaccaggaaaccgtctgcgcgttgcgctgaccggtctgacgatggctgagaagttccgtgatgaaggccgtgacgttctgctgttcgttgataacatctatcgttacaccctggccggtacggaagtatctgcactgctgggtcgtatgccttcagcggtaggttaccagcctacgctggcggaagagatgggtgttcttcaggaacgtatcacctctaccaaaaccggttctatc

SEQ ID NO: 283 - DNA, 811 bp, Enterobacter cancerogenus
  ref <308>: DATABASE ACCESSION NUMBER: ATCC 35317
gccgtaccgcgcgtgtacgatgctcttgaggtacagaatggtaacgagagcctggtgctggaagttcagcagcagctcggcggcggtatcgtacgtactatcgccatgggttcttccgacggtctgcgtcgtggtctggaagtaaaagaccttgagcacccgatcgaagtcccggtaggtaaagcaacactgggtcgtatcatgaacgtattgggtcaaccaatcgacatgaaaggcgacatcggtgaagaagagcgttgggctatccaccgcgcagcaccttcctacgaagagctgtccagctctcaggaactgctggaaaccggcatcaaagttatcgacctgatgtgtccgttcgcgaagggcggtaaagtcggtctgttcggtggtgcgggtgtaggtaaaaccgtaaacatgatggagctgatccgtaacatcgcgatcgagcactccggttattccgtgtttgcgggcgtgggtgaacgtactcgtgagggtaacgacttctaccacgaaatgaccgactccaacgttctggataaagtatccctggtgtacggccagatgaacgagccaccaggaaaccgtctgcgcgttgcgctgaccggcctgaccatggctgagaagttccgtgacgaaggtcgtgacgtactgctgttcgttgataacatctaccgttacaccctggccggtaccgaagtatctgcactgctgggtcgtatgccttcagcggtaggttatcagcctacgctggcggaagagatgggtgttcttcaggaacgtatcacctcaaccaaaaccggttctatca

SEQ ID NO: 284 - DNA, 817 bp, Enterobacter cloacae
  ref <308>: DATABASE ACCESSION NUMBER: ATCC 13047
gccgtaccacgcgtgtacgacgcgcttgaggtacagaatggtaacgagagcctggtgctggaagttcagcagcagctcggcggcggtatcgtgcgtaccatcgcgatggggtcttccgacggtctgcgtcgtggtctggaagttaaagaccttgagcacccgatcgaagtcccggtaggtaaagcaacactgggtcgtatcatgaacgtattgggtcagccaatcgacatgaaaggcgacatcggtgaagaagagcgttgggctatccaccgcgcggcaccttcctacgaagagctgtccagctctcaggaactgctggaaaccggtatcaaagttatcgacctgatgtgtccgtttgcgaagggcggtaaagttggtctgttcggtggtgcgggtgtaggtaaaaccgtaaacatgatggagctgatccgtaacatcgcgatcgagcactccggttactccgtatttgcgggcgtaggtgaacgtactcgtgagggtaacgacttctaccacgaaatgaccgactccaacgttctggacaaagtatccctggtttacggccagatgaacgagccaccaggaaaccgtctgcgcgttgcgctgactggtctgacgatggctgagaagttccgtgacgaaggccgtgacgttctgctgttcgttgataacatctaccgttacaccctggccggtacggaagtatctgcactgctgggtcgtatgccttcagcggtaggttatcagcctacgctggcggaagagatgggtgttcttcaggaacgtatcacctctaccaaaaccggttctatcacttccg

SEQ ID NO: 285 - DNA, 766 bp, Enterobacter gergoviae
  ref <308>: DATABASE ACCESSION NUMBER: ATCC 33028
aatgagagcctggtgctggaagttcagcagcagctcggcggcggtatcgtgcgtaccatcgcaatgggttcttctgacggtctgcgtcgcggtctggaagttaaagatctcgaacatccgatcgaagtcccggtaggtaaagcgaccctcggccgtattatgaacgtgctgggtcagccggttgatatgaaaggcgatatcggcgaagaagagcgttgggcgatccaccgcgctgcgccgtcctatgaagagctctccagctctcaggaactgctggaaaccggtatcaaggtaatggacctgatttgcccgttcgcgaagggcggtaaagtcggtctgttcggcggtgcgggcgttggtaaaaccgtaaacatgatggagctgatccgtaacatcgcgatcgagcactccggctactccgtgtttgcgggcgtgggtgaacgtactcgtgagggtaacgacttctaccacgaaatgaccgactccaacgttatcgacaaagtatccctggtgtacggccagatgaacgagccgccgggaaaccgtctgcgcgtggcgctgaccggtctgaccatggctgagaaattccgtgacgaaggtcgtgacgttctgctgttcgtcgataacatctaccgctataccctcgccggtactgaagtatccgcactgctgggccgtatgccttctgcagtaggttaccagccgacgctggcggaagagatgggtgttctgcaggaacgtatcacctccaccaaaaccggttcta

SEQ ID NO: 286 - DNA, 805 bp, Enterobacter hormaechei
  ref <308>: DATABASE ACCESSION NUMBER: ATCC 49162
gccgtaccacgcgtgtacgacgcgcttgaggtacagaatggtaacgagagcctggtgctggaagttcagcagcagctcggcggcggtatcgtgcgtaccatcgccatgggttcttccgacggtctgcgtcgtggtctggaagtgaaagaccttgagcacccgatcgaagtcccggtaggtaaagcaacgctgggtcgtatcatgaacgtattgggtcagccaatcgacatgaaaggcgacatcggtgaagaagagcgttgggctatccaccgcgcggcaccttcctacgaagagctgtccagctctcaggaactgctggaaaccggcatcaaagttatcgacctgatgtgtccgtttgcgaagggcggtaaagttggtctgttcggtggtgcgggtgtaggtaaaaccgtaaacatgatggagctgatccgtaacatcgcgatcgagcactccggttactccgtgtttgcgggcgtgggtgaacgtactcgtgagggtaacgacttctaccacgaaatgaccgactccaacgttctggacaaagtatccctggtttacggccagatgaacgagccaccaggaaaccgtctgcgcgttgcgctgactggcctgacgatggctgagaagttccgtgacgaaggccgtgacgttctgctgttcgtcgataacatctaccgttacaccctggccggtacggaagtatctgcactgctgggtcgtatgccttcagcggtaggttatcagccaacgcttgcggaagagatgggtgttcttcaggaacgtatcacctcgaccaaaaccggtt

SEQ ID NO: 287 - DNA, 791 bp, Enterobacter sakazakii
  ref <308>: DATABASE ACCESSION NUMBER: ATCC 29544
tacgacgcccttgaggtaacgaatggtaatgagcgtctggtgctggaagtccagcagcagctcggcggcggtatcgtacgtaccatcgcgatgggctcttccgacggtctgcgtcgcggtctgcctgttgcagaccttgagcacccgatcgaagtgccggtaggtaaagcgacgctgggtcgtatcatgaacgtcctgggtcagcctatcgacatgaaaggcgacatcggcgaagaagagcgttgggcgattcatcgcgcggcgccgtcctatgaagagctgtccagctctcaggaactgctggaaaccggcatcaaagttatcgacctgatgtgtccgttcgcgaagggcggtaaagtcggtctgttcggtggtgcaggtgtaggtaaaaccgtaaacatgatggagcttattcgtaacatcgcgattgagcactccggttactccgtgtttgcgggcgtgggcgaacgtacccgtgaaggtaacgacttctaccacgaaatgaccgactccaacgtactggataaagtatccctggtgtacggccagatgaacgagccgccgggaaaccgtctgcgcgttgcgctgaccggcctgaccatggctgagaaattccgtgacgaaggtcgtgacgttctgctgttcgtcgacaacatctaccgttacaccctggccggtactgaagtatccgcactgctgggccgtatgccttcagcggtaggttatcagccgaccctggcggaagagatgggtgttctgcaggagcgtatcacctccaccaaaaccggttc

SEQ ID NO: 288 - DNA, 839 bp, Enterococcus avium
  ref <308>: DATABASE ACCESSION NUMBER: ATCC 14025
tttctttagatcaatccttaccagacatcaacaatgcgttgattgtttacaaaaaagataaaacaaaagttgttcttgaagttgctttggaacttggtgatggtgttatccgcacaatcgctatggaggctactgatggattgcaacgtggaatggaagttgtcgatactggcaaatcaatctccgttcctgtaggtaaagatactctaggtcgtgtgtttaacgtattaggtgaaacgattgataaagaagcaccttttccagaagatgcagaaagaagcggcattcataaaaaggcgcctgcttttgaagaccttagtacaagtaacgagattttggaaacagggatcaaggttatcgacttattagccccttatttaaaaggtgggaaagtcggactattcggtggtgccggtgttggtaaaaccgttttgatccaagaattaattcataatatcgcccaagaacacggtggtatttcagtgtttaccggtgttggggaacgtactcgtgaagggaacgacctttattatgaaatgaaagactctggcgttattgagaaaacagccatggtgttcggacaaatgaacgagccgcctggtgcacgtatgcgtgttgccttgactggtttgacattagctgaatatttccgtgatgaagaaggacaagatgtgttgctatttattgacaacatcttccgctttactcaagccggatcagaagtttctgccttattaggacgtatgccatcagccgttgggtatcaaccaactttggcaactgaaatggggcaattacaagaacgaatcacttcaaccaaaaaaggttcgatcacttca

SEQ ID NO: 289 - DNA, 847 bp, Enterococcus casseliflavus
  ref <308>: DATABASE ACCESSION NUMBER: ATCC 25788
ttctctctagaccaatcattaccagatatcaacaatgcgttgattgtttacaaaaaagatgagcagaaaacaaaagttgtgttagaagctgccttagaacttggcgacggcgttatccgtacgattgccatggaatcaacagatggcttacaacgaggaatggaagtaatcgatacaggcgcctccatttctgttccagttgggacagaaaccttaggacgggtgtttaatgtcttaggggacaccatcgatttagaagcgccgttccctgaagaagcaccccgcagtgggattcacaaaaaagcacctgactttgatgaattgtcaacaagtacggagatccttgaaactgggatcaaagttatcgatttgttagccccttatttaaaaggggggaaagttggacttttcggtggtgccggtgttggtaaaaccgtcttgatccaagaattgatccacaacatcgcccaagagcatggtgggatctctgtcttcacaggtgttggtgaacggacacgtgaaggaaatgacctttataatgaaatgaaagaatctggcgttatcgaaaaaacagccatggtgtttggacaaatgaacgaaccaccaggtgctcggatgcgggtagccttgactggtttgacattagccgagtacttccgtgatgtggaaggacaagacgtgctcttgtttatcgataatatcttccgcttcactcaagcaggttctgaagtatctgccttactaggtcggatgccgtctgccgttgggtatcagccaacattagcaactgagatggggcaattacaagaacggatcacatcgacgaagaaaggttccgttacgtcta

SEQ ID NO: 290 - DNA, 845 bp, Enterococcus durans
  ref <308>: DATABASE ACCESSION NUMBER: ATCC 19432
tttctttagaccaatccttaccagatatcaacaacgctttagttgtttataaaaatgatgagaagaaatcgaaagttgttcttgaaacagcgctagaattaggtgacggtgtcatccgtacaatcgcgatggaatcaacagatggtttacaacgcggaatggaagtcattgatacagaaaaagcaatttctgtaccagtgggtaaagaaacgttaggtcgtgtattcaatgtattaggagatacgatcgatttatctgcacctttcccagaagatgcaaaacgtagcgaaatccataaaaaagcaccaaactttgatgagttaagtacaagtactgagatccttgaaactgggatcaaagttattgacttgcttgctccttacttaaaaggtgggaaagttggattattcggtggtgccggtgtaggtaaaactgtattgatccaagaattgatccataatatcgctcaagaacacggtggtatttctgtatttactggtgttggtgaacgtacacgtgaaggtaatgacctttattatgaaatgaaagattcaggagttattgaaaaaacagccatggtgtttggtcaaatgaacgaaccaccaggtgcacgtatgcgtgttgccttgactggtttgacgattgctgaatacttccgtgatgttgaagggcaagacgtgctattgtttattgataatattttccgtttcactcaagccggttcagaagtttctgccctattaggtcgtatgccttctgccgttgggtaccaaccaacgctagcaacagaaatgggtcaattacaagaacggatcacttcaacgaaaaaaggttcaatcacttca

SEQ ID NO: 291 - DNA, 840 bp, Enterococcus faecalis
  ref <308>: DATABASE ACCESSION NUMBER: ATCC 29212
ttagatcaatccttacccgatattaacaacgctttagtcgtttataaaaatggcgaagcaaaacaaaaagtagtacttgaagtcgctttagaactaggtgatggagtgattcgttctatcgccatggaatcgacagatggtttacaacgtggaatggaagttatcgatacaggaaaatcaatttcagttcctgttggtaaagatacattaggtcgtgtgtttaacgttttaggagacacaattgacttagaagcgccattccctgcagatgctgaacgtagtgggattcataaaaaagcgccagcatttgatgaattaagtaccagtaatgaaattttagaaacagggattaaagttattgacttattagcaccttatctaaaaggtggtaaagtcggacttttcggtggtgccggtgttggtaaaaccgtcttaattcaagaattaattcataatattgcccaagaacatggagggatttccgtctttactggtgttggtgaacggacacgtgaagggaacgatctgtactatgaaatgaaagattcaggcgttattgaaaaaacagccatggtttttggtcaaatgaacgaaccgccaggtgcacggatgcgtgtggccttaactgggttaacgattgctgaatatttccgtgatgtggaaggacaagacgtgctattatttattgataacattttccgtttcacccaagccggttcagaagtttctgcccttttaggtcggatgccgtcagccgttggttaccaaccaaccttagcgactgaaatgggacaattacaagaacggattacttcaacgaaaaaaggatcaattacctct

SEQ ID NO: 292 - DNA, 831 bp, Enterococcus faecium
  ref <308>: DATABASE ACCESSION NUMBER: ATCC 19434
tttctttagaccaatccttaccagatatcaacaacgcattagttgtttataaaaatgacgaaaataaatcaaaagttgttcttgaagcagcgttagaattaggggacggagtgatccggaccattgcgatggaatcaacagatggtttacaaagaggaatggaagtcattgatacaggcaaagcaatctctgttcctgtaggtaaagaaacattaggtcgcgtattcaacgtactaggagatacgatcgatttagaaacacctttcccagaagatgcggaaagaagcgaaattcataaaaaagcaccagcctttgacgaattaagtacaagtacagaaattttggaaacagggatcaaagttatcgatttgcttgccccatatttaaaaggtgggaaagtcggactattcggtggtgccggtgttggtaaaaccgtactgatccaagaactgatccataatatcgcccaagaacatggtggtatttctgtatttaccggtgtaggtgaacgtactcgtgaaggtaatgacttgtattatgaaatgaaagattcaggagttatcgaaaaaacagccatggtgttcggacaaatgaacgaaccaccaggtgcacgtatgcgtgttgctttgactggtttgacgattgcggaatatttccgtgatgtagaaggtcaagatgtactgttgtttatcgacaacattttccgtttcactcaagctggatctgaagtatcagccttgttaggacggatgccttctgcggttggttatcaaccaacattggcaacagaaatgggtcaattgcaagaacgtatcacatctacgaaaaaag

SEQ ID NO: 293 - DNA, 826 bp, Enterococcus gallinarum
  ref <308>: DATABASE ACCESSION NUMBER: ATCC 49573
ccttaccagatatcaacaatgcgttgatcgtttacaaaaaagacgagaaaaaaacaaaagtagtattggaagccgctttagaactaggggatggtgtgatccgcaccatcgcaatggaatctacagacggtttgcaacgaggaatggaagtcatcgataccggtgcctcaatctctgtccctgtaggaacagatactctaggccgagtatttaatgtactaggcgatactatcgacttggaagcaccattcccagaagatgccaaacgtagtggcatccacaaaaaagccccagatttcgatgaattgtcaacaagtacagaaatccttgaaactgggatcaaagttatcgatttattagctccttacttaaaaggtggtaaagtcggcttgttcggtggtgccggtgttggtaaaaccgtattgattcaagaattgattcacaatatcgctcaagagcatgggggaatttcagtatttaccggtgttggcgaacggacgcgtgaaggtaatgacttgtattatgaaatgaaagaatcaggcgttatcgaaaagacagccatggttttcggtcaaatgaatgaaccaccaggtgcccggatgcgggttgctttgactggtttgaccattgctgagtatttccgtgacgttgaaggacaagatgtgctcttgtttatcgataatattttccgtttcacacaagcgggttctgaagtatctgccttgttaggccggatgccatcagccgttggttatcaaccaactctagcaactgaaatgggtcaattacaagaacgaatcacttctacgaaaaaaggatctgtaac

SEQ ID NO: 294 - DNA, 846 bp, Enterococcus saccharolyticus
  ref <308>: DATABASE ACCESSION NUMBER: ATCC 43076
tttctttggaccaatccttaccagacatcaacaatgcgttggtggtctataaaaagaatgatgaaaaaacaaaagtggtacttgaaacagctttagaacttggtgatggtgtcgtacgtacgattgctatgtcgtcaacagacggtttgcaacgtgggatggaagtcatcgatacaggagcatcaatttctgttcctgttgggaaagagacattaggacgtgtatttaacgttttaggggagactatcgacttagatggtccattcccagaagaagtagcacgagatggtattcataaaaaggcacctgattttgatgaattaagtacaagtacggagattcttgaaacagggattaaagtaatcgatttattagcgccttacttaaaaggtgggaaagttggtttattcggtggtgccggtgtaggtaaaacggtattaattcaagaattgattaacaatattgcgcaagaacatggtggtatttcagtatttgcgggtgttggtgagcgtactcgtgaaggaaatgacctttattatgaaatgaaagagtcgggcgttattgagaaaacagcgatggtttttggacaaatgaacgaaccaccaggtgcacgtatgcgagttgctttaactggtttaaccattgcagaatacttccgtgatgttgaaggacaagatgtattactatttattgataacattttccgttttactcaagctggttcagaagtttcagctttattaggacgtatgccttcagcggtagggtatcaaccgacattagcaacagaaatgggacaattacaagaacgtattacgtcaacgaaaaaaggctcaattacatcaa

SEQ ID NO: 295 - DNA, 803 bp, Escherichia fergusonii
  ref <308>: DATABASE ACCESSION NUMBER: ATCC 35469
gccgtaccgcgcgtgtacgatgctcttgaggtgcaaaatggtaatgagcgtctggtgctggaagttcagcagcagctcggcggtggtatcgtgcgtaccatcgcaatggggtcctccgacggtctgcgtcgcggtctggatgtaaaagacctcgaacacccgatcgaagtcccggtaggtaaagcgactctgggccgtatcatgaacgtactgggtgaaccggtcgacatgaaaggcgagatcggtgaagaagagcgttgggcgattcaccgcgcagcaccttcctacgaagagctgtcaaactctcaggaactgctggaaaccggtatcaaagttatcgacctgatgtgtccgttcgctaagggcggtaaagtcggtctgttcggtggtgcgggtgtaggtaaaactgtaaacatgatggagcttattcgtaacatcgcgatcgagcactccggttactctgtgtttgcgggcgtaggtgaacgtactcgtgagggtaacgacttctaccacgaaatgactgactccaacgttatcgacaaagtatccctggtatatggccagatgaacgagccgccgggaaaccgtctgcgcgttgcactgaccggcctgaccatggctgagaaattccgtgacgaaggtcgtgacgttctgctgttcgttgacaacatctatcgttacaccctggccggtacggaagtatccgcactgctgggccgtatgccttcagcggtaggttatcagccgactctggcggaagagatgggcgttcttcaggaacgtatcacctccaccaaaactgg

SEQ ID NO: 296 - DNA, 822 bp, Escherichia hermannii
  ref <308>: DATABASE ACCESSION NUMBER: ATCC 33650
gatgccgtaccgcgcgtgtacgatgctcttgaggtgcaaaatggtgatgagcgtctggtgctggaagtgcagcagcagctcggcggcggtatcgtgcgtaccatcgcaatgggttcttccgacggtctgcgtcgtggtctgactgtcgtcgacctcgagcacccgatcgaagtcccggtaggtaaagcgaccctgggccgtatcatgaacgtgctgggtcagccgatcgacatgaaaggcgatatcggtgaagaagagcgttgggcgattcaccgcgcggcgccgtcctatgaagagctgtccagctctcaggaactgctggaaaccggcatcaaagttatcgacctgatgtgtccgttcgcgaagggcggtaaagtcggtctgttcggtggtgcgggcgtaggtaaaaccgtaaacatgatggagctgatccgtaacatcgcgatcgagcactccggttactctgtgtttgcgggcgtgggtgaacgtactcgtgagggtaacgacttctaccatgaaatgaccgactccaacgttctggacaaagtatccctggtttacggccagatgaacgaaccgccgggaaaccgtctgcgcgttgcactgaccggcctgaccatggctgagaaattccgtgacgaaggtcgtgacgttctgttgttcgtcgacaacatctaccgttacaccctggccggtactgaagtatccgcactgctgggccgtatgccttctgcggtaggttaccagccgaccctggcggaagagatgggcgttctgcaggagcgtatcacctccaccaaaaccggttctatcacctccgta

SEQ ID NO: 297 - DNA, 808 bp, Escherichia vulneris
  ref <308>: DATABASE ACCESSION NUMBER: ATCC 33821
ccgaacgtgtacgacgccctcgaagtgacaaatggtaatgagcgtctggtgctggaagttcagcagcagctcggcggcggtatcgtacgtaccatcgctatgggttcttccgacggtctgcgtcgtggtctggaagttcaggacctcgagcacccgatcgaagtgccggtaggtaaagcgaccctgggtcgtatcatgaacgtactgggtcagccgatcgatatgaaaggcgacatcggtgaagaagagcgttgggctattcaccgtgcagcaccgtcctatgaagagctctccagctctcaggaactgctggaaaccggcatcaaggttatcgacctgatgtgtccgttcgccaagggcggtaaagtcggcctgttcggcggcgcgggcgtgggtaaaaccgtaaacatgatggagctgatccgtaacatcgcgatcgagcactccggttactccgtgtttgcaggcgtgggtgagcgtactcgtgagggtaacgacttctaccacgagatgaccgactccaacgttctggacaaagtatccctggtgtacggccagatgaacgagccgccgggaaaccgtctgcgcgtggcactgaccggcctgaccatggctgagaagttccgtgacgaaggtcgtgacgttctgctgttcgttgacaacatctatcgttacaccctggccggtacggaagtatctgcactgctgggccgtatgccttcagcggtaggttaccagccgacgctggcggaagagatgggcgttctgcaggagcgtatcacctccaccaaaaccggttctatcacct

SEQ ID NO: 298 - DNA, 843 bp, Eubacterium lentum
  ref <308>: DATABASE ACCESSION NUMBER: ATCC 43055
tttccccctgatcagctgccggcgatttacaacgcgctgacggttgatgccaagaccctggcgggcgacttgcacctcgtgctcgaggtcgagacgcacctgccgggcaaccttgtccgctcggtggccatgagctcgacggacggtctcgtccgcggcctcgaggtcgtcgacacgggcaacccgatcatgatgcccgtgggtcccgagaccctgggtcgcatctggaacgtcatgggcgagcccgtcgacgagaagccgatgcccgaggtgaagggctacatgcccatccaccgtccggctccggactacgacgagctgtccaccaccaccgagatcttcgagaccggcatcaaggccatcgacctcgtcgagcccttcgtcaagggcggcaagacgggtctgttcggcggcgccggcgtgggcaagacggttatcatccaggagctcatcaacaacctggcccaggagcacggcggcacgtcggtgttcacgggcgtgggcgagcgtacccgcgagggtaccgacctctacctggagatgagcgactcgggcgtcatcaacaagacctgcctcgtgtacggtcagatgaacgagcctccgggagcgcgtctgcgcgtgggtctcgcgggcctcaccgaggcggagtacttccgcgatcagggccaggacgtgcttctgttcgtggacaacatcttccgcttcacgcaggccggctccgaggtgtccgctctgctgggccgcatgccctctgccgtgggttaccagccgacgctggcaaccgagatgggcgacctgcaggagcgcatcacgtcgacgtccaccggctccatcacgtccgtg

SEQ ID NO: 299 - DNA, 829 bp, Ewingella americana
  ref <308>: DATABASE ACCESSION NUMBER: ATCC 33852
tccctcaggatgcagtaccgaacgtgtacaatgctcttgaggtagaaaacggtgcctccaaactggttctggaagttcagcaacagttaggcggcggcgttgttcgttgtatcgcaatgggtacctcagacggccttcgtcgcggtctgaaagtgaacaacctggaacacccaattgaagttccggttggtaaagcgactctgggtcgtatcatgaacgtattgggtgaaccaatcgacatgaaaggtgaaatcggcgaagaagaacgtcgtgcaattcaccgtccagcgccttcttatgaagagctggctaactcccaagaattgctggaaaccggtatcaaagttatggacctgatgtgtccgttcgctaagggcggtaaagtcggtctgttcggtggtgcgggtgttggtaaaactgtaaacatgatggagctgatccgtaacatcgcgatcgagcactccggttactcagtgtttgcaggcgtgggtgagcgtactcgtgagggtaacgacttctaccacgaaatgactgactccaacgttatcgacaaagtttccctggtctatggtcagatgaatgagccaccaggtaaccgtctgcgcgttgcactgaccggcctgaccatggcggagaaattccgtgatgaaggtcgtgacgtactgctgttcgttgacaacatttaccgttacaccctggcaggtaccgaagtgtccgcacttctgggccgtatgccatcggcggtaggttatcagccaacgctggcggaagagatgggtgctctgcaagagcgtatcacctctaccaaaagtggttctatcacctccgt

SEQ ID NO: 300 - DNA, 805 bp, Francisella tularensis
  strain LVS
aacacgcctaaagtatatgatgctttaaatgtagtagaagctggtttagtattagaagttcagcaacaaattggtgatggcgtagttcgtacaattgctatgggatctagtgatggtcttagacgtggtatggaagttaagaacacaaatgcgcctatttctgttccagttggacatggcacacttggacgtatcatgaatgttttaggtgaaccaattgatgaagctggtccaattgaatatactgagaaaagatctatccatcaagctcctcctgcatatgatgagttagcattaagtacagaaatattagaaacaggtatcaaagtagttgaccttatttgtccatttgctaagggcggtaaagttggtttatttggcggtgcaggtgttggtaaaactgtaacgatgatggaacttatcaacaatattgcaaaagaacatagtggctactctgtattttccggtgttggtgaaagaactcgtgaaggtaatgacttctactatgagatgaaatattctaatgtattggataaagtatcattagtatatggtcagatgaatgagccgcctggaaacagattaagagtagctcttagtggcttaacaatagcagaaggattccgtgatgaaaagcgtgatgttttgatgtttatcgataacatctatcgttatacattagcaggtacagaggtatcggcgctacttggtcgtatgccatctgctgtgggttatcagccaacgcttgcagctgagatgggtgctttacaggagcgtattacatctactaagacaggatctatta

SEQ ID NO: 301 - DNA, 825 bp, Fusobacterium gonidiaformans
  ref <308>: DATABASE ACCESSION NUMBER: ATCC 25563
gacgaattgccaaaaatatacaatgcattaaaggtgcaagttggagaaaaagaacttgtattggaagtgcaacaacatttgggaaataatgttgtgagaacagtagcgatggactcaacagatggattgcttcgaggaatggaagtaatggataccggagcaccgattactgttccagtagggaaggcggttttaggaagaatattgaatgttttgggagagcctgtggatcaaaaagggcctgtggaaacagaagaatatttacctatccatagagaagcaccaaaatttgaagaacaagaaacagtaacagaaatttttgaaacaggaattaaagtcatagatttgttagccccttatatcaaaggaggaaagacaggtctattcggtggagccggagtagggaaaacagttttaattatggaattaattaataacattgcaaagggccacggaggaatttctgtgtttgcaggagttggagaaagaacaagagaaggaagagatttatacaacgaaatgacagagtccggagttttgaataagacctcgttggtgtatggtcaaatgaatgagccgcccggagcaagacttcgtgtggcgttgacaggattaacggttgctgaaaactttagagataaagaagggcaagatgtattgttgtttatcgacaatatcttccgtttcacacaagcaggatcagaagtatcggctctattgggaagaattccatcggcagtaggatatcaaccgaacttagcgacagaaatgggaactttacaagaaagaattacttctacaaaatcaggatctatcacttcggta

SEQ ID NO: 302 - DNA, 806 bp, Fusobacterium necrophorum subsp. necrophorum
  ref <308>: DATABASE ACCESSION NUMBER: ATCC 25286
acaatgcattaaaggtacaggtgggagaaagggaacttgtgttggaagtgcagcaacatttaggaaataatgttgtcagaacagtagcaatggattcaacagacggattacttcggggaatggaagtgagagatacaggagttcccattactgttccggtaggaaaggcggttttgggaagaatattaaatgtcttaggggagcctgtggacgaaaaaggtccgatagagacagaagaatatttaccaatacatagagaagcaccgaaatttgaagaacaggaaacggtgacagaaatttttgaaacaggaattaaagtcattgatttgttagctccttatattaaaggaggaaaaacaggcctattcggaggagccggagtaggaaaaaccgttttgattatggaactgatcaataatattgcaaaaggtcatggaggaatttctgtttttgcaggagttggagaaagaacgagagagggaagagatctatacaacgaaatgacagagtccggagttttgaataaaacttctttggtatatgggcaaatgaatgagccgcccggagcaagacttcgagtggctttaaccggacttactgttgccgaaaatttcagagataaagagggacaggatgtcttattgttcattgacaatattttccgtttcacacaagcaggttcggaagtatcggcacttttggggagaattccttctgcagtgggatatcaaccgaacttggcgacagaaatgggaagcttacaagaaagaattacttctacaaaatccggttctatcacttccgtg

SEQ ID NO: 303 - DNA, 821 bp, Fusobacterium nucleatum subsp. polymorphum
  ref <308>: DATABASE ACCESSION NUMBER: ATCC 10953
gatgaattgcctgcaatatataatgctttaaaagtaaaattagaagataaggaacttgttctagaagttgaacaacatcttggtaacaatgttgtaagaactgttgctatggattcaactgatggattaaaaagaggaatggaagttatagatacaggtaaaccaattacagtaccagttggtaaagctgttcttggtagaatattaaatgttttaggagaacctgttgataatcaaggtcctataaatgctgaaacatttttacctattcatagagaagcaccagaatttgatgacttagaaactgaaactgaaatatttgaaacaggaataaaagttatagacttattagcaccatatattaaaggtggaaaaataggattatttggtggagctggagtaggaaaaacagttttaataatggaacttatcaacaacattgcaaaaggacatggaggaatttcagtttttgcaggagttggagaaagaacaagagaaggtagagacttatatggtgaaatgactgaatcaggagttatcacaaaaacagctcttgtttatggacaaatgaatgagccacctggagcaagacttagagttgcattaacagggcttactgttgcagaaaactttagagataaagatgggcaagatgttcttctatttatagataatatatttagatttacacaagcaggttcagaagtttcagctttacttggaagaataccatcagctgttggatatcaaccaaacctagcaactgaaatgggtgctttacaagaaagaataacatctacaaaatctggttcaattacatc

SEQ ID NO: 304 - DNA, 864 bp, Gardnerella vaginalis
  ref <308>: DATABASE ACCESSION NUMBER: ATCC 49145
ttcccagttggctatcttccagatatttataatgctctcaaggttgatatcaacaccgttggaaacacggagggagataccgtccacgagattacattggaagttgagcagcaccttggtgattcaactgtgcgagcagtggcacttaagcctacggacggcttggtccgtggtgctttagtgcgagatactggtggcccaatttctgtgcctgttggagatgttacaaaaggtcacgtttttgacgtaactggtaacattttaaacgctaaaccaggcgaaaacattgaggtgaccgagcgctggccaatccaccgcaacccacctgctttcgatcagcttgagtctaagactcaaatgtttgaaacaggcattaaggttatcgatttgcttacgccttacgttcagggcggaaagattggtctgttcggtggtgcaggcgttggtaaaactgtgttgattcaggagatgattcagcgcgttgcacagaaccacggcggtgtgtctgtgtttgctggcgttggcgaacgtactcgtgagggtaacgatttgattggcgaaatggctgaggctggcgttttggagaaaacagcgcttgtctttggtcagatggatgagcctcctgggactcgtcttcgtgtgcctcttactgctttgactatggctgagtatttccgtgatgttcagaatcaggatgtgttgctgtttatcgacaacatcttccgctttactcaggcaggttctgaggtttccacgttgcttggtcgtatgccttctgcagttggttatcagccaaacttggcggatgaaatgggtgcgttgcaggagcgcattacttctacgcgcggtcattctattacgtcg

SEQ ID NO: 305 - DNA, 848 bp, Gemella haemolysans
  ref <308>: DATABASE ACCESSION NUMBER: ATCC 10379
tcgaatcagggcatatgccaaatctattaaacgctttagaagtttacatagaaaaaggcgatgggaaaaaagaaaaattagttcttgaagtttctcttgaaattggtgataacgtagtaagaacaatcgctatgtcatctactgatggattaaataggggagcagaagtagtagatacaggagcaccaattacagttcctgtaggtaactacacattaggtcgtgtgttcaacgtattaggtgaagcagttgaccacggtgaagaagcaggagcagaagttcgtaaagattcaattcacaaagaagctccaacattcgatgaattatcaactcacgttgaggttcttgaaacaggtattaaagttatcgacttacttgcaccatatattaaaggtggtaaaatcggtcttttcggtggtgcgggagttggtaaaacggttcttatccaagaacttatcaacaacgttgcgcaacaacacggtggattatcagtattcacaggtgtaggtgagcgtactcgtgaaggaaatgacttatactatgaaatgaaagattctggtgttattaacaaaacagccatggtattcggacaaatgaacgaaccaccaggtgctcgtatgcgtgtagcattaacaggattaacaatggcggaatacttccgtgatgaagaaggacaagacgtgcttctattcatcgataacattttccgtttcacacaagcaggttctgaggtttctgcgttattaggacgtatgccatcagccgttggttaccaaccaacacttgctacagagatgggacgtttacaagaacgtataacatcaactaaaaaaggttctgttacatct

SEQ ID NO: 306 - DNA, 848 bp, Gemella morbillorum
  ref <308>: DATABASE ACCESSION NUMBER: ATCC 27824
tcgaatcagggcatatgcctaatctactaaacgctttagaagtttatatagaaaaaggcgatggaaaaaaagaaaaattagttcttgaagtttctcttgaaatcggggataatgtcgtaagaactattgcgatgtcatctactgatggattaaacagaggggcagaagtagttgatactggagcgccaattacagtgccagtaggtaactatacattaggacgtgtgttcaacgtattaggtgaagcagttgaccacggagaagaagctggagcagaagttcaaaaagaatctattcataaagaagctccaactttcgaagaattatcaacacatgttgaggtattagaaacaggtattaaagttatcgaccttcttgcaccatatattaaaggtggtaagattggactattcggtggtgctggagttgggaaaacagttcttatccaagaacttattaacaacgtagcacaacaacacggaggactttcagtatttactggggtaggtgaacgtactcgtgagggtaacgacttgtactatgaaatgaaagactctggagttattaataaaactgccatggtatttggtcaaatgaatgagccaccaggtgcacgtatgcgtgttgccttaacaggattaacaatggcagagtacttccgtgatgaagaaggacaagacgtactattatttatcgataatatcttccgtttcacacaagcagggtctgaggtatctgcattattagggcgtatgccttcagccgttggatatcaaccaactcttgcaacagaaatgggacgtcttcaagaacgtattacatcaactaaaaaaggatctgttacatct

SEQ ID NO: 307 - DNA, 813 bp, Haemophilus ducreyi
  DSM 8925
gatgcagtaccaaaagtatatgatgctttaaaagttgaatcaggtttaaccttagaagttcaacaacaattaggtggtggtttagtacgttgtatcgcattaggtacctcagatggtttaaagcgtagcttaaaggttgtaaatacaggtaaccctattcaagttcctgtaggcactaaaacattaggccgtattatgaatgtattaggcgaaccaattgatgaaaaaggacctattagcgaagaagctcgttgggatattcatcgtgcggctccaaattatgaagaacagtcaaatagtactgaattacttgaaaccggtatcaaagttattgacttaatttgtccatttgcaaaaggtggtaaagtcggcttatttggtggagctggtgtaggtaaaaccgttaatatgatggaattgatccgtaatattgctattgagcactcaggttattcggtttttgctggtgtaggtgagcgtactcgtgaaggtaatgatttttatcatgaaatgacggattctaatgtattagataaagtatcactagtatatggtcaaatgaatgaaccaccaggtaaccgcctacgtgttgcgttaacaggtttaactatggctgaaaaattccgtgatgaaggtcgtgatgtattatttttcgtagataatatttatcgttatactttagccggtacagaagtttctgctttattaggccgtatgccatcagcggtaggttatcaaccaacccttgcagaagaaatgggtgtattacaagaacgtattacctcaactaaaactggttcaatcacggcagta

SEQ ID NO: 308 - DNA, 826 bp, Haemophilus haemolyticus
  ref <308>: DATABASE ACCESSION NUMBER: ATCC 33390
tgaatttccacaagatgcagtgccaaaagtttacgatgcattaaaagttgaatcaggtttaacacttgaggtgcaacaacaattaggtggcggtgtggtacgttgtatcgcattaggtgcttctgacggtttaaaacgtggtttaaaagtagaaaacacgaatgatccgattcaagtaccggtaggcacaaaaacccttggtcgtatcatgaatgtattgggtgaaccaattgacgaacaaggtccaatcggtgaagaagagcgttgggctatccatcgttctgcaccaagctatgaagaacaatcaaacagtacggaattattagagactggtatcaaagttatcgacttaatttgtccattcgcaaaaggtggtaaagttggtctattcggtggtgcgggtgtaggtaaaaccgttaacatgatggaattaatccgtaacatcgcgatcgagcactcaggttactccgtatttgcgggtgtaggtgaacgtactcgtgaaggtaacgacttctatcatgaaatgaaagattctaacgtattagataaagtatctttggtttatggtcagatgaatgagccaccaggtaaccgtttacgtgttgcgttaactggtttaaccatggcagaaaaattccgcgatgaaggtcgtgatgtattattcttcgtggataatatctatcgttatacccttgctggtacggaagtatctgcgttattaggtcgtatgccatctgcggtaggttaccaaccaactcttgctgaagaaatgggtgtgttacaagaacgtatcacttcaaccaaaacaggttctattacatctgta

SEQ ID NO: 309 - DNA, 809 bp, Haemophilus parahaemolyticus
  ref <308>: DATABASE ACCESSION NUMBER: ATCC 10014
gatgcagtaccaaaagtatatgatgcgttaaaagttgaatcaggtttaacgcttgaagttcaacaacaattaggcggtggcttagtgcgctgtatcgcattaggtacgtctgatggtttaaaacgtggcttaaaagtagaaaatacaggcaacccaattgaagtgccagtgggcactaaaacccttggtcgtattatgaacgtattgggtgagccgattgacgaaaaaggtcctatcggtgaagaagcacgctgggcaatccaccgtgcagcaccaagctacgaagagcaatcaaatagcacggaattactcgaaacaggtatcaaagttatcgacttaatctgcccattcgcaaaagggggtaaagttggtttatttggtggtgcaggtgtaggtaaaaccgtaaatatgatggagttaatccgtaacatcgcgatcgaacactctggttactctgtatttgcaggggtaggtgagcgtactcgtgaaggtaatgacttctaccacgaaatgacagactctaacgtattagataaagtatcgttagtgtatggtcaaatgaacgaaccaccaggtaaccgtttacgcgtagctttaacaggcttaaccatggcggaaaaattccgcgatgaaggtcgtgacgtattattcttcgtcgataacatctaccgttataccctagcaggtacggaagtgtcagcacttctcggtcgtatgccatctgcggtaggttatcagccaaccttagcagaagaaatgggtgtattacaagagcgtatcacttcaaccaaaactggttctatcacctc

SEQ ID NO: 310 - DNA, 824 bp, Haemophilus parainfluenzae
  ref <308>: DATABASE ACCESSION NUMBER: ATCC 7901
cgaatttccacaagatgcagtaccaaaagtttatgatgcattaaaagttgaatcgggtttaacccttgaagttcaacaacaattaggtggtggtgtggtacgttgtatcgcactgggagcttctgacggtttaaaacgcagtttaagcgttgaaaataccaataaaccaatttcagtaccggttggtgtaaaaactctcggtcgtattatgaacgtattgggcgaaccgattgatgaaagaggtcctatcggtgcggaagaagaatgggcaattcaccgttctactccaagttatgaagaacagtccaacagtaccgaattattagaaaccggtatcaaagttatcgacttaatttgtccattcgcgaagggtggtaaagttggtttattcggtggtgcgggtgtaggtaagaccgtaaatatgatggaattaatccgtaatattgcgattgagcactcaggttactccgtatttgccggtgtaggtgagcgtacccgtgaaggtaacgacttctaccatgaaatgacagaatctaacgtattagacaaagtatccctagtttacggacaaatgaatgagccgccgggtaaccgtttacgtgttgctttaaccggtttaaccatggcagaaaaattccgtgacgaaggtcgtgatgtattattcttcgtggataacatctatcgttatacccttgcagggactgaagtatcggcacttttaggccgtatgccatcagcggtaggttatcagccgacacttgcagaagaaatgggtgtgttacaagaacgtattacatcaaccaaaacaggttctattacttctg

SEQ ID NO: 311 - DNA, 811 bp, Hafnia alvei
  ref <308>: DATABASE ACCESSION NUMBER: ATCC 13337
gccgtgcctaaagtgtataacgcacttgaggtgaaaggcggtgccactaaactggtactggaagttcagcagcagctaggcggcggcgttgtacgctgtatcgctatgggtacttctgacggtctgcgtcgcggactggacgttgttgacctggagcacccgattgaagtcccagtaggtaaagcgaccttaggccgcattatgaacgtactgggtgagccaattgatatgaagggtgatatcggcgaagaagatcgctgggctattcaccgtgaagctccaagctacgaagaactgtctaactcgcaagaactgctggaaactggtatcaaggtaatggacctgatttgtccgttcgctaagggcggtaaagttggtctgttcggtggtgcgggtgttggtaaaacagtaaacatgatggagctgatccgtaacatcgcgatcgagcactcaggttactctgtatttgccggcgtgggtgaacgtactcgtgagggtaacgacttctaccacgaaatgaccgactccaacgtattggacaaagtatcactggtttatggccagatgaacgagccaccaggaaaccgtctgcgcgttgcgctgaccggtctgactatggctgagaagttccgtgacgaaggtcgtgacgtactgctgttcatcgataacatctaccgttataccttggccggtaccgaagtatctgcactgttgggtcgtatgccttctgcggtaggttatcagccaacgctggcggaagagatgggtgttctgcaagaacgtatcacctcgaccaaaacgggttcaatca

SEQ ID NO: 312 - DNA, 831 bp, Kingella kingae
  ref <308>: DATABASE ACCESSION NUMBER: ATCC 23330
gcgatgctattccacgcgtttacgatgcgttgaaactggttgatgtggacttgacattagaagtgcaacaacaactgggcgatggcgtagtgcgtaccattgcgatgggtagtaccgatggtttgaaacgcggcttagccgtgaacaacacaggcgcacctattacagtgcctgttggtaaagcaacattgggtcgtattatggacgtattgggtaatcctgttgatgaagcaggtccaattggttctgaccaaacgcgtgctattcaccaaccagctcctaaatttgatgaactgtctagcgcaaccgaattgctggaaacaggcatcaaagtgattgacttgctttgcccatttgcaaaaggtggtaaagtaggtttgtttggtggtgcaggtgtgggcaaaactgtgaacatgatggagttgattaacaacattgccaaagcgcacagtggtttgtctgtatttgcaggcgtgggtgaacgtactcgcgaaggtaatgacttctatcacgagatgaaagattctaacgtgttggataaagttgccatggtgtatggtcaaatgaatgaacctcctggcaaccgtttgcgcgttgcattgactggtttgtctatggcagaacacttccgtgatgaaaaagacgaaaatggcaaaggtcgcgatgtattgttctttgtggacaacatctatcgctacacattggcaggtacagaagtatcggcattgctgggtcgtatgccctctgcggtaggttatcaaccaacattggcagaagaaatgggtcgtttgcaagagcgtattacttcaacgcaaacaggttcgattactt

SEQ ID NO: 313 - DNA, 812 bp, Klebsiella pneumoniae subsp. ozaenae
  ref <308>: DATABASE ACCESSION NUMBER: ATCC 11296
atgccgtaccacgcgtgtacgaagcccttgaggtacagaatggtaatgaagttctggtgctggaagttcagcagcagctgggcggcggtatcgtacgtaccatcgccatgggttcttctgatggtctgcgccgcggtctggatgtaaaagacctcgagcacccgatcgaagtcccggtaggtaaagcaacgctgggtcgtatcatgaacgtactgggtcaaccggttgacatgaaaggcgacatcggcgaagaagagcgttgggctatccaccgcgcggcaccgtcctatgaagagctgtccagctctcaggaactgctggaaaccggcatcaaagttatcgacctgatgtgtccgttcgccaagggcggtaaagttggtctgttcggcggtgcgggtgtaggtaaaactgtaaacatgatggagctgatccgtaacatcgcgatcgagcactccggttactctgtgtttgcgggcgtaggtgagcgtactcgtgagggtaacgacttctaccacgaaatgaccgactccaacgttatcgataaagtatccctggtgtacggccagatgaacgagccgccgggaaaccgtctgcgcgttgcgctgaccggcctgaccatggctgagaaattccgtgacgaaggtcgtgacgtactgctgttcgtcgataacatctatcgttacaccctggccggtactgaagtatccgcgctgctgggtcgtatgccttcagcggtaggttatcagccgaccctggcggaagagatgggcgttctgcaggaacgtatcacctccaccaaaaccggttctatc

SEQ ID NO: 314 - DNA, 812 bp, Klebsiella ornithinolytica
  ref <308>: DATABASE ACCESSION NUMBER: ATCC 31898
atgccgtaccgcgcgtgtacgatgctcttgaggtacagaatggtaatgagagcctggtgctggaagttcagcagcagctcggcggtggtatcgtacgtgctatcgccatgggttcttccgacggtctgcgtcgtggtctggaagttaaagaccttgagcacccgatcgaagtcccggttggtaaagcaacgctgggtcgtatcatgaacgtgctgggtcagccaatcgatatgaaaggcgacatcggcgaagaagagcgttgggctattcaccgtgcagctccgtcctatgaagagctgtccagctctcaggaactgctggaaaccggcatcaaagttatcgacctgatgtgtccgttcgctaagggcggtaaagttggtctgttcggtggtgcgggtgtaggtaaaaccgtaaacatgatggagctgatccgtaacatcgcgatcgagcactccggttactccgtgtttgcgggcgtaggtgaacgtactcgtgagggtaacgacttctaccacgaaatgaccgactccaacgttctggataaagtatccctggtttatggccagatgaacgagccgccgggaaaccgtctgcgcgttgctctgaccggcctgaccatggctgagaaattccgtgacgaaggtcgtgacgttctgctgttcgtcgataacatctatcgttataccctggccggtactgaagtatccgcactgctgggtcgtatgccttcagcggtaggttatcagccgaccctggcggaagagatgggtgttctgcaggaacgtatcacctccaccaaaaccggttctatc

SEQ ID NO: 315 - DNA, 813 bp, Klebsiella oxytoca
  ref <308>: DATABASE ACCESSION NUMBER: ATCC 33496
gtaccgcgcgtgtacgaggctcttgaggtacaaaatggtagtgagaatctggtgctggaagttcagcagcagctcggcggcggtattgttcgtaccatcgccatgggttcttccgacggtctgcgtcgcggtctggaagtcaaagacctcgagcatccgatcgaagtcccggtaggtaaagcaacgctgggtcgtatcatgaacgtactgggccaaccggtagacatgaaaggcgacatcggcgaagaagagcgttgggcgattcaccgcgcagcgccttcctacgaagagttgtcaaactctcaggaactgctggaaaccggcatcaaagttatcgacctgatgtgtccgtttgcgaagggcggtaaagttggtctgttcggtggtgcgggtgtaggtaaaaccgtaaacatgatggagctgatccgtaacatcgcgatcgagcactccggttactccgtgtttgcgggcgtaggtgaacgtactcgtgagggtaacgacttctaccacgaaatgaccgactccaacgttatcgataaagtatccctggtgtatggccagatgaacgagccgccgggaaaccgtctgcgcgttgcgctgaccggcctgaccatggctgagaagttccgtgacgaaggtcgtgacgttctgctgttcgtcgataacatctatcgttacaccctggccggtactgaagtatccgcactgctgggtcgtatgccttcagcggtaggttaccagccgactctggcggaagagatgggcgttctgcaggaacgtatcacctccaccaaaacgggttctatcacttcc

SEQ ID NO: 316 - DNA, 822 bp, Klebsiella planticola
  ref <308>: DATABASE ACCESSION NUMBER: ATCC 33531
gatgccgtaccgcgcgtgtacgatgctcttgaggtacagaatggtaatgagagcctggtgctggaagttcagcagcagctcggcggtggtatcgtacgtgctatcgccatgggttcttctgacggtctgcgtcgtggtctggaagttaaagaccttgagcacccgatcgaagtcccggttggtaaagcaacgctgggtcgtatcatgaacgtgctgggtcagccgatcgatatgaaaggcgacatcggcgaagaagagcgttgggctattcaccgcgcagctccgtcttatgaagagctgtccagttctcaggaactgctggaaaccggcatcaaagttatcgacctgatgtgtccgttcgctaagggcggtaaagtaggtctgttcggtggtgcgggcgtaggtaaaaccgtaaacatgatggagctgatccgtaacatcgcgatcgagcactccggttactccgtgtttgcgggcgtcggtgaacgtactcgtgagggtaacgacttctaccacgaaatgaccgactccaacgttctggataaagtatccctggtttatggccagatgaacgagccgccgggaaaccgtctgcgcgttgctctgaccggcctgaccatggctgagaaattccgtgacgaaggtcgtgacgttctgctgttcgtcgataacatctatcgttataccctggccggtactgaagtatccgcactgctgggtcgtatgccttcagcggtaggttatcagccgaccctggcggaagagatgggtgttctgcaggaacgtatcacctccaccaaaaccggttctatcacttccgta

SEQ ID NO: 317 - DNA, 785 bp, Klebsiella pneumoniae subsp. pneumoniae
  ref <308>: DATABASE ACCESSION NUMBER: ATCC 13883
agaatggtaatgaagttctggtgctggaagttcagcagcagctgggcggcggtatcgtacgtaccatcgccatgggttcttctgatggtctgcgccgcggtctggatgtaaaagacctcgagcacccgatcgaagtcccggtaggtaaagcaacgctgggtcgtatcatgaacgtactgggtcaaccggttgacatgaaaggcgacatcggcgaagaagagcgttgggctatccaccgcgcggcaccgtcctatgaagagctgtccagctctcaggaactgctggaaaccggcatcaaagttatcgacctgatgtgtccgttcgccaagggcggtaaagttggtctgttcggcggtgcgggtgtaggtaaaactgtaaacatgatggagctgatccgtaacatcgcgatcgagcactccggttactctgtgtttgcgggcgtaggtgagcgtactcgtgagggtaatgacttctaccacgaaatgaccgactccaacgttatcgataaagtatccctggtgtacggccagatgaacgagccgccgggaaaccgtctgcgcgttgcgctgaccggcctgaccatggctgagaaattccgtgacgaaggtcgtgacgtactgctgttcgtcgataacatctatcgttacaccctggccggtactgaagtatccgcactgctgggtcgtatgccttcagcggtaggttatcagccgaccctggcggaagagatgggcgttctgcaggaacgtatcacctccaccaaaaccggttctatcacctccgta

SEQ ID NO: 318 - DNA, 759 bp, Kluyvera ascorbata
  ref <308>: DATABASE ACCESSION NUMBER: ATCC 33433
ctggtgctggaagttcagcagcagctcggcggcggtatcgtacgtwccatcgctatgggttcttccgacggtctgcgtcgcggtctggatgttaaagatctcgagcacccaatcgaagttccggtmggtaaagcaacmctgggtcgtatcatgaacgtactgggtcakccagtmgacatgaaaggcgacatcggtgaagaagagcgttgggctatccaccgcgctgcaccttcctacgaagagctgtctagctctcaggaattgctggaaaccggtatcaaagttatcgacctgatgtgtccgttcgctaagggcggtaaagtcggtctgttcggtggtgcsggtgttggtaaaaccgtaaacatgatggagctgatccgtaacatcgcgatcgagcactccggttactccgtgtttgcgggcgtaggtgaacgtactcgtgagggtaacgacttctaccacgaaatgaccgactccaacgttatcgataaagtatccctggtatatggccagatgaacgagccaccgggaaaccgtctgcgcgttgctctgaccggtctgaccatggctgagaaattccgtgacgaaggtcgtgacgtactgctgttcgtcgataacatctatcgttacaccctggccggtactgaagtatctgcwctgctgggtcgtatgccttcagcggtaggttaccagccgaccctggcggaagagatgggcgttctgcaggaacgtatcacctccaccaagaccggttctatc

SEQ ID NO: 319 - DNA, 831 bp, Kluyvera cryocrescens
  ref <308>: DATABASE ACCESSION NUMBER: ATCC 33435
ttccctcaggatgccgtaccgcgtgtgtacgaagcccttgaggttcagaatggtaatgaagtgctggtgctggaagttcagcagcagctcggcggcggtatcgtacgtaccatcgctatgggttcttccgacggtctgcgtcgtggtctggatgtaaaagacctcgagcacccgatcgaagtcccggtaggtaaagcaacactgggtcgtatcatgaacgtactgggccaaccggtagacatgaaaggcgacatcggtgaagaagaacgttgggctatccaccgtgcagcaccttcctacgaagagctgtcaagctctcaggaactgctggaaaccggcatcaaagttatcgacctgatgtgtccgtttgcgaagggcggtaaagttggtctgttcggtggtgcgggtgtaggtaaaaccgtaaacatgatggagcttattcgtaacatcgcgattgagcactccggttattctgtgtttgcgggcgtaggtgaacgtactcgtgagggtaacgacttctaccacgaaatgaccgactccaacgttatcgataaagtttccctggtttacggccagatgaacgagccaccaggaaaccgtctgcgcgttgcgctgactggtctgactatggctgagaagttccgtgacgaaggtcgcgacgtactgctgttcgtcgataacatctatcgttacaccctggccggtacagaagtatctgcactgctgggtcgtatgccttcagcggtaggttaccagccgactctggcggaagagatgggcgttctgcaggaacgtatcacctccaccaaaaccggttctatcacctccgta

SEQ ID NO: 320 - DNA, 810 bp, Kluyvera georgiana
  ref <308>: DATABASE ACCESSION NUMBER: ATCC 51603
gccgtaccgcgcgtgtacgaagcccttgaggtacagaatggtaatgaagtgctggtgctggaagttcagcagcagctcggtggcggtatcgtgcgtaccatcgccatgggttcctccgacggtctgcgtcgcggtctggaagttaaagatctcgagcacccgatcgaagttccggtaggtaaagcaacactgggtcgtatcatgaacgtactgggtcacccggtagacatgaaaggcgacatcggtgaagaagagcgttgggctatccaccgcgctgcgccttcctacgaagagctgtccagctctcaggaactgctggaaaccggtatcaaagttatcgacctgatgtgtccgttcgcgaagggcggtaaagtcggtctgttcggcggtgcgggtgttggtaaaaccgtaaacatgatggagctgatccgtaacatcgcgatcgagcactccggttactctgtgtttgcgggcgtaggtgaacgtactcgtgagggtaacgacttctaccacgaaatgaccgactccaacgttatcgataaagtatccctggtgtatggccagatgaacgagccgccgggaaaccgtctgcgcgttgcgctgaccggcctgaccatggctgagaaattccgtgacgaaggtcgtgacgtactgctgttcgtcgataacatctatcgttacaccctggccggtactgaagtatctgcactgctgggtcgtatgccttcagcggtaggttaccagccgactctggcggaagagatgggcgttctgcaggaacgtatcacctccaccaagaccggttctatc

SEQ ID NO: 321 - DNA, 834 bp, Lactobacillus acidophilus
  ref <308>: DATABASE ACCESSION NUMBER: ATCC 4356
tcgataagaatttacctgatattaacaacgccttacgtgtaatcaagtccgaagatgaaagcatcgttcttgaagttacacttgaactcggtgatggtgttttaagaacaatcgccatggaatctaccgatggtcttcgtcgtggtatgaaagtcgaagatactggcgctccaatttcagttccagttggagaagacactttaggtcgtgtgtttaacgttttaggacagcctattgatggtggtccagcctttccaaaggatcacccacgtgagggtatccacaaggaagcacctaaatatgaagatttaactactagtcgtgaaattcttgaaactggtatcaaggttatcgaccttcttgaaccatatgttcgtggtggtaaagttggtttgtttggtggtgccggtgttggtaaaactactattattcaagaattaattcacaacatcgctcaagaacacggtggtatttccgtatttactggtgttggtgaaagaactcgtgaaggtaatgacctttactttgaaatgaaagcttcaggcgttttaagtaagactgccatggtatttggtcagatgaacgagccgcctggtgccagaatgcgtgttgcattaaccggtttgacacttgctgaatactttagagatgttgaaggtcaagacgtattgctctttattgacaatatctttagatttactcaggctggttcagaggtatctgctttgcttggtcgtatgccaagtgccgtaggttatcagccaactttggcaacagaaatgggtcaattgcaggaaagaattacttctactaagaagggttcaattacttcaa

SEQ ID NO: 322 - DNA, 824 bp, Legionella pneumophila subsp. pneumophila
  ref <308>: DATABASE ACCESSION NUMBER: ATCC 33152
ttcctcgtgatagcgtgcctaaagtcaatgatgcgttaaagcttgttgatagtgatctggtttttgaagtgcagcagcaacttggagacggagttgtgcgtactattgccatgggaacaaccgatggtttaaagcgaggattaaaagcagaaaatacaggccatcctattcaagtgccagtaggtaagaaaactttgggacgcattatggatgttcttgggcgtcctgtagatgatgctgggcctatcgatgctgaagagacttgggctattcatcgtaaagcaccaagttatgaagagcaagctggcagccaggaattattggaaactggtattaaagtaattgatttgctttgcccttttgccaagggaggtaaagttggtctattcggtggtgccggtgtaggcaaaaccgttaacatgatggaattaatacgaaacattgcaattgagcatagcggttattcagtgtttgcaggggttggtgaacgtacccgtgaaggaaacgacttctatcatgagatgaaagactctaatgtattggataaagtatcgcttgtttatggtcagatgaatgagccgccaggaaaccgtttgcgtgttgctctaaccggtttgactatggctgaaaaattccgggatgaagggcgagacgttcttttgtttatcgataatatttatcgttataccttggctggggttgaagtatctgcgctgttaggccgtatgccttctgcagtaggatatcagccgacattagcagaggaaatgggtatgctgcaagagcgcattacctccacaaaaacaggttctattacttccata

SEQ ID NO: 323 - DNA, 818 bp, Leminorella grimontii
  ref <308>: DATABASE ACCESSION NUMBER: ATCC 33999
gacgccgtaccgaaagtgtacgatgcgcttgaagttcaaattgatgccaagctggttctggaagttcaacagcagctcggcggcggcgttgttcgctgcatcgcgatgggtacttcagacggcttaagccgcggtctggacgtgctcgatctggaacacccgattgaagtaccggtgggcaaagcgacgctgggccgcatcatgaacgtgcttggtcaccctatcgacatgaagggcgacatcggcgaagaagagcgttgggctattcaccgcgcagcgccgagctacgaagacctgtcgggcgcaaccgagctgctggagaccggcatcaaggttatcgacctgatttgtccgttcgccaagggcggtaaagtcggcctgttcggcggcgccggcgtaggtaaaaccgtaaacatgatggagctcattcgcaacattgcgaccgagcactccggttactccgtgtttgcaggcgtaggtgaacgtacccgtgagggtaacgacttctaccacgaaatgactgaatccaacgtattggacaaggtgtcgctggtatacggtcagatgaacgagccgcctggaaaccgtctgcgcgtagcgttaacgggcttgaccatggcggagaagttccgtgatgaaggccgtgacgttctgctgtttatcgacaacatttaccgctataccctggccggtacggaagtatccgcactgctgggccgtatgccttcagccgtaggctaccagccgactctggctgaggaaatgggcgtgcttcaagagcgtattacctctaccaagacggggtctatcacctccgt

SEQ ID NO: 324 - DNA, 835 bp, Listeria monocytogenes
gtggaaacttacctgaaatctacaatgccctagttattgaatataaatctgatgcagaagaagcaccaactagccaacttactttagaagtagccatccaattaggtgatgatgttgtacgtacaatcgcaatggcatcaacagatggtgttcaaagaggtatggaagttattgatactgggagcccaattacagttcctgtaggtacagtaactcttggtcgtgtatttaatgtattaggaaacaccatcgatttggacgaaccacttccaagcgatattaaacgtaataaaattcaccgcgaagctccaactttcgatcaattagcaacgacaacagaaattcttgaaacaggaattaaagtagttgacttgctagctccttacttaaaaggtggtaaaatcggattgttcggtggtgccggtgttggtaaaaccgttctaattcaagagcttatccataatatcgcacaagaacatggtggtatttctgtgttcgctggcgttggagaacgtactcgtgaaggtaacgacctttacttcgaaatgaaagattcaggcgttattgaaaaaacagcgatggtattcggtcaaatgaacgagccaccaggtgcgcgtatgcgtgttgccttaactggtctaacaattgctgaatatttccgtgatgaagaacatcaagatgtacttttattcattgataacattttccgtttcacacaagctggttcagaggtttcggctttactaggtcgtatgccatctgcggtaggttaccaaccaaccctagctactgaaatgggtcaactacaagaacgtattacatctactaacgttgg

SEQ ID NO: 325 - DNA, 828 bp, Micrococcus lylae
  ref <308>: DATABASE ACCESSION NUMBER: ATCC 27566
cccgcgtggcgagttgccggcactgttcaacgcgctgactgtcgaggtcaccctcgaagcagtcgctaaaaccattacccttgaggttgctcagcacctcggcgacaacttggttcgtgccgtgtccatggcaccgaccgacggtctcgtccgtggcgctgctgtgatcgacagcggtaagccgatctcagttcccgttggtgacgtagtcaagggacacgtcttcaacgctctgggtgattgcctcgatgagccaggtcttggccgtgacggtgagcagtggggcatccaccgcgatccgccaccttttgaccagcttgagggtaagaccgagattctggaaaccggtattaaggtcatcgacctgctgaccccgtatgttaagggcggcaagatcggcctgttcggtggtgctggtgtgggtaagaccgttcttatccaggaaatgatcacccgtatcgctcgcgagttctccggtacctcggtgttcgcaggcgtgggtgagcgtacccgtgagggcaccgacctcttcctggaaatggaagagatgggcgttctccaggacaccgctcttgtgttcggccagatggacgagcctccaggagttcgtatgcgcgtggcgctgtccggcctgaccatggcggagtacttccgcgatgtgcagcaccaggacgtgcttctgttcatcgacaacatcttccgtttcacccaggcaggttccgaggtttccaccctcctaggccgcatgccttctgccgtgggttaccagccaacgctggcagacgagatgggtgttctgcaggagcgtattacctccacaaagggtaa

SEQ ID NO: 326 - DNA, 822 bp, Moellerella wisconsensis
  ref <308>: DATABASE ACCESSION NUMBER: ATCC 35017
gatgccgtaccaaaagtgtacgatgctcttgaggttcttaacggtaaagaaaaattggtgctggaagttcagcaacaattaggcggtggtgttgttcgttgtatcgcaatgggtacatcagatggtttaagccgcggtttagaagttaaaaatacagatcatccgatcgaagttcctgtcggtgttaaaacgcttggccgtatcatgaacgtgctgggtgacccaatcgacatgaaaggtgatatcggcgaagaagaacgctggtcaattcaccgcgcagcaccaagctatgaagatctggctaactcaacagaacttctagaaacaggtatcaaagttatggacctgatttgcccattcgctaaagggggtaaagtgggtctgttcggtggtgcgggtgtcggtaaaacagttaacatgatggagcttattcgtaatatcgcgattgagcactcaggttattctgtattcgcgggtgttggtgaacgtactcgtgaaggtaacgatttctaccatgaaatgacagactcaaacgttctggataaagtttcattggtttatggccagatgaatgagccaccaggaaaccgtctgcgtgttgctctgactggtctgactatggcagagaaattccgtgacgaaggtcgtgacgtactgttattcgtagataatatttatcgttataccttagcagggacagaagtatctgcactgctgggtcgtatgccttcagcggtgggttatcagccaacgctggcggaagagatgggtgttctgcaagaacgtatcacctcgactaagaccggctctatcacttccgta

SEQ ID NO: 327 - DNA, 854 bp, Branhamella catarrhalis
  ref <308>: DATABASE ACCESSION NUMBER: ATCC 43628
ccgtggcgatgtcccccaaatctttgatgcacttcatgttgatggtactgaaaccacccttgaagtccaacaacagttaggtgatggtgtggtgcgtaccattgccatgggttctaccgaaggcttaaagcgtggcttgcctgtctctaattcaggtgcacccatttcggtaccagtcggtcaagcaacactgggtcgcattatggatgtcctaggtcgcccaatcgatgaagcaggtccggtaaatgctgaacaaaaatggtccattcatcgtgaagcaccaagttatgatgaacagtcaaatagtacagaacttttagaaacaggcatcaaagtgattgatttgctttgtccatttgccaaaggtggtaaagtcggtctgttcggtggtgctggtgttggtaagaccgttaacatgatggagcttatcaataatatcgccctaaaacactcaggtctgtcggtttttgctggtgtgggtgagcgtactcgtgagggtaatgacttctaccatgaaatgcaagaagcaggcgttgttaataccgaagattttactcagtcaaaagttgccatggtttatggtcagatgaatgagccaccaggaaaccgtctgcgtgttgccttaactggtttgaccatggcagagtatttccgtgatgaaaaagacgaagcaacgggcaaaggccgtgatgttctgctgttcgttgataatatttatcgttacacattggcaggtactgaggtatcagcacttttaggtcgtatgccatctgcggtaggttatcagccgactttggccgaagagatgggcttgctacaagagcgtatcacctccacccaatcaggctcaatta

SEQ ID NO: 328 - DNA, 831 bp, Moraxella osloensis
  ref <308>: DATABASE ACCESSION NUMBER: ATCC 19976
ccgtcaaagcgtaccaagaatttatgatgccttaaaagttgaaggcacagaaactacattagaagtacaacaacaattgggtgatggtatcgtacgtactattgccatgggttctactgaaggtctaaaacgtggtctaccagttagcaacactggcgcaccaatctctgtacctgtgggtaaaggtacactaggtcgtatcatggacgttttaggacacccaatcgatgaggcaggtccggtagagcatagtaacacttgggcgattcaccgtgaagcgccaagctatgatgaacaatcaaactctactgaacttttagaaaccggtattaaagtaattgacttactatgcccatttgctaaaggtggtaaagtcggtctgttcggtggcgcgggtgttggtaaaaccgttaacatgatggaacttatcaataacatcgcaaaagcacactcaggtttatcggtatttgctggtgtaggtgagcgtactcgtgaaggtaatgacttctaccacgagatgaaagactcaaacgtacttgataaagttgcgatggtgtatggtcagatgaatgagccaccaggaaaccgtttacgtgttgccctgacaggtttaaccatggcagaatacttccgtgacgaaaaagatgaaaacggtaaaggtcgtgacgtattattgttcgttgacaatatttatcgttacacgctagcgggtaccgaagtatcagcattattaggtcgtatgccatctgcagtagggtatcagccaacgcttgcagaagagatgggtgtactacaagaacgtattacttcaacccaatcaggctctattac

SEQ ID NO: 329 - DNA, 835 bp, Morganella morganii subsp. morganii
  ref <308>: DATABASE ACCESSION NUMBER: ATCC 25830
cgaatttcctcaggatgcagtaccgaaagtgtacgatgcgcttgaggtaacaaatggtaaagaaaaactggtgctggaagttcagcagcagttaggcggcggggttgtccgttgtatcgctatgggtacatctgatggtctgagccgtaatctggaagtaaccgatttaggccacccgatcgaagtccctgtcggcgtgaaaaccttaggacgtatcatgaacgttctgggtgatccgatcgatatgaaaggtgacatcggcgcagaagaaaaatggtctattcaccgtgctgcaccaacatacgaagaactgtctaactcccaggaactgctggaaacaggtatcaaagtaatggacctgatctgcccgttcgcgaagggtggtaaagtcggtctgttcggtggtgcgggtgtgggtaaaaccgtaaacatgatggaactgatccgtaacatcgcgatcgagcactccggttactctgtattcgcaggggtcggtgagcgtacccgtgaaggtaacgacttctatcatgaaatgacagactccaacgttctggacaaagtatcactcgtgtacggccagatgaacgagccaccgggaaaccgtctgcgcgttgctctgaccggtctgaccatggcggaaaaattccgtgatgaaggccgcgatgtactgctgttcgttgataacatctaccgttataccctggccggtactgaagtatccgcgctgttaggccgtatgccttcagcggtaggttaccagccgacactggcggaagaaatgggtgtgcttcaggaacgtatcacatcgaccaaaacaggctctatcacgtctgta

SEQ ID NO: 330 - DNA, 824 bp, Pantoea agglomerans
  ref <308>: DATABASE ACCESSION NUMBER: ATCC 27155
gacgcggtaccgcaagtgtacagcgccctcgaggttatgaatggtgatgcgcgtctggtgctggaagttcagcagcagctcggcggcggcgtagtacgtaccatcgcaatgggtacgtctgacggcctgaagcgtggtctgagcgtcaacgacctgcagaaaccgattcaggtacccgtcggtaaagcgaccctgggccgtatcatgaacgttctcggcgagccaatcgatatgaaaggcgagctgaaagaagaagatggcagcgcagtagagatcgcctctattcaccgcgcagccccttcttatgaagatcagtctaactcgcaggaactgctggaaaccggcatcaaggttatcgacctgatgtgtccgtttgctaaaggcggtaaagtcggtctgttcggtggtgcgggtgtaggtaaaaccgtcaacatgatggaactgatccgtaacatcgcggctgaacactcaggttactcagtgtttgccggtgtgggtgagcgtactcgtgagggtaacgacttctaccacgaaatgactgactctaacgttatcgataaagttgcactggtctatggccagatgaacgagccgccgggtaaccgtctgcgcgtagcactgaccggtctgaccatggcggaaaaattccgtgatgaaggtcgcgacgttctgctgttcatcgataacatctaccgttataccctggccggtacagaagtttctgcactgctgggtcgtatgccatctgcggtaggttaccagccaacgctggcagaagagatgggtgtgttgcaggagcgtattacctccaccaagaccggttc

SEQ ID NO: 331 - DNA, 808 bp, Pantoea dispersa
  ref <308>: DATABASE ACCESSION NUMBER: ATCC 14589
tatacagcgctctcgaggtaaaaaatggtgatgctcgtctggtgctggaagtacagcagcagctgggcggtggcgtggtgcgtaccatcgccatgggttcttctgacggcctgaagcgcggtctggaagtcaccgacctgaaaaaacctatccaggttccggttggtaaagcaacactcggccgtatcatgaacgtgctgggtgagccaatcgacatgaaaggcgacctgaaagaagaagacggcagcgctgtagaggtttcctctattcatcgcgcagcgccttcttatgaagatcagtcaaactcgcaggaactgctggaaaccggcatcaaggttatcgacctgatgtgtccgttcgcgaagggcggtaaagtcggtctgttcggtggtgcgggtgtaggtaaaaccgtaaacatgatggagctgatccgtaacatcgcggctgagcactcaggttattcggtctttgccggcgtgggtgagcgtactcgtgagggtaacgacttctaccacgaaatgacggactccaacgttatcgataaagtagcgctggtgtatggccagatgaacgagccgccgggtaaccgtctgcgcgtagcactgaccggtctgaccatggcggaaaaattccgtgatgaaggccgtgacgttctgctgttcatcgacaacatctaccgttacaccctggccggtacagaggtttctgcactgctgggtcgtatgccatcggcggtaggttatcagccaacgctggctgaagagatgggtgtgctgcaggagcgtattacctccaccaagaccggttc

SEQ ID NO: 332 - DNA, 805 bp, Pasteurella multocida
  NCTC 10322
gatgcagtaccaaaagtatatgatgccttaaatgttgaaacaggtttagtacttgaagttcaacaacaattaggtggtggtgtagttcgctgtatcgcaatgggatcatctgatggattaaaacgcggtttaagcgtaacaaatacgaataacccaatttctgttccagtgggaacgaaaacattgggtcgtatcatgaacgtattgggtgaaccaatcgatgagcaaggtgaaatcggtgcagaagagaattggtctattcaccgtgcgccaccaagttatgaagaacaatctaacagtactgaacttttagaaacgggaattaaagttatcgacttagtttgtccgtttgcgaaagggggtaaagtaggtttattcggtggtgcgggtgtcggtaaaaccgtcaatatgatggaattaatccgtaacatcgcaattgagcactcaggttactctgtctttgcgggggtaggtgagcgtacgcgtgaaggtaacgacttctatcatgagatgaaagactctaacgtattagataaagtgtctcttgtttatggtcaaatgaacgagccaccaggtaaccgtttacgtgtggcattaacaggcttaactatggcggaaaaattccgtgatgaaggtcgtgatgtcttattcttcgttgataatatttatcgttatactcttgctggtacagaagtttctgcattattaggtcgtatgccatctgcggtaggttatcaaccaacccttgcagaagaaatgggtgttctgcaagagcgtattacctcaaccaaaacaggttctatta

SEQ ID NO: 333 - DNA, 828 bp, Pragia fontium
  ref <308>: DATABASE ACCESSION NUMBER: ATCC 49100
tttcctcaagacgccgtaccaaaagtgtacgacgcgcttgaagttcagaacgatgccaagctggtgctggaagttcaacaacagctcggtggtggtgtcgttcgttgtatcgcaatgggtacttccgatggcttaagccgcggtttaaaagtgcttgatttagaacatcctatcgaagtaccggttggtactgcgacgctgggccgtattatgaacgtgctcggtcagccaatcgatatgaaaggcgatattggtgaagaagagcgttgggctattcaccgtgaagcaccaagttatgaagatttatctggcgccaatgaactgctggaaacgggtatcaaggttatcgacctgatttgtccgtttgctaaaggtggtaaagttggtctgtttggtggtgcgggtgtaggtaaaaccgtaaacatgatggagctgattcgtaacattgcgactgagcactcaggttactccgtattcgccggtgtaggggaacgtacccgtgaaggtaatgacttctaccacgaaatgaccgaatcaaacgtactggataaagtatctctggtttatggccagatgaacgagccaccaggaaaccgtctgcgcgtggcgttaacgggtttgaccatggctgaaaaattccgtgatgaaggtcgtgacgttctgttatttatcgataacatttatcgctataccttagccggtaccgaagtatcagcactgttggggcgtatgccatcagcggtaggttatcagccaacgttagcagaagagatgggtgtgttgcaggaacgtattacttcaaccaaaaccggttcaatcacttctgta

SEQ ID NO: 334 - DNA, 807 bp, Proteus mirabilis
  ref <308>: DATABASE ACCESSION NUMBER: ATCC 25933
gtccctaaagtatacgacgctcttgaggttatgaatggtaaagaaaaactggtgctggaagttcagcaacagttaggcggtggtatcgttcgttgtatcgcaatgggtacatcagacggtttaagccgtggcttaaaggttgaagatttaggccacccaattgaagtaccagtaggtaaagcgactttaggacgtatcatgaacgttctgggtacacctattgatatgaaaggtgagattgaaaccgaagagcgttggtcaatccaccgtgaagcaccaacttacgaagagttatcaaactctcaagaactgcttgaaaccggtatcaaagttatggacttaatctgtccatttgctaaaggtggtaaagtcggtctgttcggtggtgcgggtgttggtaaaacagttaacatgatggaattgatccgtaatatcgcgatcgagcactcaggttactctgtatttgctggtgttggtgagcgtactcgtgagggtaacgacttctatcatgaaatgacagattctaacgttcttgacaaagtatcgttagtttacggtcagatgaatgagccaccaggaaaccgtctgcgtgttgcactgactggtctgactatggctgagaaattccgtgatgaaggccgtgacgtactgttattcgtcgataacatctatcgttacaccttagccggtacagaagtatcagcactgttaggtcgtatgccatcagcggtaggttaccaaccaacattggctgaagagatgggtgttctgcaagagcgtatcacttcaaccaaaacaggttctatc

SEQ ID NO: 335 - DNA, 811 bp, Proteus vulgaris
  ref <308>: DATABASE ACCESSION NUMBER: ATCC 13315
ccctaaagtatacgacgctcttgaggttatgaatggtaaagagaaactggtgctagaagttcagcaacagttaggcggtggtatcgttcgttgtatcgcaatgggtacatcagacggtttaagccgtggcttaaaagttgaaaacttaggccacccaattgaagtaccagtaggtaaagcaacactgggacgtatcatgaacgttctgggtacacctatcgatatgaaaggtgatattgcaactgaagaacgttggtctattcaccgcgaagcgccaacctatgaagagttatcaagctctcaagaactactagaaaccggtatcaaagtaatggacttaatctgtccgtttgctaaaggtggtaaagtaggtctcttcggtggtgcgggtgttggtaaaacagttaacatgatggaattgatccgtaacatcgcgattgagcactcaggttattctgtatttgcaggtgttggtgagcgtactcgtgagggtaacgacttctatcatgaaatgacagattctaacgttcttgacaaagtatcgttagtttatggtcagatgaatgagccaccaggaaaccgtctacgtgtagcactgacgggtttaaccatggcggaaaaattccgtgatgaaggccgtgacgtactgttattcgtcgataacatctatcgttacaccttagccggtaccgaagtatcagcactgttaggccgtatgccatcagcagtaggttaccaaccaacattggctgaagagatgggtgttctgcaagaacgtatcacttcaaccaaaacaggttcaatcacctct

SEQ ID NO: 336 - DNA, 806 bp, Providencia alcalifaciens
  ref <308>: DATABASE ACCESSION NUMBER: ATCC 9886
tcaagataacgtaccaaaagtgtacgatgctcttgaggttattaacggtaaagaaaaactggtgttggaagttcaacaacagttaggtggtggtgttgtccgttgtatcgcaatgggtacatcagatggtctgagccgtggtttagaagttgtaaacttagagcacccaatcgaagtaccagtcggtaaagcaactctgggacgtatcatgaacgttctgggtgaaccaatcgacatgaaaggtgatatcggcgaagaagagcgctggtctattcaccgtgctgcaccaagctacgaagaattagctaactcaactgaactgctggaaaccggtatcaaagtaatggacttaatctgtccattcgcgaaaggtggtaaagtaggtctgttcggtggtgcgggtgttggtaaaaccgtaaacatgatggaactgatccgtaacatcgcgattgagcactcaggttactcagtgttcgctggtgttggtgagcgtacccgtgaaggtaacgacttctatcatgaaatgacagactcaaacgttctggataaagtatcactggtttatggccagatgaacgagccaccaggaaaccgtctgcgtgttgcgctgactggtctgactatggctgaaaaattccgtgacgaaggtcgtgacgtactgctgttcgttgacaacatttatcgttatacactggcaggtactgaagtatcagcactgttaggtcgtatgccatcagcggtaggttaccaaccaacgctggcggaagagatgggtgttcttcaagaacgtattacctcaactcaaa

SEQ ID NO: 337 - DNA, 830 bp, Providencia rettgeri
  ref <308>: DATABASE ACCESSION NUMBER: ATCC 9250
ttccctcaagatgacgtaccaaaagtgtacgacgctcttgaggttgttaacggtaaagaaacactggtgctggaagttcagcaacagttaggcggtggtgttgtccgttgtatcgcaatgggtacatcagatggcctgagccgtggtttagaagttgtaaacttagagcacccaattgaagtaccagtaggtaaagcaactttaggacgtatcatgaacgttctgggtcagcctattgatatgaaaggtgatatcggcgaagaagagcgctggtcaattcaccgtgctgcacctagctacgaagagttagctaactcaacagagctgctggaaaccggtatcaaagtaatggacttaatctgtccattcgcgaaaggtggtaaagttggtctgttcggtggtgcgggtgttggtaaaacagtaaacatgatggaactgatccgtaacatcgcgattgagcactcaggttactcagtattcgctggtgttggtgagcgtactcgtgaagggaacgacttctatcatgaaatgactgactcaaacgttctggataaagtatcactggtttatggccagatgaatgagccaccaggaaaccgtctgcgcgttgcgttgactggtctgactatggctgaaaaattccgtgacgaaggtcgtgacgtactactgttcgttgacaacatctatcgttatacactggcaggtactgaagtatcagcactgttaggtcgtatgccttcagcggtaggttatcagccaacgctggcggaagagatgggtgttctgcaagaacgtattacctcaactcaaacgggttctatcacttccgt

SEQ ID NO: 338 - DNA, 812 bp, Providencia rustigianii
  ref <308>: DATABASE ACCESSION NUMBER: ATCC 33673
agcgtaccaaaagtgtacgatgctcttgaggttattaacggtaaagaaaaactggtgttggaagttcagcagcagttaggcggtggtgttgtccgttgtatcgcaatgggtacatcagatggtctgagccgtggtttagaagttgtaaacttagaacacccaattgaagtaccagtaggtaaagcaactctgggacgtatcatgaacgttctgggtgaccctattgatatgaaaggtgatatcggcgaagaagagcgctggtctattcaccgttcagcgccaagctatgaagaattagctaactcaacagaactgctagaaaccggtatcaaagtaatggacttaatctgtccattcgcgaaaggtggtaaagttggtctgttcggtggtgcgggtgttggtaaaacagtaaacatgatggaactgatccgtaacatcgcgattgagcactcaggttactcagtattcgctggtgttggtgagcgtacccgtgaaggtaacgacttctatcatgaaatgactgattctaacgttctggataaagtatcactggtttatggccagatgaacgagccaccaggaaaccgtctgcgtgttgcgctgactggtctgactatggctgaaaaattccgtgacgaaggtcgtgacgtactgctgttcgttgacaacatttatcgttatacactggcaggtactgaagtatcagcactgttaggtcgtatgccttcagcggtaggttatcagccaacattggcagaagagatgggtgttctacaagaacgtatcacttctaccaaaaccggttctatcac

SEQ ID NO: 339 - DNA, 819 bp, Providencia stuartii
  ref <308>: DATABASE ACCESSION NUMBER: ATCC 33672
tcaagatgcagtaccaaaagtgtacgatgcgcttgaggttgttaacggtaaagaaaaactggtgctggaagttcagcaacagttaggcggtggtgttgtccgttgtatcgcaatgggtacatcagatggcctaagccgtggtttagaagttaaaaatttagaacacccaattgaagtaccagtaggtaaagcaacactcggacgtatcatgaacgttctgggtgaccctattgatatgaaaggtgatatcggcgaagaagagcgttggtctattcaccgcgctgcaccaagctacgaagagctatcgagctcaactgaactgctagagacaggtatcaaagtcatggacttgatctgtccattcgcgaaaggtggtaaagttggtctgttcggtggtgcgggtgttggtaaaacggtaaacatgatggaacttatccgtaacatcgcgattgagcactcaggttactcagtattcgcaggtgttggtgagcgtacccgtgaaggtaacgacttctatcatgaaatgacagattcaaacgttcttgacaaagtatcactggtttatggtcagatgaatgagccaccaggaaaccgtctacgcgtagcattgactggtttgactatggctgagaaattccgtgacgaaggccgtgatgttctgttgttcgtggataacatctatcgttatacactggcaggtacagaagtatcggctctgttaggtcgtatgccatcagcagtaggttatcagccaacattggcagaagagatgggtgttcttcaagaacgtatcacttctactaagacaggttctatcac

SEQ ID NO: 340 - DNA, 857 bp, Psychrobacter phenylpyruvicus
  ref <308>: DATABASE ACCESSION NUMBER: ATCC 23333
aaccgcactgacgtgcctcaaatttatgacgcgttagttgtagatggtaccgaaaccaccctagaagttcagcagcagctgggcgatggtgtggtacgtactattgcaatgggatctactgaaggtcttaagcgtggtttaccagtaacaaacactggtgccccaattacagttccagtaggtgatgcgactttaggtcgtattatggacgttttaggtcgtccaattgacgaacaaggtccagttaattctgaagaccattggtcaatccaccgtcaagcgccatcatatgatgagcaagctaacagtactgacctattagagacaggtattaaagtaattgacttactttgtccgttcgctaaagggggtaaagttggtctgttcggtggtgccggtgttggtaaaaccgtaaacatgatggaattgattaataacatcgctcttaagcactcaggtttatcagtattcgctggtgtgggtgagcgtactcgtgaaggtaacgacttctaccacgagatgcaagaagcgggtgttgttgacgttgaaaacttcaccaactcaaaagttgcgatggtttatggtcagatgaatgagccaccaggtaaccgtttacgtgttgcgttaaccggtctgactatggctgagtacttccgtgatcaaaaagatgaaaacggtaaaggtaaagacgttctattattcgttgataacatctaccgctacacgctagccggtactgaagtatcagcacttctaggtcgtatgccatcagcagtaggttatcagccaacactagcggaagagatgggtgtactacaagagcgtattacttcaactcagactggttctattacttc

SEQ ID NO: 341 - DNA, 832 bp, Rahnella aquatilis
  DSM 4594
gttccctcaggatgcagtaccgaacgtgtacaatgctcttgaggtagaaaacggtacctccaaactggtgctggaagttcagcaacagttaggcggcggcgttgttcgttgtatcgcaatgggtacctcagacggcctgcgtcgcggtctgaaagtgaacaacctggaacacccaattgaagtaccggtaggtaaagcgactctgggtcgtatcatgaacgtattgggtgaaccaatcgacatgaaaggtgaaatcggcgaagaagaacgtcgtgctattcaccgtgctgcgccttcttatgaagagctggcaaactcccaggaattgctggaaaccggtatcaaagttatggacctgatgtgtccgttcgctaagggcggtaaagttggtctgttcggtggtgcgggtgtaggtaaaactgtgaacatgatggagctgatccgtaacattgcgatcgagcactccggttattctgtgtttgcaggcgtgggtgaacgtactcgtgagggtaacgacttctaccacgaaatgactgattccaacgttatcgacaaagtttccctggtgtatggccagatgaatgagccaccaggtaaccgtctgcgcgttgcactgaccggcctgaccatggcggaaaaattccgtgatgaaggtcgtgacgtactgctgttcgttgacaacatttaccgttacaccctggccggtaccgaagtgtccgcacttctgggccgtatgccatcggcggtaggttatcagccaacgctggcggaagagatgggcgctctgcaagaacgtatcacctcgaccaaaagtggttctatcacctccgta

SEQ ID NO: 342 - DNA, 824 bp, Salmonella choleraesuis subsp. arizonae
  ref <308>: DATABASE ACCESSION NUMBER: ATCC 13314
ttccctcaggatgccgtaccacgcgtgtacgatgctcttgaggtgcagaatggtaatgagaagctggtgctggaagttcagcagcagcttggcggcggtatcgtgcgtaccatcgcgatggggtcttctgacggtctgcgtcgcggtcttgatgtaaaagatctcgaacacccgatcgaagtcccggtaggtaaagccacgctgggtcgtatcatgaacgtcctgggcgaaccggtcgatatgaaaggcgagatcggcgaagaagagcgttgggctattcaccgcgcggcgccgtcctacgaagagttgtcaaactctcaggaactgctggaaaccggtataaaagttatcgacctgatgtgtccgttcgcgaagggcggtaaagtcggtctgttcggtggcgcgggtgtaggtaaaaccgtaaacatgatggagcttatccgtaacatcgcgatcgagcactccggttactctgtgtttgcgggcgtaggtgaacgtactcgtgagggtaacgacttctaccacgaaatgaccgactctaacgttatcgataaagtatccctggtgtatggccagatgaacgagccaccgggaaaccgtctgcgcgttgcattgaccggcctgaccatggcggaaaaattccgtgatgaaggtcgtgacgttctgctgttcgtcgacaacatctaccgttataccctcgccggtacggaagtatccgcactgctgggtcgtatgccttccgcggtaggttaycasccgactctggcggaagagatgggcgttctgcaggaacgtatcacctccaccaaaaccggttctatcac

SEQ ID NO: 343 - DNA, 820 bp, Salmonella choleraesuis subsp. choleraesuis
  ref <308>: DATABASE ACCESSION NUMBER: ATCC 7001
gatgccgtaccacgcgtgtacgatgcccttgaggtgcagaatggtaatgagaagctggtgctggaagttcagcagcagcttggcggcggtatcgtgcgtaccatcgcgatggggtcttctgacggtctgcgtcgcggtctggatgtaaaagatctcgaacacccgatcgaagtcccggtaggtaaagccacgctgggtcgtatcatgaacgtcctgggcgaaccggtcgacatgaaaggcgagatcggcgaagaagagcgttgggcgattcaccgcgcagcaccttcctacgaagagttgtcaaactctcaggaactgctggaaaccggtatcaaagttatcgacctgatgtgtccgttcgcgaagggcggtaaagtcggtctgttcggtggtgcgggtgtaggtaaaaccgtaaacatgatggagcttattcgtaacatcgcgatcgagcactccggttactcagtgtttgcgggcgtaggggaacgtactcgtgagggtaacgacttctaccacgaaatgaccgactccaacgttatcgataaagtatccctggtgtatggccagatgaacgagccgccgggaaaccgtctgcgcgttgcactgaccggcctgaccatggcggagaaattccgtgacgaaggtcgtgatgtactgctgttcgtcgataacatctatcgttacaccctggccggtacggaagtatccgcactgctgggccgtatgccttccgcagtaggttaccagccgactctggcggaagagatgggcgttctgcaggaacgtatcacctccaccaaaaccggttctatcacctccg

SEQ ID NO: 344 - DNA, 831 bp, Salmonella choleraesuis subsp. diarizonae
  ref <308>: DATABASE ACCESSION NUMBER: ATCC 43973
ttccctcaggatgccgtaccacgcgtgtacgatgctcttgaggtgcagaatggtaatgagaagctggtgctggaagttcagcagcagcttggcggcggtatcgtgcgtaccatcgcgatggggtcttctgacggtctgcgtcgcggtcttgatgtaaaagatctcgaacacccgatcgaagtcccggtaggtaaagcaacgctgggtcgtatcatgaacgtcctgggtgaaccggtcgatatgaaaggcgagatcggcgaagaagagcgttgggcgattcaccgcgcggcgccgtcctacgaagagttgtcaaactctcaggaactgctggaaaccggtatcaaagttatcgacctgatgtgtccgttcgcgaagggcggtaaagtcggtctgttcggtggcgcgggtgtaggtaaaaccgtaaacatgatggagcttatccgtaacatcgcgatcgagcactccggttactctgtgtttgcgggcgtaggtgaacgtactcgtgagggtaacgacttctaccacgaaatgaccgactctaacgttatcgataaagtatccctggtgtatggccagatgaacgagccaccgggaaaccgtctgcgcgttgcattgaccggcctgaccatggcggaaaaattccgtgatgaaggtcgtgacgttctgctgttcgtcgacaacatctaccgttataccctcgccggtacggaagtatccgcactgctgggtcgtatgccttccgcggtaggttatcagccgactctggctgaagaaatgggcgttctgcaggaacgtatcacctccaccaaaaccggttctatcacctccgta

SEQ ID NO: 345 - DNA, 831 bp, Salmonella choleraesuis subsp. houtenae
  ref <308>: DATABASE ACCESSION NUMBER: ATCC 43974
ttccctcaggatgccgtaccacgcgtgtacgatgctcttgaggtgcagaatggtaatgagaagctggtgctggaagttcagcagcagcttggcggcggtatcgtacgtaccatcgcgatggggtcttctgacggtctgcgtcgcggtctggatgtaaaagatctcgaacacccgatcgaagtcccggtaggtaaagctacgctgggtcgtatcatgaacgtcctgggcgaaccggtcgatatgaaaggcgagatcggcgaagaagagcgttgggcgattcaccgcgctgcgccgtcctacgaagagttgtcaaactctcaggaactgctggaaaccggtatcaaagttatcgacctgatgtgtccgttcgcgaagggcggtaaagtcggtctgttcggtggcgcgggtgtaggtaaaaccgtaaacatgatggagcttatccgtaacatcgcgatcgagcactccggttactccgtgtttgcgggcgtaggtgaacgtactcgtgagggtaacgacttctaccacgaaatgaccgactccaacgttatcgataaagtatccctggtgtatggtcagatgaacgagccgccgggaaaccgtctgcgcgttgcattgaccggcctgaccatggcggaaaaattccgtgacgaaggtcgtgacgttctgctgttcgtcgataacatctatcgttacaccctggccggtacggaagtatccgcactgctgggtcgtatgccttccgcggtaggttatcagccgacgctggcggaagagatgggcgttctgcaggaacgtatcacctccaccaagaccggttctatcacctccgta

SEQ ID NO: 346 - DNA, 829 bp, Salmonella choleraesuis subsp. indica
  ref <308>: DATABASE ACCESSION NUMBER: ATCC 43974
ttccctcaggatgccgtaccacgcgtgtacgatgcccttgaggtgcagaatggtaatgagaagctcgtgctggaagttcagcagcagcttggcggcggtatcgtgcgtaccatcgcgatggggtcttctgacggtctgcgtcgcggtctggatgtaaaagatctcgaacacccgatcgaagtcccggtaggtaaagccacgctgggtcgtatcatgaacgtcctgggcgaaccggtcgatatgaaaggcgagatcggcgaagaagagcgttgggcgattcaccgcgcggcgccgtcctatgaagagttgtcaaactctcaggaactgctggaaaccggtatcaaagttatcgacctgatgtgtccgttcgcgaagggcggtaaagtcggtctgttcggtggtgcgggcgtaggtaaaaccgtaaacatgatggagcttatccgtaacatcgcgatcgagcactccggttactctgtgtttgcgggcgtaggtgaacgtactcgtgagggtaacgacttctaccacgaaatgaccgactccaacgttatcgacaaagtatccctggtgtatggccagatgaacgagccgccgggaaaccgtctgcgcgttgcactgaccggcctgaccatggcggagaagttccgtgacgaaggtcgtgacgtactgctgttcgtcgataacatctatcgttataccctggccggtacggaagtttccgcactgctgggtcgtatgccttccgcggtaggttatcagccaactctggcggaagagatgggcgttctgcaggaacgtatcacctccaccaaaaccggttctatcacctccg

SEQ ID NO: 347 - DNA, 817 bp, Salmonella choleraesuis subsp. choleraesuis
  ref <308>: DATABASE ACCESSION NUMBER: ATCC 9150
gccgtaccacgcgtgtacgatgcccttgaggtgcagaatggtaatgagaagctggtgctggaagttcagcagcagcttggcggcggtatcgtgcgtaccatcgcgatggggtcttctgacggtctgcgtcgcggtctggatgtaaaagatctcgaacacccgatcgaagtcccggtaggtaaagctacgctgggtcgtatcatgaacgtcctgggcgaaccggtcgacatgaaaggcgagatcggcgaagaagagcgttgggcgattcaccgcgcagcgccttcctacgaagagttgtcaaactctcaggaactgctggaaaccggtatcaaagttatcgacctgatgtgtccgttcgcgaagggcggtaaagtcggtctgttcggtggtgcgggtgtaggtaaaaccgtaaacatgatggagcttatccgtaacatcgcgatcgagcactccggttactctgtgtttgcgggcgtaggtgaacgtactcgtgagggtaacgacttctaccatgaaatgaccgactccaacgttatcgataaagtatccctggtgtatggccagatgaacgagccgccgggaaaccgtctgcgcgttgcactgaccggcctgaccatggcggagaaattccgtgacgaaggtcgtgacgtactgctgttcgtcgataacatctatcgttacaccctggccggtacggaagtatccgcactgctgggtcgtatgccttccgcggtaggttaccagccgactctggcggaagagatgggcgttctgcaggaacgtatcacctccaccaagaccggttctatcacctccg

SEQ ID NO: 348 - DNA, 806 bp, Salmonella choleraesuis subsp. choleraesuis
  ref <308>: DATABASE ACCESSION NUMBER: ATCC 8759
gccgtaccacgcgtgtacgatgcccttgaggtgcagaatggtaatgagaagctggtgctggaagttcagcagcagcttggcggcggtattgtgcgtaccatcgcgatggggtcttctgacggtctgcgtcgcggtctggatgtaaaagatctcgaacacccgatcgaagtcccggtaggtaaagccacgctgggtcgtatcatgaacgtcctgggcgaaccggtcgacatgaaaggcgagatcggcgaagaagagcgttgggcgattcaccgcgcagcgccttcctacgaagagttgtcaaactctcaggaactgctggaaaccggtatcaaagttatcgacctgatgtgtccgttcgcgaagggcggtaaagtcggtctgttcggtggtgcgggtgtgggtaaaaccgtaaacatgatggagcttatccgtaacatcgcgatcgagcactccggttactctgtgtttgcgggcgtaggtgaacgtactcgtgagggtaacgacttctaccacgaaatgaccgactccaacgttatcgataaagtatccctggtgtatggccagatgaacgagccgccgggaaaccgtctgcgcgttgcattgaccggtctgaccatggcggagaaattccgtgacgaaggtcgtgacgtactgctgttcgtcgataacatctatcgttacaccctggccggtacggaagtatccgcactgctgggccgtatgccttccgcagtaggttaccagccgactctggcggaagagatgggcgttctgcaggaacgtatcacctccaccaaaaccggttc

SEQ ID NO: 349 - DNA, 831 bp, Salmonella choleraesuis subsp. salamae
  ref <308>: DATABASE ACCESSION NUMBER: ATCC 43972
ttccctcaggatgccgtaccacgcgtgtacgatgcccttgaggtgcagaatggtaatgagaagctggtgctggaagttcagcagcagcttggcggcggtatcgtgcgtaccatcgcgatggggtcttctgacggtctgcgtcgkggtctggatgtaaaagatctcgaacacccgatcgaagtcccggtaggtaaagcaacgctgggccgtatcatgaacgtactgggcgaaccggtcgacatgaaaggcgagattggtgaagaagagcgttgggctattcaccgtgctgcgccgtcctacgaagagttgtcaaactctcaggaactgctggaaaccggtatcaaagttatcgacctgatgtgtccgttcgcgaagggcggtaaagtcggtctgttcggtggcgcgggtgtaggtaaaaccgtaaacatgatggagctcatccgtaacatcgcgatcgagcactccggttactccgtgtttgcgggcgtaggtgaacgtactcgtgagggtaacgacttctaccacgaaatgaccgactccaacgttatcgataaagtatccctggtgtatggccagatgaacgagccgccgggaaaccgtctgcgcgttgcactgaccggcctgaccatggcggaaaaattccgtgacgaaggtcgtgacgtactgctgttcgtcgataacatctatcgttataccctggccggtacggaagtatccgcactgctgggtcgtatgccttccgcggtaggttatcagccgacgctggcggaagagatgggcgttctgcaggaacgtatcacctccactaaaaccggttctatcacctccgta

SEQ ID NO: 350 - DNA, 823 bp, Salmonella choleraesuis subsp. choleraesuis
  ref <308>: DATABASE ACCESSION NUMBER: ATCC 10749
ttccctcaggatgccgtaccacgcgtgtacgatgcccttgaggtgcagaatggtaatgagaagctggtgctggaagttcagcagcagcttggcggcggtatcgtgcgtaccatcgcgatggggtcttctgacggtctgcgtcgcggtctggatgtaaaagatctcgaacacccgatcgaagtcccggtaggtaaagctacgctgggtcgtatcatgaacgtcctgggcgaaccggtcgacatgaaaggcgagatcggcgaagaagagcgttgggcgattcaccgcgcagcgccttcctacgaagagttatcaaactctcaggaactgctggaaaccggtatcaaagttatcgacctgatgtgtccgttcgcgaagggcggtaaagtcggtctgttcggtggtgcgggtgtaggtaaaaccgtaaacatgatggagcttatccgtaacatcgcgatcgagcactccggttactctgtgtttgcgggcgtaggtgaacgtactcgtgagggtaacgacttctaccatgaaatgaccgactccaacgttatcgataaagtatccctggtgtatggccagatgaacgagccgccgggaaaccgtctgcgcgttgcactgaccggcctgaccatggcggagaaattccgtgacgaaggtcgtgacgtactgctgttcgtcgataacatctatcgttacaccctggccggtacggaagtatccgcactgctgggtcgtatgccttccgcggtaggttaccagccgactctggcggaagagatgggcgttctgcaggaacgtatcacctccaccaagaccggttctatca

SEQ ID NO: 351 - DNA, 823 bp, Salmonella choleraesuis subsp. choleraesuis; identical to SEQ ID NO: 350
  ref <308>: DATABASE ACCESSION NUMBER: ATCC 14028

SEQ ID NO: 352 - DNA, 810 bp, Salmonella choleraesuis subsp. choleraesuis
  ref <308>: DATABASE ACCESSION NUMBER: ATCC 51955
gccgtaccacgcgtgtacgatgcccttgaggtgcagaatggtaatgagaagctggtgctggaagttcagcagcagcttggcggcggtatcgtgcgtaccatcgcgatggggtcttctgacggtctgcgtcgcggtctggatgtaaaagatctcgaacacccgatcgaagtcccggtaggtaaagccacgctgggtcgtatcatgaacgtcctgggcgaaccggtcgacatgaaaggcgagatcggcgaagaagagcgttgggcgattcaccgcgcagcaccttcctacgaagagttgtcaaactctcaggaactgctggaaaccggtatcaaagttatcgacctgatgtgtccgttcgcgaagggcggtaaagtcggtctgttcggtggtgcgggtgtaggtaaaaccgtaaacatgatggagcttattcgtaacatcgcgatcgagcactccggttactctgtgtttgcgggcgtaggggaacgtactcgtgagggtaacgacttctaccacgaaatgaccgactccaacgttatcgataaagtctccctggtgtatggccagatgaacgagccgccgggaaaccgtctgcgcgttgcattgaccggtctgaccatggcggagaaattccgtgacgaaggtcgtgacgtactgctgttcgtcgataacatctatcgttacaccctggccggtacggaagtatccgcactgctgggccgtatgccttccgcagtaggttaccagccgactctggcggaagagatgggcgttctgcaggaacgtatcacctccaccaaaaccggttctatc

SEQ ID NO: 353 - DNA, 820 bp, Serratia ficaria
  ref <308>: DATABASE ACCESSION NUMBER: ATCC 33105
gatgccgtaccaaaagtgtacgatgcccttgaggtagaaaacggtaccgagaaactggtgctggaagttcagcagcagctgggcggtggcgtcgttcgctgtatcgcaatggggacctctgacggtctgcgtcgcggtctgaaagtgaacaacctggaacacccgattgaagtgccggtgggtaaagctaccctgggccgtatcatgaacgtattgggcgaaccaatcgacatgaaaggcgagatcggcgaagaagagcgttgggcgattcaccgtcctgcgccaagctacgaagagctgtccaactcccaggacctgctggaaaccggtatcaaggtaatggacctgatttgtccgttcgccaagggcggtaaagtcggtctgttcggtggtgcgggcgtgggcaaaaccgtaaacatgatggagctgatccgtaacatcgcgatcgagcactccggttattccgtgtttgcgggcgtgggcgagcgtactcgtgagggtaacgacttctaccacgaaatgaacgactccaacgttctggacaaagtatccctggtttacggccagatgaacgagccgccgggtaaccgtctgcgcgttgcattgaccggcctgaccatggcggagaaattccgtgacgaaggccgcgacgttctgctgttcgttgacaacatttaccgttacaccctggccggtaccgaagtgtccgcacttctgggccgtatgccatccgcggtaggttatcagccaacgctggcggaagagatgggcgttctgcaagaacgtatcacctcgaccaagaccggttccatcacctccg

SEQ ID NO: 354 - DNA, 816 bp, Serratia fonticola
  ref <308>: DATABASE ACCESSION NUMBER: ATCC 29844
gatgccgtaccgaaagtgtacaacgctcttgaggttgcaaacggcaccgagaaattggtgctggaagttcagcaacagctgggtggcggcgtggttcgctgtatcgcaatggggacctcagacggtctgcgtcgtggtctggccgtaaccgacctgcagcacccaattgaagtaccggtaggtaaagctaccctgggccgtatcatgaacgtattgggtgaaccaatcgacatgaagggcgacatcggcgaagaagaacgttgggctattcaccgccctgcgccaagctacgaagagctgtccagctcccaggatctgctggaaaccggtatcaaggtaatggacctgatctgcccgttcgccaagggtggtaaagttggtctgttcggtggtgctggtgtaggtaaaaccgtaaacatgatggagctgatccgtaacatcgcgatcgagcactccggttattctgtgtttgcgggcgtgggtgaacgtactcgtgagggtaacgacttctaccacgaaatgaccgattccaacgtactggacaaagtttccctggtttacggccagatgaacgagccaccaggtaaccgtctgcgcgttgcgctgaccggcctgaccatggctgagaagttccgtgacgaaggtcgtgacgtactgctgttcgtcgataacatctaccgttataccctggccggtaccgaagtgtccgcacttctgggccgtatgccatcggcggtaggttatcagccaacgctggcggaagagatgggtgttctgcaagaacgtatcacctctaccaagactggttcaatcacc

SEQ ID NO: 355 - DNA, 822 bp, Serratia grimesii
  ref <308>: DATABASE ACCESSION NUMBER: ATCC 14460
gatgccgtaccaaaagtgtacaacgctcttgaggtagaaaacggtgccaataagctggtgctggaagttcagcaacagttgggcggtggcgtggttcgctgtatcgcaatggggacctctgatggtctgcgtcgcggtctgaaagtcacagacctggaccacccaattgaagtaccggtaggtaaagctactctgggccgtatcatgaacgtattgggtgaaccaatcgacatgaagggcgatatcggcgaagaagaacgttgggcgattcaccgtccggcgccaagctacgaagatttggccaactcccaggatctgctggaaaccggtatcaaggtaatggacctgatctgcccgttcgccaagggtggtaaagtcggtctgttcggtggtgcgggtgttggtaaaaccgtaaacatgatggagctgatccgtaacatcgcgatcgagcactccggttattctgtgtttgcgggcgtgggtgagcgtactcgtgagggtaacgacttctaccacgaaatgaacgactccaacgtactggacaaagtatccctggtttacggccagatgaacgagccaccgggtaaccgtctgcgcgttgctctgaccggtctgaccatggctgagaaattccgtgacgaaggccgtgacgttctgctgttcgttgataacatctaccgttataccctggccggtaccgaagtgtccgcacttctgggccgtatgccatcggcggtaggttatcagccaacgctggcggaagagatgggtgttctgcaagaacgtatcacctctaccaagactggttcaatcacctccgta

SEQ ID NO: 356 - DNA, 819 bp, Serratia liquefaciens
  ref <308>: DATABASE ACCESSION NUMBER: ATCC 27592
atgccgtaccaaaagtgtacaatgctcttgaggtagaaaacggtaccgagaagctggtgctggaagttcagcagcagttgggcggtggcgtagttcgctgtatcgcgatggggacctcagatggtctgcgccgcggtctgaaagtgaacgatctggaacacccaattgaagtaccggtaggtaaagctaccctgggccgtatcatgaacgtattgggtgaaccaatcgacatgaaaggcgacatcggcgaagaagaacgttgggcgattcaccgtccagcgccaagctacgaagatttgtcaaactcccaggatctgctggaaaccggtatcaaggttatggacctgatttgtccgttcgctaagggcggtaaagttggtctgttcggtggtgctggtgttggtaaaaccgtaaacatgatggagctgatccgtaacatcgcgatcgagcactccggttattccgtgtttgcaggcgtgggtgagcgtactcgtgagggtaacgacttctaccacgaaatgaacgactccaacgtactggacaaagtatccctggtttacggccagatgaacgagccaccgggtaaccgtctgcgcgttgctctgaccggtctgaccatggcggagaaattccgtgacgaaggccgcgacgttctgctgttcgttgataacatttaccgttataccctggccggtaccgaagtgtccgcacttctgggccgtatgccatctgcggtaggttatcagccaacgctggcggaagagatgggcgttctgcaagaacgtatcacctctaccaagaccggttctatcacttccg

SEQ ID NO: 357 - DNA, 805 bp, Serratia marcescens
  ref <308>: DATABASE ACCESSION NUMBER: ATCC 13880
tcaggatgccgtaccgaaagtgtacgacgcccttgaggtagaaaacggcaccgaaaaactggtgttggaagttcagcaacagctgggcggtggcgtggttcgctgtatcgcaatggggacctccgacggtctgcgtcgcggtctgaaagtgaacaacctggaccacccgattgaagtgccggtgggtaaagctaccctgggtcgtatcatgaacgtattgggtcaaccgatcgacatgaaaggcgacatcggcgaagaagagcgttgggcgattcaccgcgcggcgccaagctacgaagagctgtcaagctctcaggaactgctggaaaccggtatcaaggtaatggacctgatttgtccgttcgccaagggcggtaaagtcggtctgttcggcggtgcgggcgtaggtaaaaccgtaaacatgatggagctgatccgtaacatcgcgatcgagcactccggttattccgtgtttgcgggcgtgggcgagcgtactcgtgagggtaacgacttctaccacgaaatgaccgactccaacgttctggacaaagtatccctggtttacggccagatgaacgagccaccaggtaaccgtctgcgcgttgcgctgaccggtctgaccatggcggagaaattccgtgacgaaggccgtgacgttctgctgttcgttgacaacatctaccgttacaccctggccggtaccgaagtgtccgcacttctgggccgtatgccatccgcggtaggttatcagccaacgctggcggaagagatgggcgttctgcaagaacgtatcacctcgaccaag

SEQ ID NO: 358 - DNA, 822 bp, Serratia odorifera
  ref <308>: DATABASE ACCESSION NUMBER: ATCC 33077
gatgccgtaccaaaagtgtacgatgcccttgaggtagaaaacggtaccgaaactctggtgctggaagttcagcagcagctgggcggtggcgtggttcgttgtatcgctatgggcacctccgacggtttgcgtcgcggcctgaaagtgaacgatctgcaacacccaatcgaagtcccggttggcaaggcaacgctgggtcgtatcatgaacgtattgggtcaaccaatcgacatgaaaggcgacatcggcgaagaagagcgttgggcgattcaccgcgcggcgccaagctacgaagaactgtccaactcccaggatctgctggaaaccggtatcaaggttatggacctgatctgcccgtttgccaagggtggtaaagtcggtctgttcggtggtgcgggtgttggtaaaaccgtaaacatgatggagctgatccgtaacatcgcgatcgagcactccggttattcagtgtttgcgggcgtgggtgagcgtactcgtgagggtaacgacttctaccacgaaatgaccgactccaacgtactggacaaggtttccctggtttacggccagatgaacgagccaccgggtaaccgtctgcgcgttgcgctgaccggtctgaccatggccgagaaattccgtgacgaaggtcgtgacgttctgctgttcgttgacaacatttaccgttacaccctggccggtaccgaagtgtctgcacttctgggccgtatgccatcggcggtaggttatcagccaacgctggcggaagagatgggcgttctgcaagaacgtatcacctcgaccaagaccggttctatcacctccgta

SEQ ID NO: 359 - DNA, 805 bp, Serratia plymuthica
  ref <308>: DATABASE ACCESSION NUMBER: ATCC 183
gtgtacaacgctcttgaggtagaaaacggtgccaataagctggtgctggaagttcagcaacagctgggcggtggcgtggttcgctgtatcgcgatggggacctctgatggtctgcgtcgcggtctgaaagtgatcgacctggatcacccgattgaagtaccggtaggtaaagctaccctgggccgtatcatgaacgtattgggtgaaccaatcgacatgaaaggcgacatcggcgaagaagaacgttgggcaattcaccgtccagcgccaagctacgaagatttggccaactcccaggatctgctggaaaccggtatcaaggttatggacctgatctgtccgttcgctaagggcggtaaagtgggtctgttcggcggtgcgggcgtgggtaaaaccgtaaacatgatggagctgatccgtaacatcgcgatcgaacactccggttattccgtgtttgcgggcgtgggtgagcgtactcgtgagggtaacgacttctaccacgaaatgaacgactccaacgtactggacaaagtatccctggtttacggccagatgaacgagccaccgggtaaccgtctgcgcgttgctctgaccggtctgaccatggcggagaaattccgtgacgaaggccgcgacgttctgctgttcgttgataacatctaccgttataccctggccggtaccgaagtgtccgcacttctgggccgtatgccatctgcggtaggttatcagccaacgctggcggaagagatgggcgttctgcaagaacgtatcacctctaccaagaccggttctatcacctccg

SEQ ID NO: 360 - DNA, 831 bp, Serratia rubidaea
  ref <308>: DATABASE ACCESSION NUMBER: ATCC 27593
ttccctcaggatgccgtaccaaaagtgtacgatgcccttgaggtagagaacggtaacgaaaaactggtgctggaagttcagcagcagctgggcggcggcgttgtacgctgtatcgccatgggtacttccgacggtctgcgtcgcggtctgaaagttaacgacctcgagcacccaatcgaagtgccagttggtaaagcaacgctgggtcgtatcatgaacgtattgggtcagccaatcgacatgaaaggcgacatcggcgaagaagagcgttgggcgattcaccgcgcggcgccaagctacgaagagctgtccagctcccaagagctgctggaaaccggtatcaaggtaatggacctgatctgcccgttcgccaagggtggtaaagttggtctgttcggtggtgcgggcgtaggtaaaaccgtaaacatgatggagctgatccgtaacatcgcgatcgagcactccggttactctgtgtttgcgggcgtgggtgagcgtactcgtgagggtaacgacttctaccacgaaatgaccgactccaacgtactggacaaagtatccctggtttacggccagatgaacgagccgccgggtaaccgtctgcgcgttgcactgaccggcctgaccatggcggaaaaattccgtgatgaaggccgcgacgttctgctgttcgtggataacatctaccgttacaccctggccggtaccgaagtgtccgcactgctcggccgtatgccatctgcggtaggttatcagccaacgctggcggaagagatgggcgttctgcaagaacgtatcacctcgaccaagaccggttcaatcacctccgta

SEQ ID NO: 361 - DNA, 831 bp, Pseudomonas putida
  strain LCDC7172
ttccctcaggatgccgtaccgcgcgtgtacgatgctcttgaggtgcaaaatggtaatgagcgtctggtgctggaagttcagcagcagctcggcggcggtatcgtgcgtaccatcgcaatgggttcctccgacggtctgcgtcgcggtctggatgtaaaagacctcgaacacccgatcgaagtcccggtaggtaaagcgactctgggccgtatcatgaacgtactgggtgaaccggtcgacatgaaaggcgagatcggtgaagaagagcgttgggcgattcaccgcgcagcaccttcctacgaagagctgtcaaactctcaggaactgctggaaaccggtatcaaagttatcgacctgatgtgtccgttcgctaagggcggtaaagttggtctgttcggtggtgcgggtgtaggtaaaaccgtaaacatgatggagctcattcgtaacatcgcgatcgagcactccggttactctgtgtttgcgggcgtaggtgaacgtactcgtgagggtaacgacttctaccacgaaatgaccgactccaacgttatcgacaaagtatccctggtgtatggccagatgaacgagccgccgggaaaccgtctgcgcgttgctctgaccggtctgaccatggctgagaaattccgtgacgaaggtcgtgacgttctgctgttcgttgacaacatctatcgttacaccctggccggtacggaagtatccgcactgctgggccgtatgccttcagcggtaggttatcagccgaccctggcggaagagatgggcgttctgcaggaacgtatcacctccaccaaaactggttctatcacctccgta

SEQ ID NO: 362 - DNA, 831 bp, Shigella boydii; identical to SEQ ID NO: 361
  ref <308>: DATABASE ACCESSION NUMBER: ATCC 9207

SEQ ID NO: 363 - DNA, 802 bp, Shigella dysenteriae
  ref <308>: DATABASE ACCESSION NUMBER: ATCC 11835
gccgtaccgcgcgtgtacgatgctcttgcggtgcaaaatggtaatgagcgtctggtgctggaagttcagcagcagctcggcggcggtatcgtgcgtaccatcgcaatgggttcctccgacggtctgcgtcgcggtctggatgtaaaagacctcgaacacccgatcgaagtcccggtaggtaaagcgactctgggccgtatcatgaacgtactgggtgaaccggtcgacatgaaaggcgagatcggtgaagaagagcgttgggctattcaccgcgcagcaccttcctacgaagagctgtcaaactctcaggaactgctggaaaccggtatcaaagttatcgacctgatgtgtccgttcgctaagggcggtaaagttggtctgttcggtggtgcgggtgtaggtaaaaccgtaaacatgatggagctcattcgtaacatcgcgatcgagcactccggttactctgtgtttgcgggcgtaggtgaacgtactcgtgagggtaacgacttctaccacgaaatgaccgactccaacgttatcgacaaagtatccctggtgtatggccagatgaacgagccgccgggaaaccgtctgcgcgttgctctgaccggtctgaccatggctgagaaattccgtgacgaaggtcgtgacgttctgctgttcgttgacaacatctatcgttacaccctggccggtacggaagtatccgcactgctgggccgtatgccttcagcggtaggttatcagccgaccctggcggaagagatgggcgttctgcaggaacgtatcacctccaccaaaaccg

SEQ ID NO: 364 - DNA, 819 bp, Shigella flexneri
  ref <308>: DATABASE ACCESSION NUMBER: ATCC 12022
atgccgtaccgcgcgtgtacgatgctcttgaggtgcaaaatggtaatgagcgtctggtgctggaagttcagcagcagctcggcggcggtatcgtgcgtaccatcgcaatgggttcctccgacggtctgcgtcgcggtctggatgtaaaagacctcgaacacccgatcgaagtcccggtaggtaaagcgactctgggccgtatcatgaacgtactgggtgaaccggtcgacatgaaaggcgagatcggtgaagaagagcgttgggcgattcaccgcgcagcaccttcctacgaagagctgtcaaactctcaggaactgctggaaaccggtatcaaagttatcgacctgatgtgtccgttcgctaagggcggtaaagttggtctgttcggtggtgcgggtgtaggtaaaaccgtaaacatgatggagctcattcgtaacatcgcgatcgagcactccggttactctgtgtttgcgggcgtaggtgaacgtactcgtgagggtaacgacttctaccacgaaatgaccgactccaacgttatcgacaaagtatccctggtgtatggccagatgaacgagccgccgggaaaccgtctgcgcgttgctctgaccggtctgaccatggctgagaaattccgtgacgaaggtcgtgacgttctgctgttcgttgacaacatctatcgttacaccctggccggtacggaagtatccgcactgctgggccgtatgccttcagcggtaggttatcagccgaccctggcggaagagatgggcgttctgcaggaacgtatcacctccaccaaaactggttctatcacctccg

SEQ ID NO: 365 - DNA, 802 bp, Shigella sonnei
  ref <308>: DATABASE ACCESSION NUMBER: ATCC 29930
gtaccgcgcgtgtacgatgctcttgaggtgcaaaatggtaatgagcgtctggtgctggaagttcagcagcagctcggcggcggtatcgtgcgtaccatcgcaatgggttcctccgacggtctgcgtcgcggtctggatgtaaaagacctcgaacacccgatcgaagtcccggtaggtaaagcgactctgggccgtatcatgaacgtactgggtgaaccggtcgacatgaaaggcgagatcggtgaagaagagcgttgggcgattcaccgcgcagcaccttcctacgaagagctgtcaaactctcaggaactgctggaaaccggtatcaaagttatcgacctgatgtgtccgttcgctaagggcggtaaagttggtctgttcggtggtgcgggtgtaggtaaaaccgtaaacatgatggagctcattcgtaacatcgcgatcgagcactccggttactctgtgtttgcgggcgtaggtgaacgtactcgtgagggtaacgacttctaccacgaaatgaccgactccaacgttatcgacaaagtatccctggtgtatggccagatgaacgagccgccgggaaaccgtctgcgcgttgctctgaccggtctgaccatggctgagaaattccgtgacgaaggtcgtgacgttctgctgttcgttgacaacatctatcgttacaccctggccggtacggaagtatccgcactgctgggccgtatgccttcagcggtaggttatcagccgaccctggcggaagagatgggcgttctgcaggaacgtatcacctccaccaaaactggtt

SEQ ID NO: 366 - DNA, 785 bp, Staphylococcus aureus
taacgccttggttattgatgtgcctaaagaagaaggtacaatacaactaacattagaagttgcgctgcaattaggtgacgacgttgttcgtacaattgcgatggattcaactgatggtgtccaaagaggcatggatgtaaaagatacaggcaaagaaattagtgtacctgttggtgatgaaacattaggtcgtgtatttaatgtactaggtgaaacaattgaccttaaagaagaaattagtgattctgttcgccgcgatcctatccatcgtcaagcaccagcattcgatgaactttcaacagaagttcaaattttagaaacaggtattaaagtagtagatttactagcaccttatattaaaggtggtaaaatcggattgttcggtggtgccggtgtaggtaaaacagtattaatccaagaattaattaacaacatcgctcaagagcacggtggtatttctgtattcgccggtgtaggtgaacgtactcgtgaaggtaacgatttatacttcgaaatgagtgatagtggtgtaattaagaaaacagccatggtattcgggcaaatgaatgagccacctggtgcacgtatgcgtgttgcattatctggtttaacaatggctgaatatttccgtgacgaacaaggtcaagacgtattattattcatcgataacattttcagatttacacaagctggttctgaggtatctgcattattaggtcgtatgccttctgcagtaggttaccaaccaacacttgctactgaaatgggacaattacaagaacgta

SEQ ID NO: 367 - DNA, 843 bp, Staphylococcus auricularis
  ref <308>: DATABASE ACCESSION NUMBER: ATCC 33753
gaacataacgaagtgcctaatattaataacgccttagtactcgatgttgaaagagaagacggaacagtgtctttaactttagaagtagctttacaattaggcgatgacgttgttcgtaccattgcaatggattcaactgatggtgttaaacgtggtaacgaagtcaaagatactggtaatagcattagcgtaccagtcggagacgaaactttaggacgtgtcttcaacgttctaggtgaaacaattgatttagaagataaacttgatgattctgcgcgacgtgaccctatacatagagaagcgccagcgtttgatcaattatcaactcaagttgaaattttagaaacaggaattaaagttgttgacttattagcaccttatattaaaggtggtaaagttggactcttcggtggtgccggtgttggtaaaaccgttttaatccaagaattaatcaacaacatcgctcaagaacacggtggtatttcagtctttgccggtgtaggtgaacgtacacgtgaaggtaacgacttgtactatgaaatgagcgacagtggtgtaatcaagaaaacagccatggtcttcggacaaatgaacgaaccacctggcgcacgtatgcgtgttgctttatctggtttaacaatggctgaatatttccgtgatgaacaaggacaagacgtattgttattcatcgacaatattttccgtttcacacaagccggttcagaagtttctgccttactaggtcgtttaccatcagccgttggttatcaacctacattagcaacagaaatgggacaattacaagaacgtattacttcaacaacaaaaggatcagttacttca

SEQ ID NO: 368 - DNA, 849 bp, Staphylococcus capitis subsp. capitis
  ref <308>: DATABASE ACCESSION NUMBER: ATCC 27840
gctttgaacataatgaagttcctgatattaacaatgccttacacatcgaagttcctaaagaagatagcacacttcatttaactttagaagttgcacttcaattaggtgacgatgtagtacgtacaatcgcaatggactcaactgacggcgttcaaagaggtatggaagttaaagatacaggtaaagatattagcgtacctgttggtgatgcaactttaggaagagtatttaacgtattaggagaaacaatcgatttagatgaaaagattgatgattcagtacgtcgtgatcctattcatagacaggcacctggcttcgatgaattatctactaaagtagaaatcttagaaacaggtatcaaagtagtagacttattagcaccttacattaaaggtggtaaaattggattattcggtggtgccggtgttggtaagacagttttaatccaagaacttatcaataatatcgctcaagagcatggtggtatttcagtattcgccggtgttggtgaacgtacacgtgaaggtaacgacctttactatgaaatgagcgatagtggtgtaattaagaaaacagcgatggtattcggtcagatgaacgagccacctggtgctcgtatgcgtgttgcattatcaggtttaacaatggcagaatatttccgtgatgaagaaggccaagacgtattattattcattgataatatcttcagattcacacaagctggttctgaagtttcagcattacttggacgtatgccttcagccgttggttatcaaccaacacttgctactgaaatgggtcaattacaagaacgtattagttcaactaataaaggttctgttacttcaa

SEQ ID NO: 369 - DNA, 830 bp, Staphylococcus cohnii
  DSM 20260
gaagttccagaaattaataatgccttagttctcgatatagaaagagaagaaggtactgttgaattaacgttagaagttgcattacaacttggtgatgacgtagtacgaacaatcgcaatggattcaactgatggtgttaaacgtggtacagaagttagagatagcggaaatagtatcagcgtaccagttggtaatgaaacattaggtagagtatttaatgtattaggtgatacgatagatttagatgaagacatagatgactcagtgcgtcgtgacccaattcatagagaagcacctgcatttgatcagttatctactaaagttgaaattttagaaacaggtatcaaagtcattgatttattagcaccatatatcaaaggtggtaaagttggattattcggtggtgccggtgttggtaaaactgtattaattcaagaattaatcaataatatcgctcaagagcatggtggtatatccgtatttgctggtgtaggtgagcgtacgcgtgaaggtaatgacctatactttgaaatgagtgatagtggtgttattaaaaagacagctatggtatttggacaaatgaacgaaccacctggtgcgcgtatgcgagtagcactttctggtttaacaatggctgaatatttccgggatgaacaaggacaagatgttctattattcatagataacatctttagatttactcaagctggttcagaagtttctgcgttattaggtcgtatgccttcagctgttggttaccaaccaacgttagcaactgaaatgggacaattacaagaacgtattacttctacaactaaaggttcagtaac

SEQ ID NO: 370 - DNA, 787 bp, Staphylococcus epidermidis
  ref <308>: DATABASE ACCESSION NUMBER: ATCC 14990
aataatgcattacacatcgaagttcctaaagaagatggagcgcttcaattaacattagaagttgcacttcaactaggtgacgatgtagttcgtacaattgcaatggactcaactgacggcgttcaaagaggaatggaagttaaagatacaggtagagacataagtgtacctgtcggtgacgtaactctaggaagagtgtttaacgtactaggagaaactattgacttagatgaaaaaattgatgattcagtacgacgtgaccctatccatagacaagctccaggattcgacgaattatcaacaaaagtagaaatcttagaaactggtattaaagtagtagacttattagcaccttacataaaaggtggtaaaattggattatttggtggtgccggtgtaggtaaaaccgtactaatccaagaacttattaataacatcgctcaagaacacggtggtatctcagtattcgctggtgttggtgaacgtacacgtgaaggtaatgatctttactatgaaatgagtgacagtggtgttatcaagaaaactgcaatggtctttggtcaaatgaatgagccacctggtgcacgtatgcgtgtagcattatccggattaacaatggccgaatatttccgagatgaagaaggccaagatgtgttattattcattgataacattttcagattcactcaagctggttcagaagtttctgcgttattaggtcgtatgccatcagctgttggttatcaacctacacttgctacagaaatgggtcaattacaagaacgta

SEQ ID NO: 371 - DNA, 830 bp, Staphylococcus haemolyticus
  ref <308>: DATABASE ACCESSION NUMBER: ATCC 29970
gaagtacctgaaattaataacgccttaatcatcgaagttcccaaagaagatggtacttttgaattaacgcttgaagttgcattacaactaggtgatgacgttgttcgtacaattgctatggattcaacagatggtgttcaacgtggtatggaagttcagaacactggaaaagacatttcagtaccagttggcgaagtaactttaggacgtgtatttaacgtattaggtgacacaattgatttagaagataaattagatggttcagtaagacgtgatccaattcatagacaatcacctaactttgacgaattatctactgaagtagaaattcttgaaactggaatcaaagttgtagacttattagcaccatacatcaaaggtggtaaaatcggtctatttggtggtgccggtgttggtaaaaccgttttaatccaagaattgattaataatatcgcacaagaacatggtggtatctcagtatttgctggtgtaggtgaacgtacacgtgaaggtaacgacctatattatgaaatgagagatagtggtgttattaagaaaacagcaatggtatttggtcaaatgaacgagccacctggtgcacgtatgcgtgtggcactttctgcattgacaatggctgagtatttccgtgatgaacaaggacaagacgttctgttattcatcgataacattttcagatttactcaagcaggttcagaagtatcagcattattgggacgtatgccttcagctgtaggttatcaacctactttagctacagaaatgggtcaattacaagaacgtattacatcaacgaataaaggttcagtaac

SEQ ID NO: 372 - DNA, 846 bp, Staphylococcus hominis subsp. hominis
  ref <308>: DATABASE ACCESSION NUMBER: ATCC 27844
tcgaacataatgaagtccctgaaattaataatgccctaattattgaagtacccaaaaatgatggcacatttaaattaacattagaagttgcattgcaactaggtgatgatgttgttcgtactattgcaatggattcaactgatggtgttcaacgtggtatgcaagttgtgaatactggtaaagatattagtgttcctgtaggtgaagaaacacttggacgtgtgtttaacgttttaggagaaacaatagatttaaacgaaaaaatagatagttctgttagacgtgatccaattcatcgtcgtcaacctaattttgatgaattatctactgaagtagaaattcttgaaacaggtattaaagttgtagacttattagcaccttatattaaaggtggtaagattggtttattcggtggtgccggcgtaggtaaaactgtattaattcaagaattaatcaataatatcgctcaagaacatggtggtatttctgtattcgctggtgtaggtgaacgtactcgtgaaggtaacgatttatactatgaaatgagcgatagtggcgttatcaataaaacagccatggtatttgggcaaatgaatgagccgccaggtgcgcgtatgcgtgttgctttatcagcattgacaatggctgaatatttccgtgatgaacaaggtcaagatgtacttttattcattgacaatattttccgctttactcaagctggttctgaagtttcagcattattaggacgtatgccttcagctgtaggttatcaacctacattagcaactgaaatgggtcaattacaagaacgtattacatctactaataaaggttcagtcacttcaa

SEQ ID NO: 373 - DNA, 846 bp, Staphylococcus hominis
  strain CSG 175
tcgaacataatgaagtccctgaaattaataatgccctaattattgaagtacccaaaaatgatggcacattcaaattaacattagaagttgcattgcaactaggtgatgatgttgttcgtactattgcaatggattcaactgatggtgttcaacgtggtatgcaagttgtgaatactggtaaagatattagtgttcctgtaggtgaagaaacacttggacgtgtgtttaacgttttaggagaaacaatagatttaaacgaaaaaatagatagttctgttagacgtgatccaattcatcgtcgtcaacctaattttgatgaattatctactgaagtagaaattcttgaaacaggtattaaagttgtagacttattagcaccttatattaaaggtggtaagattggtttattcggtggtgccggcgtaggtaaaactgtattaattcaagaattaatcaataatatcgctcaagaacatggtggtatttctgtattcgctggtgtaggtgaacgtactcgtgaaggtaacgatttatactatgaaatgagcgatagtggcgttatcaataaaacagccatggtatttgggcaaatgaatgagccgccaggtgcgcgtatgcgtgttgctttatcagcattgacaatggctgaatatttccgtgatgaacaaggtcaagatgtacttttattcattgacaatattttccgctttactcaagctggttctgaagtttcagcattattaggacgtatgccttcagctgtaggttatcaacctacattagcaactgaaatgggtcaattacaagaacgtattacatctactaataaaggttcagtcacttcaa

SEQ ID NO: 374 - DNA, 835 bp, Staphylococcus lugdunensis
  ref <308>: DATABASE ACCESSION NUMBER: ATCC 43809
ataatgaagtgcctgaaataaataatgcgctcattgttgaaattcctaaaagtgatacaacaatcagtttaacacttgaagttgctttgcaattaggtgacgatgttgtacgtactattgcaatggattcaactgatggcgttcaacgtggtatggaagttcaaaacacaggtaaagacatcagtgtacctgttggagatgaaacattaggaagagtatttaacgttttaggagaatctattgatttagaagaaaagctagatgactctgtgcgtagagatccaattcatagactagcacctaaatttgatgaattatctacagaagtagaaattcttgaaactggtattaaagttgttgatttattagcaccatatattaaaggtggtaaagttggattgtttggtggtgccggagtaggtaaaacggtattaattcaagaattaatcaacaatattgctcaagaacatggtggtatttctgtgtttgccggagtaggtgaacgtacacgtgaaggtaatgacttatattatgaaatgagcgatagtggcgtaattaagaaaacagcgatggtatttggccaaatgaatgaaccacctggtgcacgtatgagagttgcgttatctgccttaacaatggctgaatatttccgtgacgagcaaggacaagacgtattgctgtttatcgataatatattccgttttacacaagcaggttcagaagtatctgcattacttggacgtatgccatctgccgttggttatcaaccaacattggctacagaaatgggacaattgcaagaaagaattacatctacaaataaaggttctgtaac

SEQ ID NO: 375 - DNA, 842 bp, Staphylococcus saprophyticus
  ref <308>: DATABASE ACCESSION NUMBER: ATCC 15305
gagcacaatgaagttccagaaattaacaatgccttagtcgtagacgttgaaagagatgaaggtacagtatctcttacattagaagtggcattacaacttggcgatgatgtcgtacgtacaattgcaatggattctactgatggtgttaaacgtggtacagaagttcgagatagcggagatagcatcagtgttccagttggtgatgctacgttaggacgtgtgtttaatgttcttggtgatacaattgacttagacgagaagcttgatacttctgtcaaacgtgatccaattcatagagaagcacctgcattcgatcaattatcaacaaaagttgaaatcttagaaacaggtattaaagtaattgatttacttgcaccatatattaaaggtggtaaaatcggtttattcggtggcgctggtgtaggtaaaacagtattaattcaagaattaattaataatatagctcaagaacatggtggtatttcagtatttgccggcgtaggtgaacgtacgcgtgaaggtaatgacttatactacgaaatgagtgatagtggtgttattaagaaaacagctatggtcttcggacaaatgaatgagccacctggtgcgcgtatgcgtgttgctttatcaggcttaacaatggctgaacacttccgtgatgtacaaggacaagatgttttactatttattgataacatattcagatttacgcaagctggttcagaagtatcagcactattaggtcgtatgccatcagccgttggttatcaacctacccttgctactgaaatgggtcaattacaagaacgtattacatcaacaactaaaggatctgtaacgtc

SEQ ID NO: 376 - DNA, 842 bp, Staphylococcus simulans
  ref <308>: DATABASE ACCESSION NUMBER: ATCC 27848
tgatgaactgcctaagattaataacgcattagtgctagatgtacctaagaaagatggcacgactgaatctcttacattagaagtagcacttgaattaggcgacgacgtagttagaactatcgccatggactctacagacggaattaaacgtggtgacgacgttaaagacactggtcgtccaatcagtgtacctgtcggtgaagatacgttaggaagagtatttaacgttttaggtgatccaatcgataatgatggaccgatttctgaatcagttccacgtgaaccaattcatagacaaccacctaaatttgatgaattatcaacaaaagttgaactacttgaaactggtatcaaagtagtagacttattagcaccatatatcaaaggtggtaaagttggtttattcggtggtgccggagtaggtaaaactgtattaatccaagaattaattaataacatcgctcaagaacacggcggtatttcagtattcgcaggtgttggtgaacgtacacgtgaaggtaacgacttgtacttcgaaatgagcgacagtggtgttatcaagaaaacagcgatggtattcggacaaatgaacgaaccacctggtgcacgtatgcgtgtagctttatcaggtttaacaatggctgaatacttccgtgatgttaaaggacaagacgttcttttattcatcgataacattttccgcttcacacaagcaggttctgaggtatcagcattgcttggccgtatgccatcagccgttggttaccaaccaacattggcaacagaaatgggtcaattacaagaacgtatcacttctacaatgaaaggttctatcacatcta

SEQ ID NO: 377 - DNA, 841 bp, Staphylococcus warneri
  ref <308>: DATABASE ACCESSION NUMBER: ATCC 27836
cataacgaagtccctgatattaataatgcccttattattgaagttccaaaagaagatggaacgttaaacttaacattagaagttgcactacaattaggtgatgatgttgtacgtacaattgcaatggattcaactgatggtgttcaaagaggcatggatgttaaagacacaggtaaagatattagtgtacctgtaggcgatgaaacgcttggaagagtgtttaatgtactaggtgaaacaattgacttggaagagaaaattgatgattccgtacgtcgtgatccaatccatagacaatcaccaggtttcgatgaattatctactgaagtagaaatcttagaaacaggtattaaagtagtagacttattagcaccttacattaaaggtggtaaagttggactattcggtggtgccggagtaggtaaaaccgttttaatccaagaattaattaacaatattgcacaagaacatggtggtatttcagtattcgcgggtgtaggtgaacgtactcgtgaaggtaatgatttatactatgaaatgagtgatagtggtgtaattaagaaaacagcgatggtatttggacaaatgaatgaaccacctggcgcacgtatgcgtgtagctttatctggtttaactatggctgaatacttccgtgatgaacaaggacaagacgtacttttattcatcgataatattttcagatttacacaagctggttctgaagtttctgcattacttggtcgtatgccttcagccgttggttaccaaccaacattagcaactgaaatgggtcaattacaagaacgaattacatctacaaataaaggttctgtaacatcta

SEQ ID NO: 378 - DNA, 846 bp, Streptococcus acidominimus
  ref <308>: DATABASE ACCESSION NUMBER: ATCC 51726
tttaacacgaatgaaccgcttcctgagataaataatgcacttgttgtttacaaagacagtgagaaaaaacataaaatcgttcttgaagtagctcttgaacttggtgaaggcctcgttcgtaccattgctatggaatcaactgatggtttgacacgtggtctagaagttcttgatacaggccgtgcaatcagtgtaccagttggtaaagaaacgcttggacgtgtcttcaacgttcttggtgatgctatcgatcttgaagaaccatttggagaagatgcagaacgtcaccccattcataagagtgccccaacttttgatgaattatcaacgtcaacagaaatccttgaaacagggattaaagttatcgacctacttgccccttacttaaaaggagggaaggttggacttttcggtggtgccggagttggtaagaccgttcttatccaagagttgattcataacattgctcaagagcatggtggtatttcagtatttaccggagttggtgaacgtacacgtgaaggtaatgacctctattgggaaatgaaagaatcaggcgttattgaaaaaacagctatggtatttggtcagatgaatgagccacctggtgcacgtatgcgtgtagcccttactggtttgacaatcgctgaatatttccgtgatgttgaaggacaggacgtgcttctctttattgataacatttttcgtttcacacaagcaggttctgaagtttcagctcttcttggacgtatgccatcagccgttggttatcaaccaaccttggcaactgaaatgggtcaattgcaagaacgtatcacgtcaactaaaaaaggttctgttacatca

SEQ ID NO: 379 - DNA, 846 bp, Streptococcus agalactiae
  ref <308>: DATABASE ACCESSION NUMBER: ATCC 12403
ttgcaagtggcgacaaacttcctgagattaataatgcattgattgtctataaaaatggcgataagtcacaaaaagtagtacttgaagttactcttgaacttggtgacggcctcgttcgtacaatcgctatggaatcaactgatgggcttacacgtggtttggaagtattagatactggtcgcgcaattagtgtgccggttggtaaggatactttgggtcgtgtcttcaacgttcttggagatgctattgaccttgaagagccttttgcagaagatgcagaacgtcaaccaatccataaaaaagcaccatcgtttgatgaattatcaacatcatcagaaatcttagaaacaggtattaaagttattgacttattagcaccttacttaaaaggtggtaaagttggacttttcggtggtgcaggtgttggtaaaaccgttcttattcaagaattaatccacaacatcgcccaagaacatggtggtatttcagtatttactggtgtaggagaacgtactcgtgaagggaatgacctttattgggaaatgaaagaatctggcgttattgaaaaaacggctatggtctttggtcaaatgaatgaaccaccaggagcacgtatgcgtgtggcacttactggtcttacaatagctgagtacttccgtgatgtagaaggacaagatgtgcttctcttcattgataatatcttccgtttcacacaagctgggtcagaagtgtcagcgcttttaggtcgtatgccttcagccgttggttatcaaccaacacttgctacagaaatgggacaattacaagagcgtatcacttcaactaaaaaaggttctgttacctcaa

SEQ ID NO: 380 - DNA, 846 bp, Streptococcus agalactiae
  ref <308>: DATABASE ACCESSION NUMBER: ATCC 13813
ttgcaagtggcgacaaacttcctgagattaataatgcattgattgtctataaaaatggcgataagtcacaaaaagtagtacttgaagttgctcttgaacttggtgacggcctcgttcgtacaatcgctatggaatcaactgatgggcttacacgtggtttggaagtattagatactggtcgcgcaattagtgtgccggttggtaaggatactttgggtcgtgtcttcaacgttcttggagatgctattgatcttgaagagccttttgcagaagatgcagaacgtcaaccaatccataaaaaagcaccatcgtttgatgaattatcaacatcatcagaaatcttagaaactggtattaaagttattgacttattagcaccttacttaaaaggtggtaaagttggacttttcggtggtgcgggtgttggtaaaaccgttcttattcaagaattaatccacaacatcgcccaagaacatggtggtatttcagtatttactggtgtaggagaacgtactcgtgaagggaatgacctttattgggaaatgaaagaatctggcgttattgaaaaaacggctatggtctttggtcaaatgaatgaaccaccaggagcacgtatgcgtgtggcacttactggtcttacaatagctgagtacttccgtgatgtagaaggacaagatgtgcttctcttcattgataatatcttccgtttcacacaagctgggtcagaagtgtcagcgcttttaggtcgtatgccttcagccgttggttatcaaccaacacttgctacagaaatgggacaattacaagagcgtatcacttcaactaaaaaaggttctgttacctcaa

SEQ ID NO: 381 - DNA, 845 bp, Streptococcus agalactiae
  ref <308>: DATABASE ACCESSION NUMBER: ATCC 12973
ttgcaagtggcgacaaacttcctgagattaataatgcattgattgtctataaaaatggcgataagtcacaaaaagtagtacttgaagttgctcttgaacttggtgacggcctcgttcgtacaatcgctatggaatcaactgatgggcttacacgtggtttggaagtattagatactggtcgtgcaattagtgtgccggttggtaaggatactttgggtcgtgtcttcaacgttcttggagatgctattgaccttgaagagccttttgcagaagatgcagaacgtcaaccaatccataaaaaagcaccatcatttgatgaattatcaacatcatcagaaatcttagaaacaggtattaaagttattgacttattagcaccttacttaaaaggtggtaaagttggacttttcggtggtgcgggtgttggtaaaaccgttcttattcaagaattaatccacaacatcgcccaagaacatggtggtatttcagtatttactggtgtaggagaacgtactcgtgaagggaatgacctttattgggaaatgaaagaatctggcgttattgaaaaaacggctatggtctttggtcaaatgaatgaaccaccaggagcacgtatgcgtgtggcacttactggtcttacaatagctgagtacttccgtgatgtagaaggacaagatgtgcttctcttcattgataatatcttccgtttcacacaagctgggtcagaagtgtcagcgcttttaggtcgtatgccttcagccgttggttatcaaccaacacttgctacagaaatgggacaattacaagagcgtatcacttcaactaaaaaaggttctgttacctca

SEQ ID NO: 382 - DNA, 845 bp, Streptococcus agalactiae
  ref <308>: DATABASE ACCESSION NUMBER: ATCC 27591
ttgcaagtggcgacaaacttcctgagattaataatgcattgattgtctataaaaatggcgataagtcacaaaaagtagtacttgaagttgctcttgaacttggtgacggcctcgttcgtacaatcgctatggaatcaactgatgggcttacacgtggtttggaagtattagatactggtcgcgcaattagtgtgccggttggtaaggatactttgggtcgtgtcttcaacgttcttggagatgctattgaccttgaagagccttttgcagaagatgcagaacgtcaaccaatccataaaaaagcaccatcgtttgatgaattatcaacatcatcagaaatcttagaaactggtattaaagttattgacttattagcaccttacttaaaaggtggtaaagttggacttttcggtggtgcaggtgttggtaaaaccgttcttattcaagaattaatccacaacatcgcccaagaacatggtggtatttcagtatttactggtgtaggagaacgtactcgtgaagggaatgacctttattgggaaatgaaagaatctggcgttattgaaaaaacggctatggtctttggtcaaatgaatgaaccaccaggagcacgtatgcgtgtggcacttactggtcttacaatagctgagtacttccgtgatgtagaaggacaagatgtgcttctcttcattgataatatcttccgtttcacacaagctgggtcagaagtgtcagcgcttttaggtcgtatgccttcagccgttggttatcaaccaacacttgctacagaaatgggacaattacaagagcgtatcacttcaactaaaaaaggttctgttacatca

SEQ ID NO: 383 - DNA, 845 bp, Streptococcus agalactiae; identical to SEQ ID NO: 382
  strain CDCss-1073

SEQ ID NO: 384 - DNA, 845 bp, Streptococcus dysgalactiae
  ref <308>: DATABASE ACCESSION NUMBER: ATCC 43078
ttgctagtggggacaaacttccagagattaataatgcattgattgtttataaagatagtgataaaaagcaaaaaatcgtccttgaagttgctctggaacttggtgacggtatggtgcgaacaatcgctatggaatcaactgatgggcttacacgtgggttagaagttcttgacactggtcgtgcgattagtgtaccagtaggtaaagaaactttgggacgcgtctttaatgtacttggagaaaccattgacttggaagaaccatttgcagaagacgttgaccgtcagccaatccataaaaaagcaccatcgtttgatgaattatcaacatcatcagaaattcttgaaactggtatcaaggtaattgaccttcttgccccttaccttaaaggtggtaaagttggacttttcgggggtgccggagttggtaagactgtccttatccaagaattaatccacaatatcgcccaagaacacggaggtatttcagtatttaccggtgttggtgagcgaacacgtgaaggaaatgacctttactgggaaatgaaagaatcaggcgttattgagaaaactgccatggtttttggtcagatgaatgagccgcctggggcacgtatgcgtgtagcccttactggtttaaccattgctgagtatttccgtgatgtagaaggccaagatgttttgctctttattgataatatcttccgtttcactcaggcaggttcagaagtatcagccctcttaggccgtatgccttctgctgttggttaccaaccgacccttgctactgaaatgggacaattgcaagaacgtattacgtcaactcaaaaaggatctgttacttct

SEQ ID NO: 385 - DNA, 846 bp, Streptococcus equi subsp. equi
  ref <308>: DATABASE ACCESSION NUMBER: ATCC 9528
ttgcgagtggggacaaactaccagagattaataatgcgttgatagtttataaagatggcgataaaaagcaaaaaatcgttctcgaggttgccctagagcttggagacggtatggtacgtacaattgctatggaatcaaccgatgggcttacacgtggattagaggttcttgatactggtcgtgccattagtgtaccagttggtaaagagactctaggtcgtgttttcaacgttcttggtgaaaccatcgacctagaagcaccatttgcagatgatgttaatcgtgaaccgatccataaaaaagcaccagcctttgatgaattgtcaacatcatcagaaattcttgaaacaggtatcaaggttattgacctgcttgccccttacttaaagggtggtaaggtcggtcttttcggtggtgccggagttggtaaaaccgttcttatccaagaattaatccacaatatcgctcaagagcatggtgggatctcggtatttaccggtgttggtgagcgtacgcgtgaaggaaatgacctttactgggaaatgaaggaatcaggcgttattgaaaaaacagccatggtttttggtcagatgaatgaaccaccaggagcccgtatgcgtgttgccttgaccggcttgacaattgctgaatatttccgcgatgttgaaggccaagacgtcctgctcttcattgacaatattttccgctttactcaagcaggctcagaggtatcagcccttctaggtcgtatgccttcagccgttggttaccagccaacacttgccactgaaatgggacaattgcaagagcgtatcacctcaacgaaaaaaggctctgttacctcta

SEQ ID NO: 386 - DNA, 843 bp, Streptococcus anginosus
  ref <308>: DATABASE ACCESSION NUMBER: ATCC 27335
gcagctggtgataaacttcctgagattaacaatgcattggtcgtttatactgatgaacaaaagtctaaacgtatcgtgctcgaagtagctcttgaacttggagaaggtgtggttcgtaccattgccatggaatctactgatggattgactcgtggactagaagttctggacactggtcgtccaatcagcgttcctgttggtaaagatacccttggacgtgtctttaacgttcttggtgataccattgacttggaagcaccttttgcagacgatgcagagcgtgaaccaattcacaaaaaagcaccaactttcgatgaattgtcaacatctactgaaatccttgaaacagggattaaagttatcgacttgctagccccttaccttaagggtggtaaagtcggactcttcggtggtgccggtgttggtaaaaccgttcttattcaagagttgattcacaacattgcccaagagcacggtggtatttccgtgtttacaggtgttggtgaacgtacacgtgaaggtaatgacctttactgggaaatgaaagaatctggcgttatcgagaaaacagccatggtcttcggtcaaatgaacgaaccacctggagcacgtatgcgtgttgcccttactggtttgacaattgcggaatacttccgtgatgtcgagggtcaagacgttcttctcttcatcgataacatcttccgtttcactcaagcaggttctgaggtttctgcccttcttggtcgtatgccatcagccgttggttaccaacctacacttgctactgaaatgggtcaattgcaagaacgtatcacatcaactaaaaaaggttctgttacatct

SEQ ID NO: 387 - DNA, 843 bp, Streptococcus salivarius; identical to SEQ ID NO: 386
  ref <308>: DATABASE ACCESSION NUMBER: ATCC 7073

SEQ ID NO: 388 - DNA, 841 bp, Streptococcus suis
  ref <308>: DATABASE ACCESSION NUMBER: ATCC 43765
ttgcagcagaagataaacttcctgagattaacaacgcactcgttgtatataaaaatgatgattccaaacaaaaagtcgtgcttgaagtggctttggaacttggtgatggcgttgtacggaccattgccatggaatcaacggatggattgacacgtgggatggaagttctcgatacaggtcgtcccatctctgttccagtcggtaaagaaacgctgggtcgtgtcttcaatgtgttgggagataccattgaccttgaagagtcttttccggcagattttgaacgtgagcctatccataagaaagcgccggcttttgacgaattatctacttcaagcgaaattttggaaacagggattaaggttatcgacctcctagcaccttatctaaaaggtggtaaggttggtctcttcggtggtgctggtgttggtaaaaccgttcttatccaagaattgattcacaatattgcccaagaacacggtggtatctctgtatttaccggagttggcgagcgtacccgtgaagggaacgatctttactgggaaatgaaagaatcaggtgttattgaaaaaacggccatggtatttggtcagatgaatgagccaccaggagcccgtatgcgtgttgctcttactggtttgactattgcggaatacttccgtgatgtggaagggcaggatgttcttctgttcatcgataatatcttccgtttcacacaggctggttcagaagtgtctgccctcttgggtcgtatgccatcagccgttggttatcagccaacacttgcgacggagatgggacaattgcaggagcgtattacctcaaccaagaagggttctgttac

SEQ ID NO: 389 - DNA, 844 bp, Streptococcus uberis
  ref <308>: DATABASE ACCESSION NUMBER: ATCC 19436
gcaaacggtgaaaaattaccagagattaataatgcattgatagtttataaaggtagcgataaaaaacaaaagattgttcttgaagttgctttggaacttggggacggaatggttcgtacaatcgctatggaatcaactgatgggcttacacgtggattagaagttttagatactggccgtgccattagtgtaccagtcggaaaagaaactttgggtcgtgttttcaatgtgcttggtgaaaccattgatttggatgaaccatttgccgctgatgctgcaagagaacccatccataaaaaagccccagcatttgatgaactatcaacgtcttcagaaattcttgaaaccggaataaaagttattgacttattagccccttatctcaaaggtggtaaagttggtttatttggtggtgccggagtaggtaaaacggttttaattcaagaattaattcataatattgcacaagaacatggtggtatttcagtatttaccggtgttggtgaaagaactcgtgaaggtaatgacctttattgggaaatgaaagaatctggcgttattgaaaaaacagccatggtatttggacaaatgaacgaaccaccaggagcacgtatgcgcgttgctttaacaggtttaaccattgctgaatatttccgggatgttgaaggtcaagatgttttgctctttattgacaacattttccgtttcacgcaagctggttcagaagtttcagccctattgggtcgtatgccttcagcggtaggataccaaccaacacttgctaccgaaatgggacaattgcaagaaagaattacctcaactaacaagggatctgttacttcta

SEQ ID NO: 390 - DNA, 846 bp, Tatumella ptyseos
  ref <308>: DATABASE ACCESSION NUMBER: ATCC 33301
ttccctcaggacgctgtaccacaggtgtacaacgctcttgaggttgaaaatggtgatacccgtctggtgctggaagttcagcagcagctgggcggtggtgtcgttcgtacgattgcaatgggaacctctgacggcctgaaacgtggccttaaggtgaccgatctgcaaaaaccgattcaggtaccggtcggtaaagcgacgctgggccgtatcatgaacgtactgggtcagccaatcgatatgaaaggcgacctgaagaacgaagatggtagcaatgttgaggtgaactctattcaccgtgcagcgccaagctacgaagaactggctaactctactgagctgctggaaacgggtatcaaggttatcgacctgatctgtccgtttgcaaaaggcggtaaagtgggtctgttcggtggtgcgggtgtaggtaagaccgtcaacatgatggaactgatccgtaacatcgctatcgagcactctggttactctgtatttgcaggggtgggtgagcgtacccgtgaaggtaacgacttctaccacgaaatgaccgagtctaacgttctggataaagttgctctggtttatggccagatgaacgagccaccaggaaaccgtctgcgcgttgcgctgaccggtctgactatggctgaaaaattccgtgacgaaggccgtgacgtactgctgttcgttgataacatctatcgttataccctggccggtactgaagtttcagcactgctgggtcgtatgccttctgcggtaggttatcagccaacactggccgaagaaatgggtgttcttcaggaacgtatcacgtcaaccaaaaccggttcaatcacttccgta

SEQ ID NO: 391 - DNA, 829 bp, Trabulsiella guamensis
  ref <308>: DATABASE ACCESSION NUMBER: ATCC 49490
ttccctcaggatgccgtaccgcgcgtgtacgatgctcttgaggttatgaatggtagtgagcgtctggtgctggaagttcagcagcagctcggtggtggtatcgtacgtactatcgccatgggttcttccgacggtctgcgtcgtggtctggatgtaaaagatctcgagcatccgatcgaagtcccggtaggtaaagcaacgctgggtcgtatcatgaacgtgctgggtcagccgatcgatatgaaaggcgacatcggcgaagaagagcgttgggctatccaccgcgcagcaccgtcctacgaagagctgtccagctctcaggaactgctggaaaccggcatcaaagttatcgacctgatgtgtccgttcgcgaagggcggtaaagtcggtctgttcggtggtgcgggtgtaggtaaaaccgtaaacatgatggagctgattcgtaacatcgcgatcgagcactccggttactctgtgtttgcgggcgtgggtgaacgtactcgtgagggtaacgacttctaccacgaaatgaccgactccaacgttctggacaaagtatccctggtgtatggacagatgaacgagccgccgggaaaccgtctgcgcgttgcactgaccggtctgaccatggctgagaagttccgtgacgaaggtcgtgacgttctgctgttcgtcgataacatctaccgttacaccctggcgggtactgaagtatctgcactgctgggccgtatgccttcagcggtaggttaccagccgaccctggcggaagagatgggtgttcttcaggaacgtatcacctcaaccaaaaccggttctatcacctccg

SEQ ID NO: 392 - DNA, 835 bp, Yersinia bercovieri
  ref <308>: DATABASE ACCESSION NUMBER: ATCC 43970
cgaattcccccaagacgctgtaccaaaagtgtacaacgcccttgaggttgaaggcacagctcagaagctggtgctggaagttcagcaacagctgggcggtggtgttgttcgttgtatcgcaatgggctcttccgatggtctgagccgcgggttgaaagtcatcaacctggaacacccaattgaagtgccggtgggtaaatcaactctgggccgtatcatgaacgtattgggtgacccaatcgacatgaaaggtcctatcggtgaagaagagcgttgggcaatccaccgcgaagcgccttcttacgaagagcttgccagctcgcaagatctgttagaaaccggtatcaaggtaatggatctgatttgtccgttcgctaagggcggtaaagtcggtctgttcggtggtgcgggtgtgggtaaaacagtcaacatgatggagctgattcgtaatattgcgattgagcactcaggttattctgtatttgccggtgtgggtgagcgtactcgtgagggtaacgacttctaccacgagatgactgactccaacgttctggacaaagtatccttggtttatggccagatgaatgagccaccaggtaaccgtctgcgcgttgcactgaccggcttgaccatggcggagaaattccgtgatgaaggtcgtgatgtactgttattcatcgataacatctatcgttataccctggccggtacagaggtatctgcactgctaggtcgtatgccatcagcggtaggctatcagccaacgctggcagaagagatgggtgtgttgcaggaacgtatcacttccaccaagacgggttcaatcacctccgta

SEQ ID NO: 393 - DNA, 812 bp, Yersinia enterocolitica
  ref <308>: DATABASE ACCESSION NUMBER: ATCC 9610
gctgtaccaaaagtgtacaacgcccttgaggttgaaggcgcagctgagaagctggtgctggaagttcagcaacagctgggcggtggtgttgttcgttgtatcgcaatgggctcttccgatggtctgagccgtgggttgaaagtcatcaacctggaacacccaattgaagtgcctgtgggcaagtcaactctgggccgtatcatgaacgtattgggtgacccaatcgacatgaaaggtcctatcggcgaagaagagcgttgggcaatccatcgtgaagcgccttcttacgaagatcttgccagctcgcaagacttgttagaaaccggtatcaaggtaatggacttgatttgtccgttcgctaagggcggtaaagtcggtctgttcggtggtgcgggtgtaggtaaaacggtaaacatgatggagcttattcgtaacattgcgattgagcactcaggttattccgtatttgctggcgtgggtgagcgtactcgtgagggtaacgacttctaccacgagatgactgactccaacgttctggacaaagtatccttggtttatggccaaatgaatgagccaccaggtaaccgtctgcgcgttgcactgaccggcttgaccatggcggagaaattccgtgatgaaggtcgtgacgtattgctgttcatcgataacatctatcgctataccttagccggtacggaagtttccgcactgctgggtcgtatgccatctgccgtaggttaccagccaacgctggcagaagagatgggtgtgttgcaggaacgtattacttccaccaagacgggttcaatcac

SEQ ID NO: 394 - DNA, 802 bp, Yersinia frederiksenii
  ref <308>: DATABASE ACCESSION NUMBER: ATCC 33641
aaagtgtacaacgcccttgaggttgaaggtactgctgagaagttagtactggaagttcagcaacagctgggcggtggtgttgctcgttgtatcgccatgggctcttccgatggtttgagccgcgggttgaaagttgtcaacctggaacacccaattgaagtaccggttggtaaatcaactctgggccgtatcatgaacgtattgggtgacccaatcgacatgaaaggtcctatcggtgaagaagagcgttgggcaatccaccgcgaagcgccttcttacgaagagcttgccagctcgcaagatctgttagaaaccggtatcaaggtaatggatctgatttgcccgttcgctaaaggcggtaaagtcggtctgttcggtggtgcgggtgtaggtaaaacggtaaacatgatggagctgatccgtaatatcgcgatcgagcactcaggttattccgtatttgcgggtgttggtgaacgtacccgtgagggtaacgacttctaccacgagatgactgactccaacgttctggacaaagtatccttggtttatggccagatgaatgagccaccaggtaaccgtcttcgcgttgcactgaccggtctgaccatggcggagaaattccgtgatgaaggtcgtgacgtattgctgttcatcgataacatctatcgttataccttggccggtacggaagtatccgcactgctgggtcgtatgccatctgcggtaggctatcagccaacgctggcagaagagatgggtgtgttgcaggaacgtattacttccaccaagacgggttcaatca

SEQ ID NO: 395 - DNA, 806 bp, Yersinia intermedia
  ref <308>: DATABASE ACCESSION NUMBER: ATCC 29909
gctgtaccaagagtgtacaacgcccttgaggttgaaggcactgctgagaagctggtgctggaagttcagcaacagctaggcggtggtgttgttcgttgtatcgcaatgggctcttccgatggtctgagccgcgggttgaaagtcatcaacctggaacacccaattgaagtgccggttggtaaatcaactctgggccgtatcatgaacgtattgggtgacccaatcgacatgaaaggtcctatcggtgaagaagagcgttgggcaatccaccgcgaagcgccttcttacgaagagcttgccagctcacaagatttgttagaaaccggtatcaaagtaatggacttgatttgcccgttcgctaagggcggtaaagtgggtctgttcggtggtgcgggtgtaggtaaaacagtaaacatgatggagcttattcgtaacatcgcgattgagcactcaggttattctgtatttgctggtgtgggtgagcgtactcgtgagggtaacgacttctaccacgagatgactgactccaacgttctggacaaagtatccttggtgtatggccagatgaatgagccaccaggtaaccgtctgcgcgttgcactgaccggcctgaccatggcggagaaattccgtgatgaaggtcgtgacgtactgttgttcatcgataacatctatcgctataccttggccggtacggaagtatccgcactgctgggtcgtatgccatcagcggtaggctaccagccaacgctggcagaagagatgggtgtgttgcaggaacgtattacgtccaccaagacgggttc

SEQ ID NO: 396 - DNA, 806 bp, Yersinia pseudotuberculosis
  ref <308>: DATABASE ACCESSION NUMBER: ATCC 29833
gctgtaccaaaagtgtacaacgcccttgaggtagaaggcacaactgaaaagttagtgctggaagttcagcaacagttgggcggtggtgttgttcgttgtatcgcaatgggctcttccgatggtctgagccgtgggttgaaagtaaccaacctggaacacccgatcgaagtaccggttggtaaagcgacccttggccgtatcatgaacgtattgggtgaaccaatcgacatgaaaggtcctatcggtgaagaagagcgttgggcaatccatcgcgaagcgccttcttatgaagagcttgctagctcacaagatctgttagaaaccggtatcaaggttatggacctgatttgtccgtttgctaagggcggtaaagtcggtctgttcggtggtgcgggtgtaggtaaaacagtaaacatgatggagctgatccgtaacatcgcgatcgagcactctgggtattctgtatttgccggtgtaggtgagcgtacccgtgagggtaatgacttctaccatgaaatgactgactccaacgttttggacaaagtatccttggtttacggccagatgaatgagccaccaggtaaccgtctacgcgttgcactgaccggcctgaccatggcggagaaattccgtgatgaaggtcgtgacgtactgctgttcatcgataatatctatcgttataccctagctggtacggaagtatccgcattgctgggtcgtatgccatcagcggtaggttatcagccaacactggctgaagagatgggtgtgttgcaggaacgtattacttccactaagacgggttc

SEQ ID NO: 397 - DNA, 829 bp, Yersinia rohdei
  ref <308>: DATABASE ACCESSION NUMBER: ATCC 43380
ttcccccaagacgctgtaccaaaagtgtacaacgcccttgaggttgaaggtgcagctgagaagcttgtgctggaagttcagcagcagctgggcggtggtgttgttcgttgtatcgcaatgggctcttccgatggtttgagccgtgggttgaaagttatcaacctggaacacccaattgaagtgccagttggtaaatcaactctgggccgtatcatgaacgtattgggtgacccaatcgacatgaaaggccctatcggtgaagaagagcgttgggcaatccaccgtgaagcgccttcttacgaagagcttgccagctcgcaagatctgttagaaaccggtatcaaggtaatggatctgatttgtccgttcgctaagggcggtaaagtcggtctgttcggtggtgcgggtgttggtaaaacagtaaacatgatggagcttattcgtaacatcgcgattgagcactcaggttattctgtatttgccggggtaggtgaacgtactcgtgagggtaacgacttctaccacgagatgactgactccaacgttctggacaaagtatccttggtttatggccagatgaatgagccaccaggtaaccgtctgcgcgttgcactgaccggcttgaccatggcggaaaaattccgtgatgaaggccgtgacgtattgctgttcatcgataacatttatcgttataccctagccggtacggaagtatccgcactgctgggtcgtatgccatctgcggtaggctatcagccaacactggcagaagagatgggtgtgttgcaggaacgtattacttccactaagacgggttcaatcacctccg

SEQ ID NO: 398 - DNA, 819 bp, Yokenella regensburgei
  ref <308>: DATABASE ACCESSION NUMBER: ATCC 35313
atgccgtaccgcgcgtgtacgatgctcttgaggtacaaaatggtaacgagaaactggtgctggaagctcagcagcagctcggcggcggtatcgtgcgtactatcgccatgggttcttccgacggtctgcgtcgtggtctggaagttaaagacctcgagcacccgatcgaagtcccggtaggtaaagcaaccctgggccgtatcatgaacgtcctgggtcagccgatcgacatgaaaggcgacatcggtgaagaagagcgttgggctatccaccgcgcagcaccttcctatgaagagctgtccagctctcaggaactgctggaaaccggtatcaaagtaatggatctgatctgcccgttcgctaagggtggtaaagtcggtctgttcggtggtgcgggtgtaggtaaaactgtaaacatgatggagcttatccgtaacatcgcgattgagcactccggttactctgtgtttgcaggcgtgggtgaacgtactcgtgagggtaacgacttctaccacgaaatgaccgactccaacgtactggataaagtatccctggtgtacggccagatgaacgagccgccgggaaaccgtctgcgcgttgcgctgaccggcctgaccatggctgagaaattccgtgacgaaggccgtgacgttctgctgttcgtcgataacatctaccgttataccctggccggtacggaagtatccgcactgctgggtcgtatgccttctgcggtaggttatcagccaactctggcggaagagatgggtgttcttcaggaacgtatcacctctaccaaaaccggttctatcacctccg

SEQ ID NO: 399 - DNA, 1097 bp, Yarrowia lipolytica
  ref <308>: DATABASE ACCESSION NUMBER: ATCC 38295
aagcttaaggctgagcgagagcgaggtatcaccattgatatcgctctctggaagttccagacccctaagtactacgtcaccgttattgatgctcccggtcaccgagatttcatcaagaacatgattaccggtacttcccaggctgactgcgccatcctcatcattgctggtggtgttggtgagttcgaggctggtatctccaaggatggtcagacccgagagcacgccctgctcgctttcaccctcggtgttaagcagctcattgttgctatcaacaagatggactccgtcaagtggtctcaggatcgatacctcgagatttgcaaggagactgccaacttcgtcaagaaggtcggttacaaccccaaggctgtccccttcgtccccatttccggatggaacggtgacaacatgatcgagccctctaccaactgtgactggtacaagggatggaccaaggagaccaaggccggcgagatcaagggtaagaccctcctcgaggccattgatgccattgagccccccgtgcgaccccacgacaagcccctccgacttcccctccaggatgtctacaagatcggtggtatcggcacagtgcccgttggccgagtcgagaccggtgttatcaaggccggtatggktgttaccttcgctcccgccaacgtgaccactgaggtcaagtctgtcgagatgcaccacgagatcctccccgatggaggtttccccggtgacaacgtcggtttcaacgtcaagaacgtttccgtcaaggatatccgacgaggtaacgttgctggtgactccaagaacgacccccccaagggctgcgactctttcaacgctcaggtcattgttcttaaccaccccggtcagatcggtgctggttacgctcccgtccttgattgccacactgcccacattgcttgcaagttcgacaccctgatcgagaagatcgaccgacgaaccggtaagaagatggaggactcccccaagttcatcaagtctggtgatgctgccattgtcaagatggttccctccaagcccatgtgtgtcgaggccttcactgagtacccccctcttggtcgattcgccgtccgaga

SEQ ID NO: 400 - DNA, 1233 bp, Absidia corymbifera
  misc_feature (1)...(1233): n=a,t,c or g
  ref <308>: DATABASE ACCESSION NUMBER: ATCC 46775
caagcttaaggctgaacgtgagcgtggtatcaccatcgatatcgctctctggaagttcgagactcccaagtaccacgttaccgtcattgatgcccctggccatcgtgatttcatcaagaacatgattactggtacttcccaagctgactgcggtatcttgattattgctgctggtactggtgaattcgaagctggtatctccaaggatggtcaaacccgtgaacacgctttgcttgctttcacccttggtgtccgtcaattgattgtcgctatcaacaagatggattccaccaagtactctgaggcccgttacaacgaaattgtcaaggaagtctccaccttcatcaagaagattggtttcaaccccaagtccgttcctttcgtccctatctctggctggaacggtgacaacatgttggaggartccaccaacatgccttggttcaagggatggaacaaggagactaaggctggtgccaagacyggcaagacccttcttgaagccattgacaacattgatccccctgttcgtccttccgacaagccccttcgtcttccccttcaagatgtctacaagatcggtggtattggtacagttcctgtcggtcgtgttgagactggtgtcatcaagcctggtatggttgtcaccttcgctcccgctaacgtcaccactgaagtcaagtccgtygaaatgcaccacgagcaacttgctgaaggtgttcccggtgacaacgtcggtttcaacgtcaagaacgtttccgtcaaggatatccgccgtggtaacgtytgctctgactccaagaacgaccccgccaaggaatccgcttccttcaccgctcaagttattgtcttgaaccaccctggtcarattggtgctggttactctcctgtcttggattgccacactgctcacattgcatgcaagttctytkagcttcttkagaagatcgatygtcgttccggtaagtaaatantttggtttrggatatgggtattgggcttaatctytggattttgcctcaattgctccttccttgatctttctcgattactttttgatcatttgctaatccaaaccctttccatttyattgaaaacaggtaagaagttggaagactcccccaagttcgtcaagwsyggtgactctgcyatcgtcaagatggttccttccaagcccatgtgcgttgaagcctacactgaatatcctcctcttggtcgtttcgctgtccgtga

SEQ ID NO: 401 - DNA, 1151 bp, Alternaria alternata
  ref <308>: DATABASE ACCESSION NUMBER: ATCC 62099
caagttgaaggccgagcgtgagcgtggtatcaccatcgacattgctctctggaagttcgagactcccaaggttagtacccctctgcctactacatcaagttctttacaatgctaacatgttgtactcagtactatgtcaccgtcattgacgcccccggtcaccgtgatttcatcaagaacatgatcactggtacctcccaggccgactgcgctattctcatcattgccgccggtactggtgagttcgaggctggtatctccaaggatggccagactcgtgagcacgctctcctcgcttacaccctcggtgtcaagcagctcatcgttgccatcaacaagatggacaccaccaagtggtccgaggagcgttaccaggagatcatcaaggagacctccaacttcatcaagaaggtcggctacaaccccaagcacgttcccttcgtccccatctccggtttcaacggtgacaacatgattgaggcctcatccaactgcccctggtacaagggttgggagaaggagaccaaggccaaggccactggtaagaccctcctcgaggccatcgacgccatcgaccctyccagccgtcccaccgacaagcccctccgtcttcccctycaggatgtttacaagattggtggtattggcacggtgcccgtcggtcgtgtcgagaccggtatcatcaaggccggtatggtcgtcaccttcgcccccgctggtgtcaccactgaagtcaagtccgtcgagatgcaccacgagcagctcaccgagggtgtccccggtgacaacgtcggcttcaacgtcaagaacgtctccgtcaaggagatccgtcgtggtaacgttgccggtgactccaagaacgacccccccaagggtgccgagtccttcaacgcccaggtcatcgtcctcaaccaccctggtcaggtcggtgctggttacgccccagtcctcgactgccacaccgcccacattgcttgcaagttctctgagctcctcgagaagattgaccgccgtaccggaaagtctgttgagaactctcccaagttcatcaagtccggtgacgccgccatcgtcaagatggttccctccaagcccatgtgcgttgaggctttcactgactaccctcctctcggtcgtttcgctgtccgtga

SEQ ID NO: 402 - DNA, 1283 bp, Aspergillus flavus
  ref <308>: DATABASE ACCESSION NUMBER: ATCC 26947
caagctcaagtccgagcgtgagcgtggtatcaccatcgatatcgccctctggaagttccagacctccaagtatgaggtcaccgtcattggtaagcatttgagttccaacctacgttgcccaacatttacagtcatctaacaaagttcaatagatgcccccggtcaccgtgacttcatcaagaacatgatcactggtacttcccaggctgactgcgctatcctcatcattgcctccggtactggtgaattcgaggctggtatctccaaggatggtcagacccgtgagcacgctctgctcgctttcaccctcggtgtccgtcagctcatcgttgccctcaacaagatggacacctgcaagtggtctcaggatcgttacaacgaaatcgttaaggagacttccaacttcatcaagaaggtcggatacaaccccaagagcgttcctttcgtccccatctccggtttcaacggtgacaacatgattgaggcctccaccaactgcccctggtacaagggttgggagaaggagaccaaggctggcaagtccaccggtaagacccttctcgaggccatcgatgccatcgagccccccgtccgtcccaccgacaagcctctccgtcttcccctycaggatgtctacaagatctctggtatcggtactgtgcccgtcggtcgtgtcgagactggtgtcatcaagcctggtatggtcgttactttcgctcctgccaacgtgaccactgaagtcaagtccgttgaaatgcaccaccagcagctccaggccggtaaccccggtgacaacgttggtttcaacgtcaagaacgtctccgtcaaggaagtccgccgtggtaacgttgccggtgactccaagaacgacccccctgctggctgcgattccttcaacgcccaggtcatcgtccttaaccaccccggtcaggtcggcaacggttacgctcccgtcctggactgccacaccgctcacattgcttgcaagttcgctgagctccttgagaagattgaccgccgtaccggtaaatctgttgaggacaagcccaagttcatcaagtctggtgatgctgccatcgtcaagatgattccctccaagcccatgtgtgtggagtctttcactgacttcccccctcttggtcgtttcgctgtccgtgacgtaagtttttccctcttgactatcttcacaatttttcacatattttcacgcctcgtcccactctttttcctcccttcctctttggttcccctttttgcctgcaagttctctatagctaacatga

SEQ ID NO: 403 - DNA, 1103 bp, Aspergillus fumigatus
  strain DAL-95
tccgagcgtgagcgtggtatcaccatcgacattgccctctggaagttccagactcccaagtatgaggtcactgtcatcggtaagctcgactcgccccgatatgttttggtgctgtagctaacacgatctgaagatgcccccggtcaccgtgacttcatcaagaacatgatcactggtacctcccaggctgactgcgctatcctcatcattgcctccggtactggtgagttcgaggctggtatctccaaggatggccagacccgtgagcacgctctgctggctttcaccctcggtgtcaagcagctcatcgtcgccctcaacaagatggacacctgcaagtggtccgaggatcgttacaacgaaattgtcaaggaaacctccaacttcatcaagaaggtcggctacaaccccaaggccgttcccttcgtccccatctctggcttcaacggtgacaacatgcttgagccctcctccaactgcccctggtacaagggatgggagaaggagaccaaggccggcaaggtcactggtaagaccctcatcgaggccatcgacgccattgagccccctgtccgtccctccaacaagcccctccgtcttcccctccaggatgtctacaagatctctggtatcggaacggtccctgtcggccgtgtcgagaccggtatcatcaagcccggcatggtcgtcaccttcgcccccgccaacgtcaccactgaagtcaagtccgtcgagatgcaccaccagcagctccaggagggtgtccccggtgacaacgtcggtttcaacgtcaagaacgtttccgtcaaggaagtccgccgtggtaacgtctgcggtgactccaagaacgatccccctcagggtgctgcctccttcaacgcccaggtcatcgtcctcaaccaccccggtcaggtcggcgctggttacgcccccgtcctcgactgccacactgcccacattgcttgcaagttctctgagctgcttgagaagattgaccgccgtaccggcaagtctgttgagaacaaccccaagttcatcaagtccggtgatgccgccatcgtgaagatggttccttccaagcccatgtgtgtcgagtccttcac

SEQ ID NO: 404 - DNA, 1149 bp, Aspergillus fumigatus
  strain WSA-172
aagctcaagtccgagcgtgagcgtggtatcaccatcgacattgccctctggaagttccagactcccaagtatgaggtcactgtcatcggtaagctcgactcgccccgatatgttttggtgctgtagctaacacgatctgaagatgcccccggtcaccgtgacttcatcaagaacatgatcactggtacctcccaggctgactgcgctatcctcatcattgcctccggtactggtgagttcgaggctggtatctccaaggatggccagacccgtgagcacgctctgctggctttcaccctcggtgtcaagcagctcatcgtcgccctcaacaagatggacacctgcaagtggtccgaggatcgttacaacgaaattgtcaaggaaacctccaacttcatcaagaaggtcggctacaaccccaaggccgttcccttcgtccccatctctggcttcaacggtgacaacatgcttgagccctcctccaactgcccctggtacaagggatgggagaaggagaccaaggccggcaaggtcactggtaagaccctcatcgaggccatcgacgccattgagccccctgtccgtccctccaacaagcccctccgtcttcccctccaggatgtctacaagatctctggtatcggaacggtccctgtcggccgtgtcgagaccggtatcatcaagcccggcatggtcgtcaccttcgcccccgccaacgtcaccactgaagtcaagtccgtcgagatgcaccaccagcagctccaggagggtgtccccggtgacaacgtcggtttcaacgtcaagaacgtttccgtcaaggaagtccgccgtggtaacgtctgcggtgactccaagaacgatccccctcagggtgctgcctccttcaacgcccaggtcatcgtcctcaaccaccccggtcaggtcggcgctggttacgcccccgtcctcgactgccacactgcccacattgcttgcaagttctctgagctgcttgagaagattgaccgccgtaccggcaagtctgttgagaacaaccccaagttcatcaagtccggtgatgccgccatcgtgaagatggttccttccaagcccatgtgtgtcgagtccttcactgactacccccctctgggtcgtttcgccgtccgtgac

SEQ ID NO: 405 - DNA, 1151 bp, Aspergillus niger
  ref <308>: DATABASE ACCESSION NUMBER: ATCC 9508
caagctcaagtccgagcgtgagcgtggtatcaccatcgacattgccctctggaagttccagactggcaagtatgaggtcaccgtcattggtatgtactcacagagttctcttttcatcaaagcaatatactaacgtccatcatagacgcccccggtcaccgtgacttcatcaagaacatgatcactggtacctcccaggctgactgcgctatcctcatcattgcctccggtactggtgagttcgaggctggtatctccaaggatggccagactcgtgagcacgctctgcttgctttcaccctcggtgtccgccagctcatcgttgccctcaacaagatggacacctgcaagtggtccgaggaccgttacaacgaaatcgttaaggagacctccaacttcatcaagaaggtcggatacaaccccaagggtgttcctttcgtccccatctccggtttcaacggtgacaacatgctcgagccctcccccaactgcccctggtacaagggttgggagaaggagaccaaggccggcaaggtcaccggtaagaccctccttgaggccatcgacgccatcgagccccccgtccgtccctccaacaagcccctccgtcttcccctccaggatgtctacaagatctccggtattggaactgttcccgtcggtcgtgtcgagaccggtatcattgcccctggtatggtcgtgaccttcgctcccgccaacgtcaccactgaagtcaagtccgttgagatgcaccaccagcagctcaaggaaggtgtccccggtgacaacgttggtttcaacgtcaagaacgtttccgtcaaggaggttcgccgtggtaacgttgccggtgactccaagaacgacccccctcttggctgtgagagcttcaccgcccaggtcatcgtcctcaaccaccccggtcaggtcggcgctggttacgctcccgtcctggactgccacactgctcacattgcttgcaagttcgctgagctccttgagaagattgaccgccgtaccggaaagtctgttgaatcttcccccaagttcatcaagtccggtgacgctgccatcgtcaagatgattccctccaagcccatgtgtgttgaggctttcactgactacccccctcttggtcgtttcgccgtccgcga

SEQ ID NO: 406 - DNA, 1093 bp, Blastoschizomyces capitatus
  ref <308>: DATABASE ACCESSION NUMBER: ATCC 10663
gcttaaagctgaacgtgaacgtggtatcaccattgatatcgctctctggaagttcgaaactcctaagtactacgttactgttattgatgctccaggtcaccgtgatttcatcaagaacatgattactggtacttcccaagccgattgcgccattcttatcattgctgccggtgtcggtgaattcgaagctggtatctccaaggaaggtcaaaccagagaacacgctcttctcgctttcacccttggtgtcagacaacttatcattgccatcaacaagatggactctgtcaagtgggaccaaaagagatacgaagaaatcgtcaaggaggcttccaacttcgtcaagaaggttggttacaaccccaagtctgttccattcgttcctatctctggttggaacggtgacaacatgttggaacctaccaccaacgccccatggtacaagggatggaccaaggaaaccaaggctggtgccactaagggtatgactcttattgaagccattgacgccattgaaccaccagtaagaccatccgacaagccactccgtctcccactccaagatgtttacaagattggtggtatcggaactgtgccagtcggccgtgtcgaaaccggtatcatcaaggccggtatggtcgttacctttgctccaccaatggtcacaactgaagttaagtccgttgaaatgcaccacgaacaacttgctcaaggtaacccaggtgacaacgttggtttcaacgtcaagaacgtttccgttaaggaaatcagacgtggtaacgtctgtggtgactccaagaacgatccaccaaagggctgcgaatctttcaacgctcaagttatcgtcttgaaccaccctggtcaaatctctgctggttactctccagttctcgattgccacactgcccacattgcctgcagattcgacgaactccttgaaaagatcgaccgtcgttctggtaagaagattgaagactctccaaagtttgtcaagtctggtgatgccgctatcgtcaagatgatcccaaccaagccaatgtgcgttgaaaccttcactgaatacccaccacttggtcgtttcgccgtccgtgat

SEQ ID NO: 407 - DNA, 1101 bp, Candida albicans
  ref <308>: DATABASE ACCESSION NUMBER: ATCC 10231
cttggacaaattgaaggctgaaagagaaagaggtatcaccattgatatcgctttgtggaaattcgaaactccaaaataccacgttaccgtcattgatgctccaggtcacagagatttcatcaagaatatgatcactggtacttctcaagctgattgtgctattttgattattgctggtggtactggtgaattcgaagccggtatttctaaggatggtcaaaccagagaacacgctttgttggcttacactttgggtgtcaaacaattgattgttgctgtcaacaagatggactctgtcaaatgggacaaaaacagatttgaagaaatcatcaaggaaacctccaacttcgtcaagaaggttggttacaacccaaagactgttccattygttccaatctctggttggaatggtgacaacatgattgaaccatccaccaactgtccatggtacaagggttgggaaaaggaaaccaaatccggtaaagttactggtaagaccttgttagaagctattgacgctattgaaccaccaaccagaccaaccgacaaaccattgagattgccattgcaagatgtttacaagatcggtggtattggtactgtgccagtcggtagagttgaaactggtatcatcaaagccggtatggttgttactttcgccccagctggtgttaccactgaagtcaaatccgttgaaatgcatcacgaacaattggctgaaggtgttccaggtgacaatgttggtttcaacgttaagaacgtttccgttaaagaaattagaagaggtaacgtttgtggtgactccaagaacgatccaccaaagggttgtgactctttcaatgcccaagtcattgttttgaaccatccaggtcaaatctctgctggttactctccagtcttggattgtcacactgcccacattgcttgtaaattcgacactttggttgaaaagattgacagaagaactggtaagaaattggaagaaaatccaaaattcgtcaaatccggtgatgctgctatcgtcaagatggtcccaaccaaaccaatgtgtgttgaagctttcactgactacccaccattaggtagattcgctgtcagaga

SEQ ID NO: 408 - DNA, 1089 bp, Candida albicans
  ref <308>: DATABASE ACCESSION NUMBER: ATCC 18804
gaaggctgaaagagaaagaggtatcaccattgatatcgctttgtggaaattcgaaactccaaaataccacgttaccgtcattgatgctccaggtcacagagatttcatcaagaatatgatcactggtacttctcaagctgattgtgctattttgattattgctggtggtactggtgaattcgaagccggtatttctaaggatggtcaaaccagagaacacgctttgttggcttacactttgggtgtcaaacaattgattgttgctgtcaacaagatggactctgtcaaatgggacaaaaacagatttgaagaaatcatcaaggaaacctccaacttcgtcaagaaggttggttacaacccaaagactgttccattcgttccaatctctggttggaatggtgacaacatgattgaaccatccaccaactgtccatggtacaagggttgggaaaaggaaaccaaatccggtaaagttactggtaagaccttgttagaagctattgacgctattgaaccaccaaccagaccaaccgacaaaccattgagattgccattgcaagatgtttacaagatcggtggtattggtactgtgccagtcggtagagttgaaactggtatcatcaaagccggtatggttgttactttcgccccagctggtgttaccactgaagtcaaatccgttgaaatgcatcacgaacaattggctgaaggtgttccaggtgacaatgttggtttcaacgttaagaacgtttccgttaaagaaattagaagaggtaacgtttgtggtgactccaagaacgatccaccaaagggttgtgactctttcaatgcccaagtcattgttttgaaccatccaggtcaaatctctgctggttactctccagtcttggattgtcacactgcccacattgcttgtaaattcgacactttggttgaaaagattgacagaagaactggtaagaaattggaagaaaatccaaaattcgtcaaatccggtgatgctgctatcgtcaagatggtcccaaccaaaccaatgtgtgttgaagctttcactgactacccaccattaggtagattcgctgtcagaga

SEQ ID NO: 409 - DNA, 1101 bp, Candida albicans
  ref <308>: DATABASE ACCESSION NUMBER: ATCC 56884
cttggacaaattgaaggctgaaagagaaagaggtatcaccattgatatcgctttgtggaaattcgaaactccaaaataccacgttaccgtcattgatgctccaggtcacagagatttcatcaagaatatgatcactggtacttctcaagctgattgtgctattttgattattgctggtggtactggtgaattcgaagccggtatttctaaggatggtcaaaccagagaacacgctttgttggcttacactttgggtgtcaaacaattgattgttgctgtcaacaagatggactctgtcaaatgggacaaaaacagatttgaagaaatcatcaaggaaacctccaacttcgtcaagaaggttggttacaacccaaagactgttccattcgttccaatctctggttggaatggtgacaacatgattgaaccatccaccaactgtccatggtacaagggttgggaaaaggaaaccaaatccggtaaagttactggtaagaccttgttagaagctattgacgctattgaaccaccaaccagaccaaccgacaaaccattgagattgccattgcaagatgtttacaagatcggtggtattggtactgtgccagtcggtagagttgaaactggtatcatcaaagccggtatggttgttactttcgccccagctggtgttaccactgaagtcaaatccgttgaaatgcatcacgaacaattggctgaaggtgttccaggtgacaatgttggtttcaacgttaagaacgtttccgttaaagaaattagaagaggtaacgtttgtggtgactccaagaacgatccaccaaagggttgtgactctttcaatgcccaagtcattgttttgaaccatccaggtcaaatctctgctggttactctccagtcttggattgtcacactgcccacattgcttgtaaattcgacactttggttgaaaagattgacagaagaactggtaagaaattggaagaaaatccaaaattcgtcaaatccggtgatgctgctatcgtcaagatggtcccaaccaaaccaatgtgtgttgaagctttcactgactacccaccattaggtagattcgctgtcagaga

SEQ ID NO: 410 - DNA, 1102 bp, Candida albicans
  ref <308>: DATABASE ACCESSION NUMBER: ATCC 60193
cttggacaaattgaaggctgaaagagaaagaggtatcaccattgatatcgctttgtggaaattcgaaactccaaaataccacgttaccgtcattgatgctccaggtcacagagatttcatcaagaatatgatcactggtacttctcaagctgattgtgctattttgattattgctggtggtactggtgaattcgaagccggtatttctaaggatggtcaaaccagagaacacgctttgttggcttacactttgggtgtcaaacaattgattgttgctgtcaacaagatggactctgtcaaatgggacaaaaacagatttgaagaaatcatcaaggaaacctccaacttcgtcaagaaggttggttacaacccaaagactgttccattcgttccaatctctggttggaatggtgacaacatgattgaaccatccaccaactgtccatggtacaagggttgggaaaaggaaaccaaatccggtaaagttactggtaagaccttgttagaagctattgacgctattgaaccaccaaccagaccaaccgacaaaccattgagattgccattgcaagatgtttacaagatcggtggtattggtactgtgccagtcggtagagttgaaactggtatcatcaaagccggtatggttgttactttcgccccagctggtgttaccactgaagtcaaatccgttgaaatgcatcacgaacaattggctgaaggtgttccaggtgacaatgttggtttcaacgttaagaacgtttccgttaaagaaattagaagaggtaacgtttgtggtgactccaagaacgatccaccaaagggttgtgactctttcaatgcccaagtcattgttttgaaccatccaggtcaaatctctgctggttactctccagtcttggattgtcacactgcccacattgcttgtaaattcgacactttggttgaaaagattgacagaagaactggtaagaaattggaagaaaatccaaaattcgtcaaatccggtgatgctgctatcgtcaagatggtcccaaccaaaccaatgtgtgttgaagctttcactgactacccaccattaggtagattcgctgtcagagat

SEQ ID NO: 411 - DNA, 1102 bp, Candida albicans; identical to SEQ ID NO: 410
  ref <308>: DATABASE ACCESSION NUMBER: ATCC 90028

SEQ ID NO: 412 - DNA, 1101 bp, Candida dubliniensis
  strain NCPF 3108
cttggataaattgaaggctgaaagagaaagaggtatcaccattgatatcgctttgtggaaattcgaaactccaaaataccacgttaccgtcattgatgctccaggtcacagagatttcatcaagaacatgatcactggtacttctcaagctgattgtgctattttgattattgctggtggtactggtgaattcgaagccggtatttctaaggatggtcaaaccagagaacacgctttgttggcttacactttgggtgtcaaacaattgattgttgctgtcaacaagatggactctgtcaaatgggacaaaaacagatttgaagaaatcatcaaggaaacctctaacttcgtcaagaaggttggttacaacccaaagactgttccattcgttccaatctctggttggaatggtgacaacatgattgaagcttccaccaactgtccatggtacaagggttgggaaaaggaaaccaaatccggtaaggttactggtaagaccttgttagaagctattgatgctattgaaccaccaaccagaccaaccgacaaaccattgagattgccattgcaagatgtttacaagatcggtggtattggtactgtgccagtcggtagagttgaaactggtgtcattaaagccggtatggttgtcacttttgccccagctggtgttaccactgaagtcaaatccgttgaaatgcatcacgaacaattggctgaaggtgttccaggtgacaatgttggtttcaacgttaagaatgtttctgtcaaagaaattagaagaggtaacgtttgtggtgactccaagaacgatccaccaaagggttgtgactctttcaatgcccaagtcattgtcttgaaccatccaggtcaaatctctgctggttactctccagtcttggattgtcacactgcccacattgcttgtaaattcgacactttggttgaaaagattgacagaagaactggtaagaaattggaagaaaatccaaaattcgtcaaatccggtgacgctgctatygtcaagatggtcccaaccaaaccaatgtgtgttgaagctttcactgactacccaccattaggtagattcgctgtcagaga

SEQ ID NO: 413 - DNA, 1098 bp, Candida catenulata
  ref <308>: DATABASE ACCESSION NUMBER: ATCC 10565
ggacaagcttaaggctgagcgtgagagaggtatcaccattgacattgccttgtggaagttcgagactcccaagtaccacgtcactgtcattgacgcccccggtcacagagatttcatcaagaacatgatcactggtacctcgcaggctgactgtgctatcttgatcattgcttccggtgtcggtgagttcgaggctggtatctccaaggacggtcagacccgtgagcacgccttgttggcctacaccttgggtgtcaagcagttgatcgttgccatcaacaagatggactccgtcaagtgggacaagaacagattcgaggagattgtcaaggagaccaccaacttcgtcaagaaggttggttacaaccccaaggctgtccccttcgtccccatctctggctggaacggtgacaacatgattgaggcctccaccaactgcccctggtacaagggctgggagaaggagaccaaggccggtaagtctaccggtaagaccttgttggaggccattgacgccattgagccccctaccagacccaccgacaagcccttgagattgcccttgcaggatgtctacaagatcggtggtattggtacggtgcccgtcggccgtgtcgagaccggtgtcatcaagcccggtatggtcgtcaccttcgcccccgctggtgtcaccactgaagtcaagtccgtcgagatgcaccacgagcagttgtccgagggtgtccccggtgacaacgttggtttcaacgtcaagaacgtctctgttaaggagatcagacgtggtaacgtctgcggtgactccaagaacgacccccccatgggttgctcttctttcaacgcccaggttatcgtgttgaaccaccccggtcagatctctgccggttactctcccgtcttggactgccacaccgcccacattgcttgcaagttcgccgagttgatcgagaagattgacagacgtaccggtaagtccatggaggctaaccccaagttcgtcaagtctggtgacgccgccatcgtcaagatggagcccactaagcccatgtgtgttgaggccttcactgacttccctcctttgggtagattcgccgtcagaga

SEQ ID NO: 414 - DNA, 1102 bp, Candida dubliniensis
  strain NCPF 3949
cttggataaattgaaggctgaaagagaaagaggtatcaccattgatatcgctttgtggaaattcgaaactccaaaataccacgttaccgtcattgatgctccaggtcacagagatttcatcaagaacatgatcactggtacttctcaagctgattgtgctattttgattattgctggtggtactggtgaattcgaagccggtatttctaaggatggtcaaaccagagaacacgctttgttggcttacactttgggtgtcaaacaattgattgttgctgtcaacaagatggactctgtcaaatgggacaaaaacagattcgaagaaatcatcaaggaaacctctaacttcgtcaagaaggttggttacaacccaaagactgttccattcgttccaatctctggttggaatggtgacaacatgattgaagcttccaccaactgtccatggtacaagggttgggaaaaggaaaccaaatccggtaaggttactggtaagaccttgttagaagctattgatgctattgaaccaccaaccagaccaaccgacaaaccattgagattgccattgcaagatgtttacaagatcggtggtattggtactgtgccagtcggtagagttgaaactggtgtcattaaagccggtatggttgtcacttttgccccagctggtgttaccactgaagtcaaatccgttgaaatgcatcacgaacaattggttgaaggtgttccaggtgacaatgttggtttcaacgttaagaatgtttctgtcaaagaaattagaagaggtaacgtttgtggtgactccaagaacgatccaccaaagggttgtgactctttcaatgcccaagtcattgtcttgaaccatccaggtcaaatctctgctggttaytctccagtcttggattgtcacactgcccacattgcttgtaaattcgacactttggttgaaaagattgacagaagaactggtaagaaattggaagaaaatccaaaattcgtcaaatccggtgacgctgctatygtcaagatggtcccaaccaaaccaatgtgtgttgaagctttcactgactacccaccattaggtagattcgctgtcagagat

SEQ ID NO: 415 - DNA, 1102 bp, Candida dubliniensis
  CBS 7987
cttggataaattgaaggctgaaagagaaagaggtatcaccattgatatcgctttgtggaaattcgaaactccaaaataccacgttaccgtcattgatgctccaggtcacagagatttcatcaagaacatgatcactggtacttctcaagctgattgtgctattttgattattgctggtggtactggtgaattcgaagccggtatttctaaggatggtcaaaccagagaacacgctttgttggcttacactttgggtgtcaaacaattgattgttgctgtcaacaagatggactctgtcaaatgggacaaaaacagattygaagaaatcatcaaggaaacctctaacttcgtcaagaaggttggttacaacccaaagactgttccattcgttccaatctctggttggaatggtgacaacatgattgaagcttccaccaactgtccatggtacaagggttgggaaaaggaaaccaaatccggtaaggttactggtaagaccttgttagaagctattgatgctattgaaccaccaaccagaccaaccgacaaaccattgagattgccattgcaagatgtttacaagatcggtggtattggtactgtgccagtcggtagagttgaaactggtgtcattaaagccggtatggttgtcacttttgccccagctggtgttaccactgaagtcaaatccgttgaaatgcatcacgaacaattggttgaaggtgttccaggtgacaatgttggtttcaacgttaagaatgtttctgtcaaagaaattagaagaggtaacgtttgtggtgactccaagaacgatccaccaaagggttgtgactctttcaatgcccaagtcattgtcttgaaccatccaggtcaaatctctgctggttaytctccagtcttggattgtcacactgcccacattgcttgtaaattcgacactttggttgaaaagattgacagaagaactggtaagaaattggaagaaaatccaaaattcgtcaaatccggtgacgctgctatygtcaagatggtcccaaccaaaccaatgtgtgttgaagctttcactgactacccaccattaggtagattcgctgtcagagat

SEQ ID NO: 416 - DNA, 1094 bp, Candida famata
  ref <308>: DATABASE ACCESSION NUMBER: ATCC 62894
aattgaaggctgaaagagaaagaggtatcaccattgatatcgctttatggaaattcgaaactccaaaataccacgttaccgttattgatgctccaggtcacagagatttcatcaagaacatgattactggtacttctcaagctgattgtgctattttrattattgctggtggtgtcggtgaattcgaagccggtatctctaaggatggtcaaaccagagaacacgctttattggcttacaccttaggtgttagacaattgattgttgccgtcaacaagatggactctgttaaatgggacaaggctagattcgaagaaatcatcaaggaaacctctaacttcgtcaagaaggttggttacaaccctaagactgttcctttcgtyccaatttctggatggaacggtgacaacatgattgaagcctccaccaactgtccatggtacaagggttgggaaaaggaaaccaaggctggtaaatctactggtaagactttgttagaagccattgatgccattgaaccaccaaccagaccaaccgaaaagccattgagattaccattacaagatgtctacaagatcggtggtattggtactgtgccagtcggtagagttgaaaccggtgttatcaagggtggtatggttgttacctttgccccagccggtgtcactaccgaagtcaaatccgttgaaatgcaccacgaacaattagctgaaggtgttccaggtgacaatgttggtttcaacgtcaagaacgtttccgttaaggaaatcagaagaggtaacgtttgtggtgactccaagaacgacccaccaaagggtgctgaatctttcaccgctcaagttattgtcttgaaccacccaggtcaratctctgctggttactctccagtcttagattgtcacaccgcccacattgcttgtaaattcgatgctttactcgaaaagattgacagaagatccggtaagaaattagaagacgaaccaaaattcgtcaagtccggtgatgctgctatcgtcaagatggtcccaaccaaaccaatgtgtgttgaagctttcactgaatacccaccattaggtagattcgctgttagagat

SEQ ID NO: 417 - DNA, 1101 bp, Candida glabrata
  ref <308>: DATABASE ACCESSION NUMBER: ATCC 66032
tttggacaagttgaaggctgaaagagaaagaggtatcactatcgatatcgctttgtggaagttcgaaactccaaagtaccacgtyaccgttatcgatgcyccaggtcacagagatttcatcaagaacatgattactggtacttctcaagctgactgtgctatcttgattattgctggtggtgtcggtgaattcgaagcyggtatctccaaggatggtcaaaccagagaacacgctctattggctttcaccctaggtgttagacaattgattgtygctgtcaacaagatggactctgtcaagtgggatgaatccagattcgctgaaatcgttaaggaaacctccaacttcatcaagaaggtcggttacaacccaaagactgttccattcgtcccaatctctggttggaacggtgacaacatgattgaagccaccaccaacgcttcctggtacaagggttgggaaaaggaaaccaaggctggtgtcgtcaagggtaagaccttgttggaagccattgacgctatcgaaccaccaaccagaccaactgacaagccattgagattgccattgcaagatgtctacaagatcggtggtatcggtacggtgccagtcggtagagtcgaaaccggtgtcatcaagccaggtatggttgttaccttcgccccagctggtgttaccactgaagtcaagtccgttgaaatgcaccacgaacaattgactgaaggtttgccaggtgacaacgttggtttcaacgttaagaacgtttccgttaaggaaatcagaagaggtaatgtctgtggtgactccaagaacgacccaccaaaggctgctgcttctttcaacgctaccgtcattgtcttgaaccacccaggtcaaatctctgctggttactctccagttttggactgtcacaccgcccacattgcttgtaagttcgaagaattgttggaaaagaacgacagaagatccggtaagaagttggaagactctccaaagttcttgaagtccggtgacgctgctttggttaagttcgttccatccaagccaatgtgtgtcgaagctttctccgactacccaccattgggtagattcgctgtcagaga

SEQ ID NO: 418 - DNA, 1080 bp, Candida guilliermondii
  ref <308>: DATABASE ACCESSION NUMBER: ATCC 6260
agagaaagaggtatcaccattgacattgctttgtggaaattcgagactccaaagtaccacgttacygtcattgatgccccaggtcacagagatttcatcaagaacatgatcactggtacttctcaagctgactgtgctattttgattattgctggtggtaccggtgaattcgaagctggtatctctaaggatggtcaaaccagagagcacgctttgttggcttacaccttgggtgttagacaattgattgttgctgtcaacaagatggactccgtcaartgggacaagaacagattygaggaaatcatcaaggaaacctctaacttcgtcaagaaggttggttacaaccctaagactgtgccattcgttcctatctctggatggaayggtgacaacatgattgaggcttctaccaactgtccttggtacaagggatgggagaaggagaccaaggctggtaagtccaccggtaagactttgttggaggccattgacgccattgagccacctcaaagaccaaccgacaagccattgagattgccattgcaagatgtytacaagattggtggtattggaacggtgccagtcggtagagttgaaaccggtatcatyaaggccggtatggttgttacctttgccccagctggtgtyaccactgaagtcaagtccgtggaaatgcaccacgaacaattggttgaaggtgttccaggtgacaatgttggtttcaacgttaagaacgtttccgttaaggaaattagaagaggtaacgtttgtggtgactccaagaacgacccaccaaagggttgtgactctttcaccgctcaagttattgtgttgaaccaccctggtcaaatctctgctggttactctccagttttggactgtcacaccgcccacattgcttgtaaattcgacaccttgttggagaagattgacagaagaaccggtaagaagatggaggacaaccccaagtttgtcaagtccggtgacgcttctatcgtcaagatggtgccatccaagccaatgtgtgttgaggctttcaccgactacccaccattgggaagattcgccgtcagagac

SEQ ID NO: 419 - DNA, 751 bp, Candida haemulonii
  ref <308>: DATABASE ACCESSION NUMBER: ATCC 22991
tctgtcaagtgggacaaggccagatacgaggaaatcgtcaaggagacctctaacttcgtcaagaaggttggttacaaccctaagactgttccattcgtcccaatctctggttggaacggtgacaacatgattgaggcttctaccaactgtgactggtacaagggttgggagaaggagaccaagtctggtaagtccaccggtaagaccttgttggaggccattgacgccattgagccaccaaccagaccaaccgacaagccattgagattgccattgcaggatgtctacaagattggtggtatcggaactgtgccagtcggcagagttgagaccggtgttatcaaggccggtatggttgtcaccttcgccccagctggtgtcaccactgaagtcaagtctgtcgagatgcaccacgagcagttgccagagggtgtcccaggtgacaacgttggtttcaacgtcaagaacgtttccgttaaggaaatcagaagaggtaacgtctgtggtgactccaagcaggacccaccaaagggctgtgactctttcaccgctcaggttattgtgttgaaccacccaggtcagatctcttctggttactctccagttttggactgtcacactgcccacattgcttgtaagttcgacaccttggttgagaagatcgacagaagaaccggtaagaagttggaagatgagccaaagttcatcaagtccggtgacgctgctatcgtcaagatggtcccaaccaagc

SEQ ID NO: 420 - DNA, 1102 bp, Candida inconspicua
  ref <308>: DATABASE ACCESSION NUMBER: ATCC 16783
tcttgacaagttaaaggctgaaagagaaagaggtatcactattgatattgctttatggaaattcgaaactccaaagtatcacgttaccgtcattgatgctccaggtcacagagatttcattaagaacatgattactggtacttctcaagcagattgtgctattttgattattgctggtggtgtcggtgaattcgaagctggtatttccaaggatggtcaaactagagaacacgctttattagcattcaccttaggtgttaagcaattgattgttgctatcaacaagatggattctgttaagtgggatgaaaagagatttgaagaaattgtcaaggaaacccaaaacttcatcaagaaggttggttacaacccaaagactgttccattcgttccaatttctggttggaatggtgacaacatgattgaaccatcttctaactgtccatggtacaagggttggactaaggaaaccaaggcaggtgttgtcaagggtaagaccttattagaagctattgatgctattgaaccacctgtcagaccaactgataagccattaagattaccattacaagatgtttacaagattggtggtattggtactgtgccagtcggtagagttgaaaccggtattattaagccaggtatggttgttgttttcgcaccatctggtgttaccactgaagtcaagtccgttgaaatgcaccatgaacaattagaagaaggtgtcccaggtgacaatgttggtttcaacgtcaagaacgtctctgttaaggatatcaagagaggtaacgtttgtggtgactccaagaatgacccaccacaaggttgtgcttccttcaatgctcaagtcattgtcttgaaccaccctggtcaaatttctgctggttactctccagttttagattgtcacactgcccacattgcatgtaaattcgatgaattaattgaaaagattgacagaagaactggtaagtccgttgaagaccatccaaagtctgttaagtctggtgatgcagctatcgttaagatggttccaaccaagccaatgtgtgttgaagctttcactgaatacccaccattaggtagattcgcagtcagagat

SEQ ID NO: 421 - DNA, 1099 bp, Candida kefyr
  ref <308>: DATABASE ACCESSION NUMBER: ATCC 28838
tggacaagttaaaggctgaaagagaaagaggtatcaccatcgatatcgctttgtggaagttcgaaactccaaagtaccaagttaccgttatcgatgctccaggtcacagagatttcatcaagaacatgattactggtacttctcaagctgactgtgctatcttgattattgctggtggtgtcggtgaattcgaagccggtatctccaaggatggtcaaaccagagaacacgctttgttggcttacaccttgggtgttagacaattgattgttgctatcaacaagatggactctgttaagtgggatgaatctcgttaccaagaaattgttaaggaaacctccaacttcatcaagaaggtcggttacaacccaaagaatgttccattcgtcccaatctctggttggaacggtgacaacatgattgaagccaccaccaacgctccatggtacaagggttgggaaaaggaaaccaaggctggtaccgtcaagggtaagaccttgttggaagctattgacgctatcgaaccaccaaccagaccaactgacaagccattgagattgccattgcaagatgtctacaagatcggtggtattggtactgtgccagtcggtagagtcgaaaccggtgtcatcaagccaggtatggttgttaccttcgccccagccggtgtcactaccgaagttaagtccgtcgaaatgcaccacgaacaattggaagaaggtctaccaggtgacaacgtcggtttcaacgtcaagaacgtttccgttaaggaaatcagaagaggtaacgtctgtggtgactccaagaacgatccaccaaaggctgctgcttctttcaacgccactgttatcgtcttgaaccacccaggtcaaatctctgctggttactctccagttttggattgtcacactgctcacattgcttgtaagttcgacgaattgttggaaaagaacgacagaagatccggtaagaagttggaagactctccaaagttcttgaagtctggtgacgctgctttggttaagttcgttccatctaagccaatgtgtgttgaagcattctctgactacccaccattgggtagattcgctgtcagaga

SEQ ID NO: 422 - DNA, 1095 bp, Candida krusei
  ref <308>: DATABASE ACCESSION NUMBER: ATCC 34135
aagttaaaggcagaaagagaaagaggtatcactattgatattgctttatggaagttygaaactccaaartaccacgttaccgttattgatgctccaggtcacagagatttcatcaagaacatgattaccggtacttctcaagctgattgtgctattttgattattgctggtggtgtcggtgaattcgaagctggtatctccaaggatggtcaaactagagaacacgctctattggctttcaccttaggtgttagacaattgattgttgctatcaacaagatggattccgttaartgggatgaaaacagatttgaagaaattgtcaaggaaacccaaaacttcatcaagaaggttggttacaacccaaagactgttccattcgttccaatytctggttggaatggtgacaacatgattgaagcatccaccaactgtccatggtacaagggttggactaaggaaaccaaggcaggtgttgttaagggtaagaccttattagaagcaatcgatgctattgaaccacctgtcagaccaaccgaaaagccattaagattaccattacaagatgtttacaagattggtggtattggtactgtgccagtcggtagagtcgaaaccggtgtcattaagccaggtatggttgtcacttttgctccagcaggtgtcaccaccgaagtcaagtccgttgaaatgcaccatgaacaattagaacaaggtgttccaggtgataacgttggtttcaacgttaagaacgtttctgtcaaggatatcaagagaggtaacgtttgtggtgactccaagaacgacccaccaatgggtgcagcttccttcaatgctcaagtcattgtcttgaaccaccctggtcaaatttccgctggttactctccagtcttggattgtcacactgcccacattgcatgtaagttcgacgaattaatcgaaaagattgacagaagaactggtaagtctgttgaagaccatccaaagtcygtcaagtctggtgatgcagctatcgtcaagatggtcccaaccaagccaatgtgtgttgaagctttcactgaatayccaccattaggtagattcgcagtcagagat

SEQ ID NO: 423 - DNA, 1104 bp, Candida lambica
  ref <308>: DATABASE ACCESSION NUMBER: ATCC 24750
cttggacaagcttaaggctgaaagagaaagaggtatcaccattgatatcgctttatggaagttcgaaactccaaagtaccacgttaccgtcattgacgctccaggtcacagagatttcatcaagaacatgattactggtacctctcaagcagattgtgctattttratyattgctggtggtgtcggtgaattcgaagctggtatctctaaggatggtcaaaccagagaacacgctcttcttgcattcactcttggtgttagacaattgattgttgctatcaacaagatggactctgtcaagtgggacgaatccagattcgatgaaatttgtaaggaaaccgcwaacttcatcaagaaggttggttacaacccaaagactgttccattcgtcccaatctctggttggaacggtgacaacatgattgaaccatctgctaactgtccatggtacaagggatggactaaggaaaccaaggcttccggtgtcgtcaagggtaagacccttcttgaagcaattgatgctattgagccacctgtcagaccaactgacaaggctttgagattgccattrcaagatgtctacaagattggtggtattggtactgtgccagtcggtagagttgaaaccggtatcatcaagccaggtatgattgtcgttttcgctccaaccggtgttactactgaagttaagtccgttgaaatgcaccatgaacaattagaagaaggtgtcccaggtgacaatgttggtttcaacgtcaagaacgtctctgttaaggatattaagagaggtaacgtctgtggtgactccaagaacgacccaccaatgggttgtgcttccttcaatgctcaagtcattgttcttaaccacccaggtcaaatttctgctggttactcaccagttcttgactgtcacactgcccacattgcatgtaagttcgaygaattactcgaaaagattgacagaagaaccggtaaggctactgaagaccatccaaagtctgtcaagtctggtgatgcagctatcgtcaagatggttccaaccaagccaatgtgtgtygaagctttcactgactacccaccattaggtagattcgctgtyagaga

SEQ ID NO: 424 - DNA, 1098 bp, Candida lusitaniae
  ref <308>: DATABASE ACCESSION NUMBER: ATCC 66035
ggacaagttgaaggctgagagagaaagaggtatcaccatcgatatcgctttgtggaagttcgagactccaaagtaccacgttaccgtcattgacgctccaggtcacagagatttcatcaagaacatgatcactggtacttcccaagctgactgtgctatcttgattatcgctggtggtgtcggtgagttcgaagccggtatctctaaggacggtcaaaccagagagcacgctttgttggcttacaccttgggtgtcaagcagttgattgttgctgtcaacaagatggactccgtcaagtgggaccaatctagattcgaggaaatcatcaaggaaacctctaacttcgtcaagaaggttggttacaaccctaagactgttccattcgtcccaatctctggttggaacggtgacaacatgattgagccatcyaccaactgcccatggtacaagggttgggagaaggagaccaagtcyggtaagtccaccggtaagaccttgttggaggccattgacgccattgagccaccttcgagaccaaccgacaagccattgagattgccattgcaagatgtctacaagatyggtggtattggtactgtgccagtcggtagagttgagaccggtgtcatcaaggccggtatggttgtcacctttgctccagctggtgtcaccactgaagtcaagtccgtggaaatgcaccacgaacaattggctgagggtgtcccaggtgacaacgttggtttcaacgtcaagaacgtttccgtcaaggaaatcagaagaggtaacgtctgtggtgactccaagaacgacccaccaaaggctgctgcttcyttcactgctcaagtyatygtcttgaaccacccaggtcaaatctcctcyggttactctccagtyttggactgtcacactgcycacattgcttgtaagttcgacaccttgattgagaagatcgacagaagaacyggtaagaagttggaagaagagccaaagttcatcaagtcyggtgacgctgctatcgtcaagatggtcccaaccaagccaatgtgygtygaagctttcaccgactacccaccattgggtagattcgctgtcagaga

SEQ ID NO: 425 - DNA, 1101 bp, Candida norvegensis
  ref <308>: DATABASE ACCESSION NUMBER: ATCC 22977
tcttgacaagttaaaggctgaaagagaaagaggtatcactattgatattgctttatggaaattcgaaactccaaaataccacgttaccgttattgatgctccaggtcacagagatttcattaagaacatgattactggtacttcccaagctgattgtgctatcttaattattgctggtggtgtcggtgaattcgaagctggtatctccaaggatggtcaaaccagagaacacgctttattagcattcaccttaggtgttaagcaattaattgttgctatcaacaagatggactctgttaagtgggatgaaaagagatttgaagaaattgtcaaggaaacccaaaacttcatcaagaaggttggttacaacccaaagactgttccattcgttccaatttctggttggaatggtgacaacatgattgaaccatctactaactgtccatggtacaagggttggactaaggaaaccaaggcaggtgttgttaagggtaagaccttattagaagctattgatgctattgaaccacctgtcagaccaactgacaagccattaagattaccattacaagatgtttacaagattggtggtattggtactgtgccagtcggtagagttgaaaccggtgttattaagccaggtatggttgttgttttcgcaccatctggtgttaccactgaagtcaagtccgttgaaatgcaccatgaacaattagaacaaggtgtcccaggtgacaatgttggtttcaacgtcaagaacgtctctgttaaggatattaagagaggtaacgtttgtggtgactccaagaacgacccaccacaaggttgtgcttccttcaatgctcaagtcattgtcttgaaccaccctggtcaaatttctgcaggttactctccagttttagattgtcacactgcccacattgcatgtaagttcgatgaattaatcgaaaagattgacagaagaactggtaagtccgttgaagaccatccaaagtctgttaagtctggtgatgcagctatcgttaagatggttccaaccaagccaatgtgtgttgaagctttcactgaatacccaccattaggtagattcgcagtcagaga

SEQ ID NO: 426 - DNA, 1095 bp, Candida parapsilosis
  ref <308>: DATABASE ACCESSION NUMBER: ATCC 90018
caaattgaaggctgaaagagaaagaggtatcaccattgatatcgctttgtggaaattcgaaactccaaaataccatgttactgttattgatgctccaggtcacagagatttcatcaagaatatgattactggtacttctcaagctgattgtgctattttgattattgctggtggtactggtgaattcgaagctggtatctctaaggatggtcaaaccagagaacacgctttgttggcttacaccttgggtgttaagcaattgattgttgccatcaacaagatggactcagtcaaatgggacaagaacagatacgaagaaattgtcaaggaaacttccaacttcgtcaagaaggttggttacaaccctaaagctgtcccattcgtcccaatctctggttggaacggtgacaatatgattgaaccatcaaccaactgtccatggtacaagggttgggaaaaggaaactaaagctggtaaggttaccggtaagaccttgttggaagctatcgatgctatcgaaccaccaaccagaccaactgacaagccattgagattgccattgcaagatgtctacaagattggtggtattggaactgtgccagttggtagagttgaaaccggtatcatcaaggctggtatggttgttacttttgccccagctggtgttaccactgaagtcaagtccgttgaaatgcaccacgaacaattgactgaaggtgtcccaggtgacaatgttggtttcaacgtcaagaacgtttcagttaaggaaatcagaagaggtaacgtttgtggtgactccaagaacgatccaccaaagggatgtgaytccttcaatgctcaagttattgtcttgaaccacccaggtcaaatctctgctggttactcaccagtcttggattgtcacactgcccacattgcttgtaaattcgacactttgattgaaaagattgacagaagaaccggtaagaaattggaagatgaaccaaaattcatcaagtccggtgatgctgcyatcgtcaagatggtcccaaccaagccaatgtgtgttgaagctttcactgactacccaccattgggaagattcgctgttagaga

SEQ ID NO: 427 - DNA, 752 bp, Candida rugosa
  ref <308>: DATABASE ACCESSION NUMBER: ATCC 96275
ctccgtcaagtggtctcagtctcgtttcgaggagatcgtcaaggaggtttccaacttcatcaagaaggttggttacaagcccgatgaggttcctttcgtccccatctctggctggaacggcgacaacatgcttgagccctccaccaactgcccctggtacaagggatggaccaagaagaccaagaagggtgaggtcaagggtaagactcttctcgaggccattgacgccatcgagcccccctcccgtcctaccgacaagcccctccgcttgcctcttcaggatgtctacaagatcggcggtatcggtacggtacctgtcggccgtgtcgagaccggtatcatcaagcccggcatggtcgtcactttcgcccccgctggtgtcaccactgaagtgaagtccgtcgagatgcaccacgagcagatccccgagggtctccccggtgacaacgtcggtttcaacgtcaagaacgttaccgtcaaggatatccgccgtggtaacgtctgcggtgactccaagaacgacccccccaagggctgctcttccttcactgcccaggtcatcgttttcaaccaccccggtcagatctccaacggttactcccccgttttggactgccacaccgcccacattgcctgccgcttcgacgagatccagtccaagatggaccgtcgtactggtaagacccttgaggagaaccccaagttcatcaaggctggtgactccgctatcgtcaagatggttccctccaagc

SEQ ID NO: 428 - DNA, 1093 bp, Candida sphaerica
  ref <308>: DATABASE ACCESSION NUMBER: ATCC 2504
agttaaaggctgaaagagaaagaggtatcaccatcgatatcgctttgtggaagttcgaaactccaaagtaccaagttaccgttatcgatgctccaggtcacagagatttcatcaagaacatgattactggtacttctcaagctgactgtgctatcttgattattgctggtggtgtcggtgaattcgaagccggtatctccaaggatggtcaaaccagagaacacgctttgttggctttcaccttgggtgttagacaattgattgttgctgttaacaagatggattccgttaagtgggatgaatctcgtttccaagaaattgtcaaggaaacctctaacttcatcaagaaggtcggttacaacccaaagactgttccattcgtcccaatctctggttggaacggtgacaacatgattgaagccaccaccaatgcttcatggtacaagggttgggaaaaggaaaccaagtccggtgtcgtcaagggtaagaccttgttggaagctattgacgctatcgaaccaccatccagaccaactgacaagccattgagattgccattgcaagatgtctacaagattggtggtatcggaactgtgccagtcggtagagtcgaaaccggtgttatcaagccaggtatgattgttacctttgccccagccggtgttactactgaagttaagtccgtcgaaatgcaccacgaacaattggaagaaggtctaccaggtgacaacgtcggtttcaacgtcaagaacgtttccgttaaggaaatcagaagaggtaacgtctgtggtgactccaagaacgatccaccaaaggctgctgcttctttcaacgccactgttatcgtcttgaaccatccaggtcaaatctctgctggttactctccagttttggattgtcacactgctcacattgcttgtaagttcgacgaattgttggaaaagaacgatagaagatccggtaagaagttggaagactctccaaagttcttgaagtccggtgatgctgctttggttaagttcgttccatctaagccaatgtgtgttgaagccttctctgactacccacctctaggtagattcgctgtcagaga

SEQ ID NO: 429 - DNA, 1094 bp, Candida tropicalis
  ref <308>: DATABASE ACCESSION NUMBER: ATCC 13803
aaattgaaggctgaaagagaaagaggtatcaccattgatatcgctttgtggaaattcgaaactccaaaataccacgttaccgttattgatgctccaggtcacagagatttcatcaagaacatgattactggtacttcccaagctgattgtgctattttgattattgctggtggtactggtgaattcgaagctggtatttctaaagatggtcaaaccagagaacacgctttgttggcttacaccttgggtgtcaaacaattgattgttgctgtcaacaagatggactctgttaaatgggacaaaaacagatttgaagaaattatcaaggaaacttctaacttcgtcaagaaggttggttacaaccctaaggctgttccattcgttccaatctctggttggaatggtgacaacatgattgaagcttctaccaactgtccatggtacaagggttgggaaaaagaaaccaaggctggtaaggttaccggtaagactttgttggaagccattgatgctattgaaccaccttcaagaccaactgacaagccattgagattgccattgcaagatgtttacaagattggtggtattggtactgtgccagtcggtagagttgaaactggtgtcatcaaagccggtatggttgttactttcgccccagctggtgttaccactgaagtcaaatccgtcgaaatgcaccacgaacaattggctgaaggtgtcccaggtgacaatgttggtttcaacgttaagaacgtttctgttaaagaaattagaagaggtaacgtttgtggtgactccaagaacgatccaccaaagggttgtgactctttcaacgctcaagttattgtcttgaaccacccaggtcaaatctctgctggttactctccagtcttggattgtcacactgctcatattgcttgtaaattcgacaccttggttgaaaagattgacagaagaactggtaagaaattggaagaaaatccaaaattcgtcaaatccggtgatgctgctattgtcaagatggttccaaccaaaccaatgtgtgttgaagctttcactgactacccaccattaggtagattcgctgtcagaga

SEQ ID NO: 430 - DNA, 1095 bp, Candida utilis
  strain Csp 388
caagcttaaagctgagagagagagaggtatcactatcgacattgctctctggaagttcgagactccaaagtaccacgttactgtcattgatgccccaggtcacagagatttcatcaagaacatgattactggtacctcccaggctgactgtgctattcttatcattgccggtggtgttggtgagttcgaggctggtatctctaaggatggtcagaccagagagcacgctttgctcgctttcacccttggtgttagacagatgattgttgctatcaacaagatggactctgtcaagtgggacgagaagagattcgaggagatcgttaaggagacctctaacttcatcaagaaggttggttacaacccaaagactgttccatttgtcccaatttcyggttggaacggtgacaacatgattgaggcctctaccaactgtccatggtacaagggttgggagaaggagaccaaggctggtgttgtcaagggtaagaccttgctcgatgccattgacgccattgagccaccaacaagaccaactgacaagccattgagattgccactccaggatgtctacaagattggtggtatcggaactgttccagtcggtagagtcgagaccggtgtcatcaagccaggtatggttgttacctttgccccatccggtgtcaccactgaggttaagtccgtcgagatgcaccacgagcagcttgctgagggtatcccaggtgacaacgttggtttcaacgttaagaacgtctctgttaaggagatcagaagaggtaacgttgccggtgactccaagaacgacccaccacagggtgctgagtccttcaacgctcaggtcattgtcttgaaccacccaggtcagatctctgctggttactctccagttttggactgtcacaccgcccacattgcttgtaagttctctgagcttttggagaagattgacagaagatccggtaagtcccttgaggcctctccaaagttcgtcaagtctggtgatgccgctatcgtcaagatggttccatccaagccattgtgtgttgaggccttcactgactacccaccactcggtagattcgctgtcagaga

SEQ ID NO: 431 - DNA, 1085 bp, Candida viswanathii
  ref <308>: DATABASE ACCESSION NUMBER: ATCC 28269
gctgaaagagaaagaggtatcaccatcgatatcgctttgtggaaattcgaaactccaaartaccacgttaccgtcattgaygctccaggtcacagagatttcatcaagaacatgatyactggtacttctcaagctgattgtgctatyttgattatcgctggtggtactggtgaattcgaagctggtatytctaaggatggtcaaaccagagaacacgctttgttggcctacaccttgggtgtcaagcaattgattgttgctgtcaacaagatggactctgtcaaatgggacaagaacagattcgaagaaatcatcaaggaaacctccaacttcgtcaagaaggttggttacaacccaaagactgttccattcgtcccaatctctggttggaacggtgacaacatgattgaagcctccaccaactgcccatggtacaagggttgggaaaaggaaaccaaggctggtaaggttaccggtaagactttgttggaagccattgacgctatcgaaccaccaaccagaccaactgacaagccattgagattgccattgcaagatgtctacaagattggtggtatcggaactgtgccagtcggtagagttgaaactggtgtcatcaaggccggtatggttgtcactttygccccagctggtgttaccactgaagtcaagtccgttgaaatgcaccacgaacaattggctgaaggtgtcccaggtgacaacgttggtttcaacgtcaagaacgtttccgtcaaggaaatcagaagaggtaacgtctgtggtgactccaagaacgacccaccaaagggttgtgastctttcaacgctcaagtcattgtcttgaaccacccaggtcaaatctctgctggttactctccagtcttggattgtcacactgcccacattgcttgtaagtttgacaccttggttgaaaagattgacagaagaaccggtaagaagttggaagaaaacccaaagtttgtcaagtccggtgacgctgctatcgtcaagatggtcccaaccaagccaatgtgtgttgaagcyttcactgactacccaccattgggtagattcgctgtcagaga

SEQ ID NO: 432 - DNA, 1072 bp, Candida zeylanoides
  ref <308>: DATABASE ACCESSION NUMBER: ATCC 7351
aggtattaccattgacattgccttgtggaagttcgagacccccaagtaccaggtcaccgtcattgacgctcctggccacagagatttcattaagaacatgatcactggtacctcccaggctgactgtgccatcttgatcattgctggtggtgttggtgagttcgaggctggtatctccaaggatggccagaccagagagcacgccttgcttgcctacaccttgggtgtcaagcaattgattgttgctgtcaacaagatggactccgtcaagtgggacaagaacagattcgaggagattgtcaaggagacctccaacttcgtcaagaaggttggctacaaccccaagactgtccccttcgttcccatctccggttggaacggtgacaacatgattgaggcctccaccaactgcccttggtacaagggttgggagaaggagaccaaggccggtaaggtcactggtaagaccttgttggaggctattgacgccattgagccccccaccagacccaccgacaagcccttgagattgcccttgcaggatgtctacaagattggtggtattggaacggtgcccgttggcagagttgagaccggcatcatcaaggccggtatggttgtcacctttgcccccgctggtgtcactactgaagtgaagtctgtcgagatgcaccacgagcaattggctgagggtgtcccaggtgacaatgttggtttcaacgtgaagaacgtttccgttaaggagatcagaagaggtaacgtttgcggtgactccaagaacgacccccccaaggctgctgcttctttcaacgcccaggttatcgtcttaaaccaccccggtcaaatctctgctggttactctccggttttggattgccacactgcccacattgcttgcagattcgaccagttgattgagaagatcgacagaagaaccggtaagaagatggaggacgaccctaagttcatcaagtccggtgacgctgccatcgtcaagatggttccttccaagcccatgtgtgttgaggccttcactgactaccctcccttgggtcgtttcgctgtcagagac

SEQ ID NO: 433 - DNA, 751 bp, Coccidioides immitis
  strain Silveira
agcaccaactggtccgagcctcgtttcaacgaaatcgtcaaggaagtctccaacttcatcaagaaggtcggatacaaccccaaggctgttccattcgtccccatctctggtttcgaaggtgacaacatgattcaaccctccaccaacgctccttggtacaagggctggaacaaggagaccgcctctggcaagcacactggcaagaccctcctcgacgccattgatgccatcgaccccccaacccgccccaccgagaagcccctccgtctcccacttcaggatgtgtacaagatctctggtatcggaacagtcccagtcggccgtgtcgaaaccggtgttatcaagcctggtatggttgtgaccttcgctccttccaacgtcaccactgaagtcaagtccgtcgaaatgcaccaccagcagctcacccagggtaaccctggtgacaacgttggcttcaacgtcaagaacgtctctgtcaaggaagtccgccgcggtaacgtcgctggtgactccaagaacgacccaccaaagggctgcgactccttcaacgcccaggtcatcgtcctcaaccaccctggtcaagtcggtgctggttatgccccagtccttgactgccacactgcccacattgcttgcaagttctccgagctcctcgagaagatcgaccgccgtaccggtaaatccgttgagaacaaccccaagttcatcaagtctggtgatgccgctatcgtcaagatggttccatccaagc

SEQ ID NO: 434 - DNA, 1146 bp, Cryptococcus albidus
  ref <308>: DATABASE ACCESSION NUMBER: ATCC 66030
aagctcaaggccgagcgagagcgaggtatcaccatcgacatcgccttgtggaagttcgagacccccaagtacaatgtcaccgtcattgacgcccccggtcaccgagacttcatcaagaacatgatcaccggtacctcgcaggccgactgtgccatcctcatcatcgcctccggtatcggagagttcgaggctggtatctccaaggacggtcagacccgagagcacgcccttttggccttcaccctcggtgtccgacagctcatcattgccatcaacaagatggacacctgcaaggttagttcgcaggtcctggtctctgtacgaatcttgctgaccccttttacagtggtccgaagaccgatacaacgaaatcgtcaaggaggcttccggtttcatcaagaaggtcggatacaaccccaagaccgttcccttcgtccccatctccggatggcacggagacaacatgttggaggagtccaccaacatgccctggtacaagggatggcacaaggagtccaaggccggtgttgtcaagggaaagaccttgctcgaggccatcgacgccatcgagccccctacccgaccttccgacaagcccttgcgattgcccctccaggatgtctacaagatcggtggtatcggtacggtgcccgtcggtcgagtcgagaccggtgtcatcaaggctggtatggtcgtcaccttcgcccctgccaacgtcaccaccgaagtcaagtccgtcgaaatgcaccacgaacagctcgctgagggtgttcccggtgacaacgtcggtttcaacgtcaagaacgtttccgtcaaggacatccgacgaggaaacgtctgctccgactcgaagaacgaccccgctatggagtctgcttccttcaacgctcaggtcattgtcttgaaccacccgggtcagatcggtgccggctactcccccgttttggactgccacaccgctcacattgcctgcaagttcgctgagctcgttgagaagatcgaccgacgaaccggtaaggtcatggaggccgcccccaagttcgtcaagtccggtgacgccgccatcgtcaagttgatcccgtccaagcccatgtgtgtcgagtcctactccgagtacccccccttgggtcgattcgccgtccgaga

SEQ ID NO: 435 - DNA, 1095 bp, Exophiala jeanselmei
  ref <308>: DATABASE ACCESSION NUMBER: ATCC 64755
caagctgaaggccgagcgtgagcgtggtatcaccatcgatatcgccttgtggaagttcgagactcccaagtactatgtcactgtcatcgacgcccctggtcatcgtgactttatcaagaacatgatcactggtacttcccaggctgactgcgccattctcatcattgccgccggtactggtgaattcgaagccggtatctccaaggatggtcagactcgtgagcacgctctgctcgcctacaccctgggtgtcaagcagctcattgtcgccatcaacaagatggacaccaccaagtggtccgaggatcgtttcaacgaaatcatcaaggagacttccagcttcatcaagaaggtcggctacaaccccaagtccgttcctttcgtccccatctccggcttcaacggtgacaacatgatcgatgtctccaccaactgcccctggtacaagggctgggagaaggagaccaaggctggcaaggcctctggcaagactctcctcgaggccatcgacgccatcgacccccccactcgtcccaccgacaagcctctccgtcttcctctccaggatgtctacaagatctctggtatcggaacggtgcccgtcggtcgtgttgagactggtgtcatcaaggccggtatggtcgttaccttcgctcctgccaacgtcaccactgaagtcaagtccgtcgaaatgcaccacgaacaactcgccgagggtgttccaggtgacaacgttggtttcaacgtcaagaacgtctccgtcaaggaggttcgtcgtggaaacgtctgcggtgactccaagaacgacccacccaagggtgctgattccttcaacgcccaggtcatcgtcttgaaccaccctggtcaagtcggtgctggctacgccccagtgttggattgccacactgcccacattgcttgcaagttctctgagcttctcgagaagattgaccgccgtaccggtaaatccatcgaaaacaaccccaagttcatcaagtctggtgacgctgccatcgtcaagatggttcccagcaagcccatgtgtgttgaggccttcactgactacccacctcttggtcgtttcgccgtccgtga

SEQ ID NO: 436 - DNA, 1113 bp, Fusarium oxysporum
  strain WSA-212
aagctcaaggccgagcgtgagcgtggtatcaccatcgatattgctctctggaagttcgagactcctcgctactatgtcaccgtcattggtatgttgtcgctcatgcttcattctacttctcttcgtactaacacatcactcagacgctcccggtcaccgtgatttcatcaagaacatgatcactggtacttcccaggccgattgcgccattctcatcattgccgccggtactggtgagttcgaggctggtatctccaaggatggccagacccgtgagcacgctcttcttgcctacacccttggtgtcaagaacctcatcgtcgccatcaacaagatggacaccaccaagtggtctgaggcccgttaccaggagatcatcaaggagacctcctctttcatcaagaaggtcggctacaaccccaaggctgtcgctttcgtccccatctccggtttcaacggtgacaacatgcttaccccctccaccaactgcccctggtacaagggttgggagcgtgagatcaagtccggcaagctcactggcaagaccctcctcgaggccattgactccatcgagccccccaagcgtcccgttgacaagccccttcgtcttccccttcaggatgtctacaagatcggtggtattggaacggttcccgtcggccgtatcgagactggtgtcatcaagcccggtatggtcgttaccttcgctccttccaacgtcaccactgaagtcaagtccgtcgagatgcaccacgagcaactcactgagggccagcccggtgacaacgttggtttcaacgtgaagaacgtctccgtcaaggacatccgacgtggtaacgtcgctggtgactccaagaacgacccccctatgggtgccgcttctttcaccgcccaggtcatcgtcctcaaccaccccggtcaggtcggtgctggttacgctcccgtcctcgattgtcacactgcccacattgcctgcaagttcgccgagatccaggagaagatcgaccgccgaaccggtaaggctactgaggccgcccccaagttcatcaagtctggtgactccgccatcgtcaagatggttccctccaagcccatgtgtgttgaggctttcac

SEQ ID NO: 437 - DNA, 726 bp, Geotrichum spp.
  strain LEV-4
ggtccgaggacagattcaacgagattgtcaaggagacttccaacttcatcaagaaggttggttayaaccccaagactgttgctttcgtccccatctctggttggaacggtgacaacatgattgagccctccaccaactgcccctggtacaagggatggcagaaggagaccaaggctggtgtcactaagggtaagaccctccttgaggccatcgatgccattgagccccctgtcagaccttccgacaagcccctccgtcttcccctccaggatgtctacaagatcggtggtatcggaactgtgcccgtcggccgtgtcgaaaccggtgtcatcaaggccggtatggtcgtcaccttcgcccccgctggtgtcaccactgaagtcaagtccgtcgagatgcaccacgagctcctcactgagggtctccccggtgacaacgttggtttcaacgtcaagaacgtctccgttaaggatatcagacgtggtaacgtctgcggtgactccaagaacgatccccccaaggcttgcgcttctttcaacgcccaggtcattatcttcaaccaccctggtcagatctctgctggatactctcccgtccttgattgccacaccgcccatattgcttgcaagttcgacactttgatcgagaagattgaccgtcgtactggtaagaagactgaggactcccccaagttcgtcaaggccggtgatgctgctatcgtcaaga

SEQ ID NO: 438 - DNA, 754 bp, Histoplasma capsulatum
  strain G186A5
caccaccaagtggtccgagtcccgtttcaacgaaatcatcaaggaggtttccaacttcatcaagaaggtcggatataaccccaaggctgttcccttcgtgccaatctctggtttcgagggtgacaacatgattgaaccctcccccaactgcacatggtacaagggctggaacaaggagactgcctctggcaagtcttctggtaaaacccttctcgatgccattgacgccattgaacccccaacccgtcctaccgataagcccctccgtcttcccctccaggatgtgtacaaaatctctggtattggcactgttcccgtcggacgtgttgagactggtgtcatcaagcccggtatggtcgtgactttcgctccctccaacgtcaccactgaagtcaagtccgtcgaaatgcaccaccaacaactccaggctggttaccctggcgacaacgtcggcttcaacgtcaagaacgtttcagtcaaggaagtccgccgtggcaacgttgctggcgactccaaaaatgatccccctaagggctgcgaatccttcaatgcccaggtcatcgtccttaaccaccccggccaggttggcgctggttatgccccagtcctcgactgccacactgcccacattgcttgcaagttctctgagcttattgagaagatcgaccgccgtaccggaaagtctgttgagaacaaccccaagttcatcaagtctggtgatgctgctatcgtcaagatggttccctccaagccc

SEQ ID NO: 439 - DNA, 743 bp, Issatchenkia orientalis
  ref <308>: DATABASE ACCESSION NUMBER: ATCC 6258
tgggatgaaaacagatttgaagaaattgtcaaggaaacccaaaacttcatcaagaaggttggttacaacccaaagactgttccattcgttccaatctctggttggaatggtgacaacatgattgaagcatccaccaactgtccatggtacaagggttggactaaggaaaccaaggcaggtgttgttaagggtaagaccttattagaagcaatcgatgctattgaaccacctgtcagaccaaccgaaaagccattaagattaccattacaagatgtttacaagattggtggtattggtactgtgccagtcggtagagtcgaaaccggtgtcattaagccaggtatggttgtcacttttgctccagcaggtgtcaccaccgaagtcaartccgttgaaatgcaccatgaacaattagaacaaggtgttccaggtgataacgttggtttcaacgttaagaacgtctctgtcaaggatatcaagagaggtaacgtttgtggtgactccaagaacgacccaccaatgggtgcagcttcyttcaatgctcaagtcattgtcttgaaccaccctggtcaaatttccgctggttactctccagtcttggattgtcacactgcccacattgcatgtaagttcgacgaattaatcgaaaagattgacagaagaactggtaagtctgttgaagaccatccaaagtcygtcaagtctggtgatgcagctatcgtcaagatggtcccaaccaagcc

SEQ ID NO: 440 - DNA, 1091 bp, Malassezia furfur
  ref <308>: DATABASE ACCESSION NUMBER: ATCC 42132
caagctcaaggctgagcgtgagcgtggtatcaccatcgacattgctctgtggaagttcgagacccctaagtaccacgttaccgtcattgacgctcctggtcaccgtgacttcatcaagaacatgattacgggtacctcgcaggctgactgcgctatcctcatcattgccggtggtaccggtgagttcgaggctggtatctcgaaggacggtcagacccgtgagcacgctctgctcgctttcaccctgggtgtgcgtcagctcattgtggccgtcaacaagatggacaccaccaagtactcggaggaccgcttcaacgagattgtccgcgaagtgtcgaacttcatcaagaaggtcggtttcaaccccaagactgttgccttcgtccccatctcgggctggcacggtgacaacatgatcgaggccaccaccaacatgccttggtacaagggctgggagaaggagaccaagtcgggcaaggtcactggtaagactctgctggacgccatcgacgccatcgagcccccgacccgccccactgacaagcccctgcgtctccctctgcaggatgtgtacaagatcggtggtatcggtactgtccctgtcggtcgtgttgagaccggtgtgatcaagcccggtatggttgtgaccttcgctccctcgaacgtcaccactgaagttaagtcggttgagatgcaccacgagtcgctccctgagggtctccccggtgacaacgttggtttcaacgtgaagaacgtctcggttaaggacattcgccgtggtaacgttgcctcggactcgaagaacgaccccgctcaggaggctgcttcgttcaacgcgcaggtcattgtcatgaaccaccctggtcagatcagcaacggttactcgcccgtgcttgactgccacactgcgcacattgcctgccgcttcaacaacatcctccagaagatcgaccgtcgctcgggtaaggtgcttgaggagaaccccaagttcatcaagtcgggtgacgctgccatggtggagatgatccccaccaagcccatgtgtgtggagtcgttcaacgagtacccccctctgggtcgtttcgctgtgc

SEQ ID NO: 441 - DNA, 749 bp, Malassezia pachydermatis
  ref <308>: DATABASE ACCESSION NUMBER: ATCC 42756
accaccaagtactcggaggaccgcttcaacgagattattcgcgagacttcgaacttcatcaagaaggtcggttacaacccgaagactgttgccttcgtcccgatctcgggctggcacggtgacaacatgattgaggcgaccaccaacatgccgtggtacaagggctgggagaaggagaccaagtcgggcaaggccactggtaagacccttctggacgctattgacgccattgagccgccgacgcgcccgaccgacaagcctctccgtcttcctctccaggatgtgtacaagatcggtggtatcggtacygtcccggtcggccgtgttgagaccggtgttatcaagcccggtatggttgtgaccttcgctccgtcgaacgtcacsactgaagttaagtcggtcgagatgcaccacgagcagatccctgagggtcttccgggtgacaacgttggtttcaacgtgaagaacgtgtcggtcaaggacattcgccgtggtaacgtcgcctcggactcgaagaacgacccggctcaggaggctgcctcgttcaatgctcaggtcattgtgatgaaccaccctggtcagatcagcaacggttactcgccrgtgctcgactgccacactgctcacattgcctgccgcttcaacaacatcctccagaagatcgaccgtcgttcgggtaaggttctygaagagaaccccaagttcatcaagtcgggtgacgctgccatggttgagatgatcccgaccaa

SEQ ID NO: 442 - DNA, 1150 bp, Malbranchea filamentosa
  ref <308>: DATABASE ACCESSION NUMBER: ATCC 48174
actgaaggccgagcgtgagcgtggtatcaccatcgatatcgccctctggaagttcgagacccccaagtaccatgtcaccgtcattggtacgttcgacatgttcgaccttttgcctagtgtccccttctaaccacagtttatagacgcccctggccatcgtgatttcgtcaagaacatgatcactggtacttcccaggctgattgcgctatcctcatcattgcttccggcactggtgaattcgaggctggtatctccaaggatggccagacccgtgagcacgctctgctttccttcaccctcggtgttaggcagctcattgtcgccctcaacaagatggacactgtcaacttcgctgaggcccgttacaacgagattgtcaaggaagtctccaacttcatcaagaaggtcggctacaaccccaaggccgttcctttcgtccccatctccggtttcgagggtgacaacatgatcgaggcctccacccgcattccttggtacaagggctggaacaaggagaccgccagtggcaagagcaccggcaagaccctyctcgaggccattgatgccatcgaacccccggtccgtcccaccgacaagcccctycgtctccctcttcaggatgtgtacaagatctccggtattggcactgttcctgtcggtcgtgttgagactggtgtcatcaagcctggtatggtcgttactttcgcccccgccaacgtcaccactgaagtcaagtccgtcgagatgcaccaccagcagctccaggccggtaaccccggtgacaacgtcggcttcaacgtcaagaacgtttccgtcaaggaagtccgccgtggcaacgttgcctccgactccaagaacgaccccgccaagggctgcgactccttcaacgcccaggtcatcgtccttaaccaccccggtcaggtcggtgctggatacgctcccgtcctcgattgccacactgcccacattgcttgcaagttctctgagcttcttgagaagatcgatcgccgtaccggtaaatccgttgaggaccaccccaagttcatcaagtctggtgatgccgctatcgtcaagatggttccctccaagcctatgtgcgttgaggctttcactgactaccctccccttggtcgtttcgccgtccgtgac

SEQ ID NO: 443 - DNA, 1099 bp, Metschnikowia pulcherrima
  DSM 70336
ggacaagttgaaggctgagagagagagaggtatcaccatcgacattgccttgtggaagttcgagactcctaagtaccacgtcaccgtyattgacgccccaggtcacagagatttcatcaagaacatgatcactggtacttcccaggctgactgtgcyatcttgattatcgcyggtggtgttggtgagttcgaggctggtatctccaaggatggccagaccagagagcacgctttgttggcytacaccttgggtgttagacarttgattgttgccgtcaacaagatggactctgtcaagtgggacaagaacagatttgaggagatcatcaaggagacctctaacttcgtcaagaaggttggttacaaccctaagacygtgccattcgtgccaatytctggttggaacggtgacaacatgattgaggcytccactaactgcccatggtacaagggttgggagaaggagaccaaggccggtaagtctwccggtaagaccttgttggaggccattgacgccattgagccaccaaccagacctaccgacaaggccttgagattgcctttgcaggatgtctacaagatcggtggtatcggaacggtgccagtcggccgtgtcgagaccggtgtcattaaggccggtatggttgtyaccttygccccagctggtgtcaccactgaggtcaagtccgtcgagatgcaccacgagcagttggtcgagggtcttccaggtgacaaygttggtttcaacgtcaagaacgtctccgttaaggagatcagaagaggtaacgtctgtggtgactccaagcaggacccaccaaagggtgccgcttctttcaccgcycaggttattgtgttgaaccaccctggtcagatctcctctggttactctccagtgttggactgycacaccgcccacattgcctgtaarttcgacaccttgttggagaagattgacagaagaactggtaagtccttggagtcygagcctaagttcgtcaagtcyggtgacgccgccattgtcaagatggtgccaaccaagccaatgtgtgttgaggctttcaccgactacccacctttgggtagattcgccgtcagagac

SEQ ID NO: 444 - DNA, 1153 bp, Paecilomyces lilacinus
  ref <308>: DATABASE ACCESSION NUMBER: ATCC 42570
caagctcaaggccgagcgtgagcgtggtatcaccatcgacattgccctctggaagttcgagactcccaagtactatgtcaccgtcattggtacgtcgactcgcgcgagactggtcgcaatttccacgtcgctaacgtgcttgaacagacgctcccggccaccgtgacttcatcaagaacatgatcactggtacctcccaggctgactgcgctatcctcattatcgctgccggcactggtgagttcgaggctggtatctccaaggatggccagacccgtgagcacgctctgctcgcctacaccctcggtgttaagcagctcatcgtcgctatcaacaagatggacaccaccaagtggtctgaggcccgtttccaggagatcatcaaggagacctccaacttcatcaagaaggtcggctacaaccccaagaccgtcgctttcgtccccatctctggtttccacggcgacaacatgctttccccctccaccaactgcccctggtacaagggctgggagaaggagaccaaggctggcaagtccaccggcaagaccctccttgaggccatcgactccatcgagccccccaagcgccccagcgacaagcccctccgccttccccttcaggatgtgtacaagatcggcggtatcggcacagtccctgtcggccgtatcgagactggtgtcatcaagcccggcatggtcgtgaccttcgctccttccaacgtcaccaccgaagtcaagtccgttgagatgcaccacgagcagctctccgagggtgtccccggtgacaacgtcggcttcaacgtcaagaacgtctccgtcaaggagatccgtcgtggcaacgtcgccggtgactccaagaacgacccccctctgggtgccgcttctttcgatgcccaggtcatcgtcctcaaccaccccggccaggtcggtgctggctacgcccccgtcctcgactgccacaccgcccacattgcctgcaagttcgccgagatcaaggagaagatcgaccgccgtaccggcaagtctgtcgagtccgcccccaagttcatcaagtctggcgactctgccatcgtcaagatgattccctccaagcccatgtgcgttgaggctttcaccgactaccctcctctgggccgcttcgccgtccgtga

SEQ ID NO: 445 - DNA, 763 bp, Paracoccidioides brasiliensis
  ref <308>: DATABASE ACCESSION NUMBER: ATCC 32071
taccactaagtggtccgagacccgattcaatgaaattatcaaggaagtcaccaatttcattaagaaggtcggatataaccccaagactgttcctttcgttcccatttctggtttcgagggtgacaacatgatcgagccctctgccaactgcccatggtacaagggctggtccaaggagactgctcagggcaagtactctggcaagacccttcttgaggccatcgacgccattgagccccccacccgtcctaccgataaacctctccgtcttcccctccaggatgtctacaagatctccggtattggcactgttcctgtcggacgtgttgagactggagtcatcaagcccggtatggtcgtgaccttcgctcccgccaacgtcaccactgaagtcaagtccgtcgaaatgcaccaccagcagcttaccgccggtaaccccggtgacaacgtcggcttcaacgtcaagaatgtttccgtcaaagaagtccgccgtggtaacgttgccggtgactctaagaatgatcccccaaagggctgcgattccttcaatgcccaggtcatcgtcctcaaccaccctggtcaggttggcgctggttatgccccagtcctcgactgccatactgcccacattgcctgcaaattcgctgagctccttgagaagattgatcgacgaaccggaaagtctgttgagaacaaccccaagttcatcaagtccggtgatgctgctatcgtcaagatgattccttccaagcccatgtgcgtc

SEQ ID NO: 446 - DNA, 1346 bp, Penicillium marneffei
  ref <308>: DATABASE ACCESSION NUMBER: ATCC 64101
aagctcaaggctgagcgtgagcgtggtatcaccatcgatattgctctctggaagttccagactgccaagtacgaggttaccgtcattgacgcccccggtcaccgtgatttcatcaagaacatgatcactggtacctcccaggccgattgcgctattctcatcattgcctctggtactggtgaattcgaggctggtatctccaaggatggccagactcgtgagcacgctcttttggctttcaccctcggtgtccgtcagctcattgttgccctcaacaagatggacacttgcaagtggtctcagggtgagtactcgtacctgcgtttggccttgaatatcttactaatgcaccatagatcgttacaacgaaattgtcaaggagacttccaacttcatcaagaaggtcggatacaaccccaagaacgttcctttcgttcctatctccggtttcaacggtgacaacatgcttgagccctcccccaactgcccctggtacaagggttgggagaaggagaccaaggccggtaaggtcactggtaagaccctcctcgaggccatcgacgccattgagccccctacccgtcccgccaacaaggttagtccctcctcgactactcaaaccctcctcataagttcagattactgactcgttcacagcccctccgtcttcccctccagratgtctacaagatcggtggtattggaacggttcccgtcggtcgtgttgagactggtaccatcgttcctggtatggttgtcaccttgtaagtcactctcctcgcttatcctacctgaaatcatcatgtgctaacttgacactcagcgctcccgccaacgtcaccactgaagtcaagagtgttgaaatgcaccaccagcagctcactgccggtcagcccggtgacaacgttggtttcaacgtgaagaacgtctccgtcaaggaaatccgtcgtggtaacgttgctggtgacagcaagaacgacccccctgccggtgctgcctccttcaacgcccaggtcatcgtcctcaaccaccccggtcaggtcggtgctggttacgccccagtcctcgattgccacactgcccacattgcttgcaagttcgctgagctcctcgagaagattgaccgtcgtaccggaaagtctgttgaggaccaccccaagttcatcaagtccggtgacgctgccatcgtcaagatgattccttccaagcccatgtgtgttgaggctttcaccgagtaccctcctctcggtcgtttcgccgttcgcgagtaagttttatctccgttgtctattttccatccttcccttctcctccgtcttccatatatactttttcagttatatgtg

SEQ ID NO: 447 - DNA, 1094 bp, Pichia anomala
  misc_feature (1)...(1094): n=a,t,c or g
  ref <308>: DATABASE ACCESSION NUMBER: ATCC 18205
aagttaaaagctgaacgtgaaagaggtatcactattgatattgctttatggaaattcgaaactccaaaataccatgttaccgttattgatgctccaggtcacagagatttcatcaaaaatatgattactggtacttcccaagctgattgtgctatyttaattattgccggtggtattggtgaattcgaagctggtatctcaaaagatggtcaaaccagagaacacgctttnttagcttacaccttaggtgttaaacaattgattgttgctatcaacaagatggattccgttaaatgggatgaatctcgtttcgaagaaattgtcaaggaaacytcaaactttatcaagaaagttggttacaacccaaaaactgttccattcgttccaatctcaggttggaatggtgataacatgattgaaccatcawctaactgtccatggtacaaaggttggaaaaaagaaaccaaagctggtgaagctaaaggtaaaactttattagaagccattgatgctattgacccaccatcaagaccaactgataaaccattacgtttaccattacaagatgtttacaarattggtggtattggtactgtgccagtcggtagagttgaaaccggtgttatcaaaccaggtatggttgttacctttgccccagctggtgttaccactgaagtcaaatctgttgaaatgcatcatgaacaattgactgaaggtttaccaggtgacaatgttggtttcaacgttaagaatgtttctgttaaagaaatccgtcgtggtaacgtctgtggtgactctaaaaacgatccaccaaaagctgctgaatcattcaatgctcaagttattgtcttaaaccatccaggtcaaatctctgctggttactctccagttttagattgtcacactgctcacattgcttgtaaatttgacactttaattgaaaaaattgacagacgtactggtaagaaattagaagaagctccaaaattcatcaaatcaggtgatgctgctattgttaaatttgttccatcaaaaccattatcagttgaagctttcactgactacccaccattaggtcgtttcgctgtcagaga

SEQ ID NO: 448 - DNA, 1100 bp, Pichia anomala
  ref <308>: DATABASE ACCESSION NUMBER: ATCC 2149
cttagataagttaaaagctgaacgtgaaagaggtatcactattgatattgctttatggaaattcgaaactccaaaataccatgttaccgttattgatgctccaggtcacagagatttcatcaaaaatatgattactggtacttcccaagctgattgtgctatmttaattattgccggtggtattggtgaattcgaagctggtatctcaaaagatggtcaaaccagagaacacgctttrttagcttacaccttaggtgttaaacaattgattgttgctatcaacaagatggattccgttaaatgggatgaatctcgtttcgaagaaattgtcaaggaaacytcaaactttatcaagaaagttggtacaacccaaaaactgttccattcgttccaatctcaggttggaatggtgataacatgattgaaccatcaactaactgtccatggtacaaaggttggaaaaaagaaaccaaagctggtgaagctaaaggtaaaactttattagaagccattgatgctattgatccaccatcaagaccaactgataaaccattacgtttaccattacaagatgtttacaarattggtggtattggtactgtgccagtcggtagagttgaaaccggtgttatcaaaccaggtatggttgttacctttgccccagctggtgttaccactgaagtcaaatctgttgaaatgcatcatgaacaattgactgaaggtttaccaggtgacaatgttggtttcaacgttaagaatgtttctgttaaagaaatccgtcgtggtaacgtctgtggtgactctaaaaacgatccaccaaaagctgctgaatcattcaatgctcaagttattgtcttaaaccatccaggtcaaatctctgctggttactctccagttttagattgtcacactgctcacattgcttgtaaatttgacactttaattgaaaaaattgacagacgtactggtaagaaattagaagaagctccaaaattcatcaaatcaggtgatgctgctattgttaaatttgttccatcaaaaccattatcagttgaagctttcactgactacccaccattaggtcgtttcgctgtcagaga

SEQ ID NO: 449 - DNA, 1201 bp, Pseudallescheria boydii
  ref <308>: DATABASE ACCESSION NUMBER: ATCC 44331
caagctcaaggccgagcgtgagcgtggtatcaccatcgatatcgccctctggaagttcgagacccccaagtaccaggtcaccgtcattggtatgtctttgtgctttttgtgctttttgtgcctgtgcctcgcacaattccagccctcgataattatgaacctcgtactaatatgtcgttctcccactacccacagacgcccccggccatcgtgatttcatcaagaacatgattactggtacctcccaggctgattgcgccattctcatcattgcctccggtactggtgagttcgaggctggcatctccaaggatggccagacccgtgagcacgctcttctcgccttcaccctcggtgtcaagaacctcattgttgccatcaacaagatggacaccaacaactggtccgaggaccgatacaaggagatcatcaaggagacctccaacttcatcaagaaggtcggctacaaccccaaggccgttcctttcgtccccatctccggtttccacggagacaacatgcttaccccctccaccaactgcccctggtacaagggttgggtccgtgaggtcaagggtaacacccttaccggcaagacccttctcgaggccatcgactycatcgagccccccaagcgtcccaccgagaagcccctccgtcttccccttcaggacgtctacaagatcggtggtattggcactgtgcccgtcggccgtatcgagaccggtatcctcaagcccggtatggtcgtcaccttcgctccctccaacgtcaccactgaagtcaagtccgtcgagatgcaccacgagcagcttaccgagggtgtccccggtgacaacgttggtttcaacgtgaagaacgtctccgtcaaggatatccgccgtggcaacgtctgcggtgactccaagaacgacccccccgctgctgccgcctctttccaggcccaggtcattgtcctcaaccaccccggccagatcggtgctggttacgctcccgttcttgactgccacactgcccacattgcttgcaagttcgccgagctccttgagaagatcgaccgccgtaccggtaagtcggtcgagaacaaccccaagttcgtcaagtctggtgatgccgccatcgtcaagatggttccctccaagcccatgtgtgttgagtccttcaccgagtacccccctctcggtcgtttcgccgtccgtga

SEQ ID NO: 450 - DNA, 1095 bp, Rhizopus oryzae
  ref <308>: DATABASE ACCESSION NUMBER: ATCC 56015
caagcttaaggctgaacgtgaacgtggtatcaccatcgatattgctctctggaagttcgaaacccccaagtaccaaattaccgttattgatgctcccggtcaccgtgatttcatcaagaacatgattaccggtacttctcaagccgattgtgctattcttatcattgctggtggtactggtgaattcgaagctggtatctccaaggatggtcaaacccgtgaacacgcccttttggctttcactctcggtgtccgtcaattgattgttgctgtcaacaagatggataccaccaagtggtccgaagctcgtttcaacgaaatygtcaaggaagtttcttccttcatcaagaagattggttacaaccccaagtctgttcccttcgtccccatctctggttggcacggtgacaacatgttggaagaatctaccaacatgccctggtacaagggatggaacaaggaaaccaaggctggtgccaagtctggtaagaccctcttggatgccattgacaacattgaccctcctacccgtcctgttgacaagcctctccgtcttcctcttcaagatgtttacaagattggtggtatcggtactgtccccgtcggtcgtgtcgaaactggtgtcatcaaggctggtatggttgtcaccttcgctcctgctgctgtcaccactgaagttaagtccgtcgaaatgcaccacgaaaccctcactgaaggtctccccggtgacaacgtcggtttcaacgtcaagaacgtctccgtcaaggatatccgtcgtggtaacgtctgttctgactccaagaacgaccccgccaaggaagccggttccttcaccgctcaagtcattatcttgaaccaccctggtcaaattggtgctggttacgctccygttttggattgtcacactgctcacattgcctgtaagttcgctgaattgatcgaaaagattgacagacgttccggtaagtccttggaagctactcccaagttcgtcaagtctggtgactctgccatcgtcaagatgatcccctccaagcccatgtgtgttgaagcttacactgactaccctcctctcggtcgtttcgctgttcgtga

SEQ ID NO: 451 - DNA, 1292 bp, Rhodotorula minuta
  ref <308>: DATABASE ACCESSION NUMBER: ATCC 10658
gctgaaggccgagcgagagcgtggtatcaccatcgatatcgctctatggaagttcgagacccccaagtacaacgtcaccgtcattgacgctccaggacatcgtgatttcatcaagagtgagttaaccataacatcaaacagtgttgcaaacatcagctaatgcatgttatgcgtccagacatgattactggtacttcccaggccgattgcgctattctcatcatcgccaccggtgttggtgagttcgaggctggtatctccaaggatggccagacccgagagcacgcccttctcgccttcaccctcggtgtcagacagctcatcgttgccttgaacaagatggactcggtcaaggtaggctaacttcacaacgtcggcttcccatcattcattcacttacctgtcttgtcttccaccctccagttctccgagtcccgatacgatgaaatcgtcaaggagacatccggtttcatcaagaaggtcggattcgaccccaagggtgttcccttcgtccccatctcaggatggcacggagacaacatgatcgaggagtccaccaacatgccttggtacaagggatggaagaagaccaccaagaccggcgagtacaagggaaagaccctgctcgaggccatcgactccatcgagccccccacccgtcctaccgacaagcctctccgacttcccctccaggatgtctacaagattggtggtatcggaacagtgccagtcggacgagtcgagactggtaccatcaaggctggtatggtcgtcaccttcgctccttcagctgtcaccaccgaagtcaagtctgttgagatgcaccacgagcagctcgaggctggtcttccaggtgacaacgtcggattcaacatcaagaacgtttcagtcaaggatatccgaagaggaaacgtctgcggtgactccaagaacgatccccccaaggaggctgcttccttcaccgcccaggtcattgtcctcaaccaccccggtcaaatcggtaacggatactctccagttctcgattgccacactggtgagtcattcttccatattagtttgaactcttttgaacaatactaacgtgaatcattatacttttcagcccacattgcatgcaagttcgacaccctcctagagaagattgaccgacgatccggaaagtccatcgaagatacccccaagttcgtcaagtctggtgacgccgccatcgtcaagatggtccccaccaagccaatgtgcgttgaggctttcaccgactacccacctcttggacgattcgccgtccgtga

SEQ ID NO: 452 - DNA, 1289 bp, Sporobolomyces salmonicolor
  ref <308>: DATABASE ACCESSION NUMBER: ATCC 32311
aagctcaaggccgagcgtgagcgtggtatcaccatcgatatcgctctctggaagttcgagacccccaaggtgcgttctcaccccggctgaggagcacgcacgcgagggctcacgctgcgcctcttacagtacatgatcaccgtcatcgacgccccgggtcaccgtgacttcatcaagaacatgatcaccggtacctcgcaggccgactgcgccatcctcatcatcgccgccggtaccggtgagttcgaggctggtatctcgaaggacggccagacccgcgagcacgccctcctcgccttcaccctcggtgtccgtcagctcatcgtcgccatcaacaagatggacacgaccaagtactcggaggcccgtttcgaggagatcatcaaggagacctccaacttcatcaagaaggtcggcttcaaccccaagaacgtccccttcgtccccatctcgggatggcacggtgacaacatgattgaggagaccgccaacatgccctggtacaagggatggaagaaggagaccaaggccggtgaggtcaagggcaagaccctcctcgacgccatcgacgcgatcgagcccccttcgcgccctaccgacaagcccctccgtcttcccctccaggttcgtttccctgctcgcggtttacgctgctacttcgagctgacccgcgagctctgcccgaacaggatgtctacaagatcggtggtatcggcacagtccccgtcggccgtgtcgagaccggcacgatcaaggccggtatggtcgtcgtcttcgccccggccaacgtcaccactgaggtcaagtcggtcgagatgcaccacgagcagctcgaggctggtctcccgggagacaacgtcggcttcaagtgcgtctcatcatgtttttgcttcgctcggccattttttcagtcctgaccccgttttgcccctcgacagcgtcaagaacgtttccgttaaggacatccgtcgcggtaacgtctgcggtgactcgaagaacgacccccccaaggaggccgcttccttcaaggcccaggtcatcgtcatgaaccaccccggtcagatcggcaacggttacgctcccgttctcgactgccacaccgcccacattgcctgcaagttcgacaccctcctcgagaagatcgaccgtcgctcgggcaagtcgattgaggacctccccaagttcgtcaagtcgggtgacgccgccatcgtcaagatggttccctccaagccgatgtgtgtcgagtcgttcgccgagtacccccctctcggacgtttcgccgtccgtga

SEQ ID NO: 453 - DNA, 1070 bp, Sporothrix schenckii
  strain WSA-148
gtgagcgcggtatcaccatcgatattgctctgtggaagttcgagacccccaagtactacgtcaccgtcattgacgcccccggtcatcgcgatttcatcaagaacatgatcactggtacctcgcaggccgactgcgccattctcatcattgccgctggtactggtgagttcgaggctggtatctccaaggatggccagactcgtgagcacgctctgctcgcctacaccctgggtgtgcggcagctgatcgtcgccatcaacaagatggacacggccaagtgggctgaggctcgttaccaggagatcatcaaggagacctccaacttcatcaagaaggtcggctacaaccccaagactgttgccttcgtccccatctcgggcttccacggcgacaacatgcttactccctcgaccaactgcccctggtacaagggctgggagaaggagggcaagagcggcaaggttaccggtaagactctgctggacgccattgacgccgtcgagccccccaagcgccccacggacaagcccctgcgtctgcccctccaggatgtctacaagatcggcggtatcggcactgtccctgtcggccgtatcgagactggtgtcctgaagcccggcatggtcgtcacctttgccccgtccaacgtcaccactgaagtcaagtccgtcgagatgcaccacgagcagcttgttgagggtgttcccggcgacaacgtcggcttcaacgtcaagaacgtctccgtcaaggagatccgtcgtggcaacgttgccggtgactccaagaacgaccccccctcgggcgccgccaccttcaacgcccaggtcattgtcctgaaccaccccggccaggtcggcaacggctacgccccggttctggactgccacaccgcccacattgcctgcaagttcaccgagatccttgagaagatcgaccgccgtaccggcaagtcggttgagaacaaccccaagttcatcaagtcgggtgacgccgccattgtcaagctgacgccctcgaagcccatgtgcgttgaggccttcactgactacccccctctgggccgtttcgcc

SEQ ID NO: 454 - DNA, 1092 bp, Stephanoascus ciferrii
  ref <308>: DATABASE ACCESSION NUMBER: ATCC 52550
cttaagtctgagcgtgagagaggtatcaccatcgatattgctctctggaaattcgagactcctaagtacaacgttaccgtcattgatgctccaggtcacagagatttcatcaagaacatgattactggtacctcccaggccgatcttgccatccttatcattgctggtggtgtcggtgagttcgaggctggtatctccaaggacggtcagaccagagagcacgctcttctttctttcacccttggtgtcagaaacatgattgttgctgtcaacaagatggactccgtcaagtggtctgaggatcgtttcaacgaaattgtcaaggagacctccaacttcgtcaagaaggttggttacaaccctaagaatattgctttcgttcctatctccggttggaacggtgacaatatgattgagccatccaccaactgcccatggtacaagggttgggagcgtgagaccaagaacggtactgccaagggtaagaccatcttggaggccattgactctatggagccaccttccagaccagttgacaagcctctccgtcttcctcttcaggacgtttacaagattggtggtattggtacggtgccagttggtcgtgttgagactggtgttatcaagccaggtatggttgttacctttgccccagctggtgtcaccactgaagtcaagtctgtcgagatgcaccacgaacagatcccagaaggtaccccaggtgacaacgttggtttcaacgtcaagaacgtctccgtcaaggaaatcagacgtggtaacgttactggtgactccaagaacgacccaccaaagggctgcgactctttcaacgctcaggtcatcatcttcaaccaccctggtcagatctctgctggttacgctccagttttggactgccacactgctcacattgcttgcaagtttgaggagctcattgagaagattgacagacgttccggtaagaaggtcgaagactctcctaagttcgtcaaggccggtgatgccgccattgtcaagatggttccatccaagccaatgtgtgttgaaaccttcactgagtacccacctcttggtcgtttcgccgtccgtgac

SEQ ID NO: 455 - DNA, 1149 bp, Trichophyton mentagrophytes
  strain WSA-225
gccgagcgtgagcgtggtatcaccatcgatatcgccctctggaagttcgagacccccaagtacaatgtcaccgtcattggtatgttttctctttacctttcccctccatcgtcttgctgtgccataactaacgagagtagacgcccccggtcaccgtgacttcatcaagaacatgatcactggtacctcccaggccgactgtgctattctcatcattgctgccggtactggtgagttcgaggctggtatctccaaggatggccagacccgtgagcacgctctgctcgccttcacccttggtgtcaagcagctcatcgttgccatcaacaagatggacaccaccaactggtccgaggaccgtttcaaggaaatcatcaaggaagtcaccaacttcatcaagaaggttggctacgaccccaagggtgttccattcgttccaatctctggtttcaacggtgacaacatgattgaggcctccaccaactgcccatggtacaagggatggaacaaggagactaaggccggtggtgccaagactggcaagaccctcctcgaggccatcgatgccatcgacatgccaacccgtcctaccgacaagcccctccgtctcccactccaggatgtctacaagatctctggtatcggaactgtaccagtcggtcgtgttgagaccggtatcatcaagcccggtatggtcgtcaccttcgcccctgccaacgtcaccactgaagtcaagtccgtcgaaatgcaccaccagcagcttcagcagggtgtccccggtgacaacgtcggcttcaacgtcaagaacgtttccgtcaaggaagtccgccgtggtaacgttgccggtgactccaagaacgacccaccatccggctgtgcctccttcaacgcccaggtcatcgtcctcaaccaccccggccagatcggtgctggttacgccccagtcctcgactgccacactgctcacattgcttgcaagttcgctgagctcctcgagaagattgaccgccgtaccggtaaatccgtcgaagccaaccccaagttcgtcaagtctggtgatgccgctatcgccaagatggttccctccaagcctatgtgcgttgaggctttcactgactaccccccacttggtcgtttcgccgtccgtga

SEQ ID NO: 456 - DNA, 1101 bp, Trichosporon cutaneum
  ref <308>: DATABASE ACCESSION NUMBER: ATCC 62965
tcttgacaagcttaaagctgaacgtgaacgtggtatcaccattgatatcgctctctggaagttcgaaactcctaagtactacgttactgttattgatgctccaggtcaccgtgatttcatcaagaacatgattactggtacttcccaagccgactgcgccattcttatcattgctgccggtgtcggtgaattcgaagctggtatctccaaggaaggtcaaaccagagaacacgctcttctcgctttcacccttggtgtcagacaacttatcattgccatcaacaagatggactctgtcaagtgggaccaaaagagatacgaagaaatcgtcaaggaggcttccaacttcgtcaagaaggttggttacaaccccaagtctgttccattcgttcctatctctggttggaacggtgacaacatgttggaacctaccaccaacgccccatggtacaagggatggaccaaggaaaccaaggctggtgccactaagggtatgactcttattgaagccattgacgccattgaaccaccagtaagaccatccgacaagccactccgtctcccactccaagatgtttacaagattggtggtatcggaactgtgccagtcggccgtgtcgaaaccggtatcatcaaggccggtatggtcgtcacctttgctccaccaatggtcacaactgaagttaagtccgttgaaatgcaccacgaacaacttgctcaaggtaacccaggtgacaacgttggtttcaacgtcaagaacgtttccgttaaggaaatcagacgtggtaacgtctgtggtgactccaagaacgatccaccaaagggctgcgaatctttcaacgctcaagttatcgtcttgaaccaccctggtcaaatctctgctggttactctccagttctcgattgccacactgcccacattgcctgcagattcgacgaactccttgaaaagatcgaccgtcgttccggtaagaagattgaagactctccaaagtttgtcaagtctggtgatgccgctatcgtcaagatgatcccaaccaagccaatgtgcgttgaaaccttcactgaatacccaccacttggtcgtttcgccgtccgtga

SEQ ID NO: 457 - DNA, 1085 bp, Wangiella dermatitidis
  strain WSA-229
gttgaaggccgagcgtgagcgtggtatcaccatcgatatcgccctctggaagttcgagacccccaagtactatgtcaccgtcatcgacgccccgggtcatcgtgactttatcaagaacatgatcactggtacctcgcaggccgactgcgccatcttgatcattgccgccggtaccggtgaattcgaagccggtatctccaaggatggtcagacccgtgagcacgctctgctcgcctacaccttgggtgtcaagcagctcatcgtcgccatcaacaagatggacaccaccaagtggtccgaggagcgtttcaacgaaatcatcaaggagacttccaacttcatcaagaaggtcggctacaaccccaaggccgttcctttcgtccccatctccggcttcaacggtgacaacatgattgaggtctccaccaactgcccgtggtacaagggatgggagaaggagtccaaggctggcaaggccaccggcaagaccctcctcgaggccattgacgccatcgacccacccacccgtcccaccgacaagcctctccgtctccctctccaggatgtctacaagatctctggtatcggaacggttcctgtcggtcgtgtcgagaccggtaccatcaaggccggtatggtcgtcaccttcgctccggccaacgtcaccactgaagtcaagtccgtcgaaatgcaccacgagcagctcgccgagggtctgccaggtgacaacgttggcttcaacgtcaagaacgtctccgtcaaggaggttcgtcgtggtaacgttgccggtgactccaagaacgacccgcccaagggtgccgagtccttcaacgcccaggtcattgtcctcaaccaccctggtcagatcggtgccggctacgctccagtcttggattgccacactgcccacattgcttgcaagttcgccgagttgctcgagaagatcgaccgtcgtaccggaaagtccatcgagaacaaccccaagttcatcaagtctggtgatgctgccatcgtcaagatgattcccagcaagcccatgtgtgtcgaggctttcaccgactatcctcctctgggtcgtttcgctg

SEQ ID NO: 458 - DNA, 492 bp, Aspergillus fumigatus
  strain DAL-95
tgtcttcatccggaattgattgtgagtcgttccacatgctcacctagttttcgctcgatcttttcactaacgcaaaccatgtagaacaacattgccaaggcccacggtggttactccgtcttcactggtgttggtgagcgtactcgtgagggtaacgatctgtaccacgaaatgcaggagactggtgtcattcagctcgagggtgaatccaaggtcgcactggtgttcggacagatgaacgagccccccggtgcccgtgcccgtgtcgcccttaccggtctgaccattgccgagtacttccgtgacgaggagggtcaggacgtgctgctcttcattgacaacattttccgtttcacccaggccggttctgaggtgtctgcccttctcggtcgtatcccctctgccgtcggttaccagcccaccctggccgtcgacatgggtggtatgcaggagcgtatcaccaccaccaagaagggttctattacctccgtc

SEQ ID NO: 459 - DNA, 1154 bp, Blastoschizomyces capitatus
  ref <308>: DATABASE ACCESSION NUMBER: ATCC 10663
gtccgtggtcaagaagttattgacactggtgccccaattaccattcctgttggtcgtggtactcttggtagaattatcaacgtcattggtgaaccaattgacgaacgtggtcctatcaaggcttctaagtatgctcctatccatactgaaccaccaacctttgctgaacaatctacttctgctgaagttcttgaaactggtatcaaggttgtcgatcttcttgctccttacgcccgtggtggtaagattggtcttttcggtggtgctggtgtcggtaagactgtcttcattcaagaacttattaacaacattgccaaggctcacggtggtttctctgtcttcactggtgtcggtgaaagaacccgtgaaggtaacgatctttaccgtgaaatgaaggaaactggtgtcatcaacctcgaaggtgactccaaggtcgctctcgttttcggtcaaatgaacgaacctccaggtgcccgtgcccgtgtcgctttgactggtcttaccattgccgaatacttccgtgatgaagaaggacaagatgtcttgcttttcgttgacaacattttcagattcacccaagccggttctgaagtctctgctcttttgggtcgtattccatctgccgtcggttaccaacctacccttgctaccgatatgggtgccctccaagaacgtattaccaccacccaaaagggttccgtcacatctgtccaagccgtctatgtcccagcagacgatttgactgatcctgccccagccaccactttcgctcacttggacgccaccactgtcttgtctcgttccatttccgaattgggtatctacccagctgtcgatcctctcgattccaagtctcgtcttttggatcctgaagttattggacacgaacactacgaagttgccactcaagttcaacaaaccctccaagcttacaagtctctccaagatatcattgccattttgggtatggatgaattgtctgaagctgataagcttactgtcgaacgtgcccgtaagatccaaagattcctttcccaaccattcgctgttgccgaagttttcactggtatcgaaggtcgtctcgttccattgaaggaaaccgtcagatctttcaaggaaatccttgaaggtaagtacgatcaccttccagaagc

SEQ ID NO: 460 - DNA, 1295 bp, Candida albicans
  ref <308>: DATABASE ACCESSION NUMBER: ATCC 18804
ccaattcgacgaaggaaacttgccagctattttgaatgctttgactttgaagaacggtgaccaagacttggtcttggaagttgctcaacatttgggtgaaaacaccgtcagagctattgctatggatggtactgaaggtttagtcagaggtaccgaagtcaacgataccggtgccccaatctccgtcccagtcggtagaggtactttaggtagaatcatcaatgttgttggtgaaccaattgatgacagaggtccaattgaatgtaaggaaaagaaaccaattcacgctgaaccaccatcattcgttgaacaatccactgctgccgarattttggaaaccggtatcaaggttgtcgacttgttggccccatacgccagaggtggtaarattggtttattcggtggtgctggtgtcggtaagaccgtctttatccaagaattgattaacaacattgccaaagcccatggtggtttctctgtctttaccggtgtyggtgaaagaaccagagaaggtaacgatttgtaccgtgaaatgaaagaaaccggtgtcatcaacttggaaggtgactccaaggtcgctttggtcttcggtcaaatgaacgaaccaccaggtgctagagctagagttgctttgactggtttgaccattgctgaatacttcagagatgaagaaggtcaagatgtcttgttgttcattgataacattttcagattcacccaagctggttccgaagtgtctgctttgttaggtcgtattccatctgctgtcggttatcaaccaaccttagccactgatatgggtcttttgcaagaacgtattaccaccaccaagaaaggttccgtcacctctgtccaagctgtctatgtcccagctgatgatttgaccgatcctgctccagccactacattcgcccatttggatgccactactgtcttgtctagaggtatttctgaattgggtatctacccagctgtcgatccattggattccaaatccagattattggacgcttctgttgttggtcaagaacattacgatgtcgctactggtgttcaacaaactttacaagcttacaaatccttacaagatatcattgctattttgggtatggatgaattgtctgaagctgataaattgactgtcgaaagagcccgtaagatccaaagattcttgtctcaaccattcgctgttgctgaagttttcactggtatcccaggtagattagtcagattgcaagacactgtcaaatcattcaaggatgttttggaaggtaaatacgataacttgccagaaa

SEQ ID NO: 461 - DNA, 1277 bp, Candida dubliniensis
  strain NCPF 3949
taacttgccagctattttgaatgctttgactttgaagaacggtgaccaagatttagttttggaagttgctcaacatttgggtgaaaacaccgtcagagctattgctatggatggtactgaaggtttagtcagaggtactgaagtcaacgataccggtgccccaatctccgttccagtcggtagaggtaccttaggtagaatcatcaatgttgttggtgaaccaattgatgacagaggtccaattgaatgtaaggaaaagaaaccaattcatgcagaaccaccatccttcgttgagcaatccactgctgccgaaattttggaaaccggtatcaaggttgtcgacttattggccccatacgccagaggtggtaagattggtttgttcggtggtgctggtgtcggtaagaccgtctttatccaagaattgattaacaacattgctaaagcccatggtggtttctccgtctttaccggtgtcggtgaaagaaccagagaaggtaacgatttgtaccgtgaaatgaaagaaaccggtgtcatcaacttagaaggtgactccaaggtcgctttggtctttggacaaatgaacgaaccaccaggtgctagagctagagttgctttgactggtttgactattgctgaatacttcagagatgaagaaggtcaagatgtcttgttgttcatcgataacattttcagattcacccaagctggttccgaagtgtctgctttgttaggtcgtattccatctgccgtcggttatcaaccaaccttagctactgatatgggtcttttgcaagaacgtattaccaccaccaagaaaggttccgtcacctctgtccaagctgtctatgtcccagctgatgatttgaccgatcctgctccagccaccacattcgcccatttggatgccactactgtcttgtctagaggtatttctgaattgggtatttacccagctgtcgatccattggattccaaatccagattattggacgctgccgttgttggtcaagaacattatgatgtcgctactggtgttcaacaaactttgcaagcttacaaatccttacaagatatcattgctattttgggtatggatgaattgtctgaagctgataaattgactgtcgaaagagcccgtaagattcaaagattcttgtctcaaccattcgccgttgctgaagttttcactggtattccaggtagattagtcagattgcaagacactgtcaaatcattcaaggatgttttggaaggtaaatacgatcacttgccag

SEQ ID NO: 462 - DNA, 1278 bp, Candida famata
  ref <308>: DATABASE ACCESSION NUMBER: ATCC 62894
gtaacttgccagctattttgaacgctttgaccttgaagaacggtgaaaacgacttagttttagaagttgcccaacatttgggtgaaaacaccgtcagagctattgctatggatggtactgaaggtttagttagaggtactccagttaccgattctggtgctccaatttctgtcccagtcggtagaggtactttaggtagaatcttgaacgttattggtgaaccaattgatgaacaaggtccagttgatgccaaggaaaccagaccaattcaccaagacccaccagcattcgttgatcaatccaccaaggctgaagttttggaaactggtatcaaggttgtcgatttattagccccttacgctagaggtggtaagattggtttattcggtggtgccggtgtcggtaagaccgtctttatccaagaattgattaacaacattgccaaggcccatggtggtttctctgttttcactggtgtcggtgaaagaaccagagaaggtaacgatttatatagagaaatgaaggaaactggtgtcattaacttggaaggtgactccaaggtcgccttggttttcggtcaaatgaacgaaccaccaggtgctagagctagagttgctttaaccggtttaaccattgccgaatacttcagagacgaagaaggtcaagatgtgttattgttcgtcgataacatttttagattcacccaagccggttccgaagtgtctgctttgttaggtcgtattccatcggctgtcggttatcaaccaaccttagccactgatatgggtcttttacaagaaagaattaccaccaccaccaagggttccgttacttctgtccaagctgtctacgtcccagccgatgatttaaccgatcctgctccagctaccactttcgcccacttggatgctaccactgtgttgtctcgtggtatctctgaattgggtatttacccagctgtcgatccattggattccaaatccagattgttagatgctgatatcgttggtaaagaacactacgaagttgccactggtgtccaacaaaccttacaagcttacaaatctttacaagatatcattgctattttaggtatggatgaattgtctgaagccgataaattgactgtcgaaagagccagaaagatccaaagattcttgtctcaaccattcgccgttgccgaagttttcaccggtatcccaggtagattagttagattgcaagacactgttaaatctttcaaggaagtcttagaaggtaaatatgatcacttaccag

SEQ ID NO: 463 - DNA, 1154 bp, Candida glabrata
  ref <308>: DATABASE ACCESSION NUMBER: ATCC 66032
tctggtcagaggcgagaaggtcgtcgacacaggtgccccaatctccgtccctgtcggcagagagaccctgggcagaatcatcaacgttatcggtgaacctatcgacgagcgtggcccaatcaactcaaagttgagaaagcctatccacgccgaccctccttccttcgcagaacagtccaccgccgccgaagtcctggaaacaggtatcaaggtcgtcgacttgctggccccttacgccagaggtggtaagatcggtctgttcggtggtgccggtgtcggtaagaccgtgttcatccaagaactgatcaacaacatcgcaaaggctcacggtggtttctccgtgttcacaggtgtcggtgaaagaaccagagaaggtaacgatttgtacagagaaatgaaggaaaccggtgtcatcaacttggaaggtgactctaaggtcgccttggtcttcggccaaatgaacgaaccaccaggagccagagccagagtcgccttgaccggtttgaccatcgcagaatacttcagagatgaagaaggtcaagatgtcctgctgttcgtcgacaacattttcagattcacccaagccggttcagaagtctccgctttgctaggtcgtatcccatccgccgtcggttatcaaccaaccttggccaccgatatgggtctgttgcaagaaagaattaccaccacaaagaagggttccgtcacttccgtccaagccgtctacgtgcctgcagatgatttaacagatcctgcccctgccactactttcgcgcacttggacgccaccaccgtcttgtccagaagtatctcagaattgggtatctacccagctgtcgacccattggactccaagtctagattgctagacgctgccgttgtcggtgaagagcattacaacgtcgccacaaaggtccaagaaactttacaaacttacaagtctctgcaagatatcatcgccattttgggtatggatgaattgtccgaacaagataagctaactgtcgaaagagcaagaaagatccaaagattcttgtcccaaccattcgctgtcgctgaagttttcaccggtatcgaaggtaagctggtcagattgaaggacaccatctcctctttcaaggctgtcttggaaggtaagtacgatgatcttccag

SEQ ID NO: 464 - DNA, 1293 bp, Candida guilliermondii
  ref <308>: DATABASE ACCESSION NUMBER: ATCC 6260
ccactacgaggacggtaaccttcctgctattttcaacgccttgactcttaagaacggtgaccaaaacttggttttggaagttgcccagcatttgggtgaaaacaccgtcagaaccattgctatggatggtactgaaggtttggttagaggtgccagcgtcactgacactggtgctcctatctctgtgcctgttggtcgtggtactttgggtcgtatcatcaacgttattggtgagccaattgacgagcgtggaccaatcgagtccaagcaaaagaagcccattcacgctgaaccaccatcgttcgtcgaacaatccacttctgccgaggttttggaaaccggtatcaaggttgtcgacttgttggctccatacgccagaggtggtaagattggattgttcggtggtgccggtgtcggtaagactgtgtttatccaagagttgattaacaacattgccaaggctcacggtggtttctccgtgttcaccggtgtcggtgaaagaaccagagaaggtaacgatttgtaccgtgaaatgaaggaaactggtgtcatcaacttggaaggtgaatccaaggtggccttggtgttcggtcaaatgaacgaacctccaggagctagagccagagttgcccttaccggtttgaccatcgctgaatacttcagagatgaggagggtcaagatgtgttgttgttcgtcgacaacattttcagattcactcaagctggttctgaagtgtcggctttgttgggtcgtattccttcggctgtcggttaccaacctactttggccaccgatatgggtttgttgcaagagcgtattaccaccaccaagaagggttccgtcacctctgtccaagctgtctatgtgccagccgatgatttgaccgatcctgctcctgctactacttttgctcacttggatgctaccactgtgttgtctagaggtatctccgagttgggtatttacccagctgtcgatcctttggattccaagtcgagattgttggatgcctctgttgtcggtgaggagcactactcggttgcttctaacgttcaacaaaccttgcaagcttacaagtctttgcaagatatcattgccattttgggtatggacgaattgtcggaagctgacaagttgaccgtcgagagagcccgtaagatcgagagattcttgtctcaaccatttgctgttgccgaagttttcactggtatcagtggtaagttggtcagattggaggacactatcagatctttcaaggaagtcttggaaggtaagtacgatcacttgccaga

SEQ ID NO: 465 - DNA, 1293 bp, Candida haemulonii
  ref <308>: DATABASE ACCESSION NUMBER: ATCC 22991
cactttgacgatggtaacttgccagccattttcaacgccttgaagttgaagaacggtgaccaggacttggtcttggaggtcgcccagcacttgggtgagaacaccgtcagaaccattgccatggacggtaccgatggtttggtcagaggcgaggctgtcactgacactggtgctccaatctccgtgcctgttggtcgtgagactttgggtcgtatcatcaacgttattggtgagccaattgacgagagaggaccaatcaagtccaagaagagaaacccaatccacactgacccaccaaccttcgttgagcagtctacttctgctgaggttttggagactggtattaaggttgtcgacttgttggccccttacgccagaggtggtaagattggtttgttcggtggtgccggtgtcggtaagaccgtctttatccaagagttgattaacaacattgccaaggcccacggtggtttctctgtctttaccggtgtcggtgagagaaccagagaaggtaacgatttgtaccgtgaaatgcaggagaccggtgtcatcaacttcgagggtgactccaaggtcgccttggtcttcggtcagatgaacgagccaccaggagctagagctagagttgctttgaccggtttgaccattgccgaatacttcagagatgaagaaggtcaggatgtgttgttgttcgttgacaacattttcagattcactcaggctggttccgaggtgtccgccttgttgggtcgtattccatctgctgtcggttaccagccaaccttggccaccgatatgggtaccttgcaagaaagaattaccaccaccaagaagggttccgtcacctctgtccaggccgtttacgtgccagctgatgatttgaccgatcctgccccagctaccactttcgctcacttggatgctaccactgtgttgtctagaggtatttccgagttgggtatctacccagctgtcgacccattggactccaagtctagattgttggatgcctctgttgtcggtaaggagcactacgatgttgctaccaacgtccagcagaccttgcaggcctacaagtccttgcaggatatcattgccattttgggtatggatgaattgtccgaagccgacaagttgactgtcgagagagctagaaagattcagagattcttgtcccagccattcgccgtcgccgaggttttcactggtatcgagggtaagttggtcagattggaggagaccgtcaagtctttcaaggaggtcttggatggtaagtacgaccacttgccagag

SEQ ID NO: 466 - DNA, 1111 bp, Candida inconspicua
  ref <308>: DATABASE ACCESSION NUMBER: ATCC 16783
aacggtggatctaagttagtcttagaagttgctcaacatttgggtgaaaacactgtcagaaccattgctatggatggtactgaaggtttagttagaggtcaaccagttaatgatactggtgctccaatctctgtcccagtcggtagaggtactttaggtagaatcttaaacgttattggtgatccagtcgatgaaagaggtccaattgattgtaaggaaagaaaaccaattcatcaagatcctcctgctttcgttgaacaatctactgaagctgaagttttagaaaccggtattaaggttgttgatttattagctccttacgctagaggtggtaagattggtttattcggtggtgctggtgtcggtaaaaccgttttcattcaagaattaattaacaatgttgcaaaggctcatggtggtttctcagttttcactggtgtcggtgaaagaaccagagaaggtaatgatttatacagagaaatgaaggaaactggtgttattaacttagaaggtgaatctaaggtcgccttagttttcggtcaaatgaatgaaccaccaggagcaagagcaagagttgctttaaccggtttaactattgctgaatacttcagagatgaagaaggtcaagatgtcttgttattcattgataacattttcagatttactcaagcaggttctgaagtttctgcattgttaggtagaattccatccgctgtcggttatcaaccaactttagcaactgatatgggtcttttacaagaaagaattacaactactaagaaaggttccgttacttctgtccaagcagtttatgtcccagcagatgatttaactgatcctgctccagcaactactttcgcccacttagatgcaactactgtcttatctagaggtatttccgaattaggtatttacccagctgtcgatccattagattctaaatctagattattagatgttgctgttgttggtcaagaacattatgatgttgcaactcaagttcaagaaactttacaagcatacaaatctttacaagatattattgctattttaggtatggatgaattatctgaacaagataaattaaccgttgaaagagcaagaaagattc

SEQ ID NO: 467 - DNA, 1283 bp, Candida kefyr
  ref <308>: DATABASE ACCESSION NUMBER: ATCC 28838
tcgaacaaggtcaattgccagaaattttgaacgctttggagattgawactcctcaaggtaagttggttttggaagttgcccaacatttgggtgaaaacaccgtcagaaccattgctatggacggtaccgaaggtttggtccgtggtgagaaggttttggacactggtgctccaatttccgtcccagtcggtagagaaactttgggtagaatcatcaacgttattggtgagccaattgacgaaagaggcccaatcaagtccaagatgagaaagccaattcacgctgaccctccatcctttgttgaacaatccactgctgctgaagttttggaaaccggtatcaaggttgtcgacttgttggccccatacgccagaggtggtaagattggtttgttcggtggtgccggtgtcggtaagaccgttttcatccaagagttgattaacaacattgccaaggcccatggtggtttctccgtcttcaccggtgtcggtgaaagaaccagagaaggtaacgatttgtaccgtgaaatgaaggaaaccggtgtcatcaacttggaaggtgactccaaggtcgccttggtcttcggtcaaatgaacgaaccacctggagctagagccagagttgccttgaccggtttgactatcgctgaatacttcagagatgaagaaggtcaagatgtgttgttgtttatcgacaacattttcagattcacacaagccggttccgaagtgtccgctttgttgggtcgtattccatccgctgtcggttaccaacctactttggccaccgatatgggtttgttgcaagaaagaattaccactaccaagaagggttccgttacctccgtccaagctgtctacgtccctgctgatgatttgactgatcctgctccagctacyactttcgcccatttggacgccaccaccgtgttgtccagaggtatctccgaattgggtatctacccagctgtcgatccattggattccaagtctagattgttggacgctgccgttgtcggtcaagaacattacgacgtcgctactcaagttcaacaaactttgcaagcttacaagtctttgcaagatatcattgccattttgggtatggatgaattgtctgaacaagacaagttgactgtcgaaagagccagaaagatccaaagattcttgtctcaaccattcgccgtcgccgaagttttcactggtatcccaggtagattggtcagattaaaggacaccatcgcttccttcaaggctgttttggaaggtaagtacgatcacttg

SEQ ID NO: 468 - DNA, 1287 bp, Candida krusei
  ref <308>: DATABASE ACCESSION NUMBER: ATCC 34135
cttcgaacaaggccaattaccacaaattttaaacgctttagttatggataatggtggtaacaagttagttttagaagttgctcaacatttaggtgaaaacactgtcagaaccattgctatggatggtactgaaggtttagttagaggtcaaaccgttaacgataccggtgctccaatctctgtcccagttggtagaggtaccttaggtagaatcttgaacgtcattggtgatccagtcgatgaaagaggtccagttgactgtaaggaaagaaagccaattcacgctgatcctccagctttcgttgaacaatccactgaagctgaagttttggaaactggtattaaggttgtcgatttattagcaccttacgcaagaggtggtaagattggtttattcggtggtgctggtgttggtaagaccgtttttatccaagaattgatcaacaatgtygcaaaggctcatggtggtttctccgttttcactggtgttggtgaaagaaccagagaaggtaacgatttatacagagaaatgaaggaaactggtgttattaacttggaaggtgaatccaaggtcgccttagttttcggtcaaatgaacgaaccaccaggagctagagcaagagttgctttaactggtttgaccattgcagaatatttcagagatgaagaaggtcaagatgtcttgttattcattgataacattttcagattcacccaagcaggttctgaagtctctgcattattaggtagaattccatctgctgtcggttatcaaccaactttagcaaccgatatgggtcttttacaagaaagaattaccaccaccaagaagggttccgttacttctgtccaagctgtttatgtcccagccgatgatttaaccgatcctgctccagctactactttcgcccacttggatgcaaccactgtcttgtcyagaggtatttccgaattaggtatctacccagctgtcgatccattagattctaagtctagattattagatgttgcagttgttggtcaagaacattatgaagttgcaactcaagtccaagaaactttacaagcttacaagtctttacaagatattattgctattttgggtatggatgaattatctgaacaagataagttaacygttgaaagagcaagaaagatccaaagattcttatctcaaccattctctgttgcagaagttttcactggtattccaggtaagttagtcagattagaagaaaccatcaagtctttcagggatgttcttgcaggtaagtacgatcacttacc

SEQ ID NO: 469 - DNA, 1283 bp, Candida lambica
  ref <308>: DATABASE ACCESSION NUMBER: ATCC 24750
tcgaacaaggtcaattaccaccaattcttaacgctttggtcatggaaaacgatggtcaaaagttagttttggaagttgctcaacatttgggtgaaaacaccgtcagaaccattgctatggacggtaccgaaggtttagttagaggtcaacctgttaacgacactggtgctccaatctctgtcccagttggtagaggtactcttggtagaatcttgaacgtcactggtgacccagtygatgaaagaggtcctgtcgamtgtaaggagagaagaccaattcaccaagacccacctgctttcgttgaccaatccactgaagctgaagttttggaaaccggtattaaggttgtcgatttattagcaccttacgctagaggtggtaagattggtttgttcggtggtgctggtgtcggtaagaccgttttcatccaagaattgattaacaatgttgctaaggcccacggtggtttctccgttttcactggtgtcggtgaaagaaccagagaaggtaacgatttatacagagaaatgaaggaaaccggtgttattaaccttgaaggtgaatctaaggtcgccctcgttttcggtcaaatgaacgaaccaccaggagcaagagctagagttgctcttactggtttgaccattgctgaatacttcagagatgaagaaggtcaagatgtcttgcttttcattgacaacattttcagattcacccaagcaggttccgaagtgtctgctttgttaggtagaattccwtctgccgttggttaccaaccaaccttagcaaccgatatgggtttgttacaagaaagaattaccaccaccaagaagggttccgtcacctccgtccaagctgtttacgtcccagctgatgatttractgaccctgcaccagcaaccactttcgcccacttggatgctaccaccgtcttgtctagaggtatttccgaattaggtatttacccagctgtcgatccattagattctaagtctagattattggatgtcgctgttgtcggtcaagaacattataccgttgcaacycaagtccaagaaactttacaagcttacaagtccttacaagatatcattgctattttgggtatggacgaattatctgaacaagataagcttactgttgaaagagcaagaaagatccaaagattcctttcccaacctttctccgtcgcagaagttttcactggtatcccaggtaagcttgtcagattagaagaaaccattatttctttcagagatgtcctcgatggtaagtacgaccactta

SEQ ID NO: 470 - DNA, 1140 bp, Candida lusitaniae
  ref <308>: DATABASE ACCESSION NUMBER: ATCC 66035
aggtgcctctgtcactgacactggttctccaatctctgtccctgttggtcgtgaaaccttgggtagaattatcaacgttgttggtgagccaattgacgagagaggcccaatcaactccaagaagagaaacccaattcacactgagccaccatcgtttgttgaacaatccacttctgctgaagttttggagactggtatcaaggttgtcgacttgttggccccttacgccagaggtggtaagattggtttgttcggtggtgccggtgtcggtaagaccgttttcatccaagagttgattaacaacattgccaaggcccacggtggtttctctgttttcactggtgtcggtgaaagaaccagagaaggtaacgatttgtaccgtgaaatgcaagagaccggtgtcatcaacttcgagggtgactccaaggtcgccttggtcttcggtcaaatgaacgaaccaccaggagccagagctagagttgctttgaccggtttgactattgccgagtacttcagagacgaagagggccaagatgtcttgttgttcgttgacaacattttcagattcacccaggccggttctgaagtgtctgctttgttgggtcgtattccatccgctgtcggttaccaaccaaccttggccaccgatatgggtgctttgcaagagagaattaccaccaccaagaagggttccgtcacctctgtccaagccgtttatgttccagctgatgacttgactgaccctgctccagccaccaccttcgcccacttggacgccaccactgtgttgtccagaggtatctctgaattgggtatctacccagctgtcgacccattggactccaagtctagattgttggacgcttctattgttggtaaggagcactacgaagttgcttctaacgttcaacaaactttgcaagcttacaagtctttgcaagatatcattgccattttgggtatggatgaattgtctgaggctgacaagttgaccgttgagagagccagaaagatccaaagattcttgtctcaaccattcgctgttgccgaggttttcactggtatcccaggtagattggtcagattggaggacactgtcagatccttcaaggaagttttggacggtaagtacgaccactt

SEQ ID NO: 471 - DNA, 1296 bp, Candida norvegensis
  ref <308>: DATABASE ACCESSION NUMBER: ATCC 22977
tcaattcgaacaaggtcaattaccaccaattttaaacgctttagtcatggacaacggtggaactaagttagttttagaagttgctcaacatttaggtgaaaacaccgtcagaaccattgctatggatggtactgaaggtttagttagaggtcaaccagttaatgatactggtgctccaatctctgtcccagtcggtagaggtactttaggtagaatcttaaacgttattggtgatccagtcgatgaaagaggtccaatcgattgtaaggaaagaaaaccaattcatcaagatcctcctgctttcgttgaacaatcaactgaagctgaagttttagaaactggtattaaagttgtcgatttattagctccttacgctagaggtggtaagattggtttattcggtggtgcaggtgttggtaaaaccgtttttattcaagaattaattaacaatgttgcaaaagctcatggtggtttctccgttttcactggtgtcggtgaaagaactagagaaggtaacgatttatacagagaaatgaaggaaactggtgttattaatttagaaggtgattctaaggtcgcattagttttcggtcaaatgaacgaaccacctggagcaagagcaagagttgctttaactggtttaactattgctgaatatttcagagatgaagaaggtcaagatgtcttgttattcattgataacattttcagatttactcaagcaggttctgaagtttccgctttgttaggtagaattccatccgctgtcggttatcaaccaactttagcaactgatatgggtcttttacaagaaagaattactactactaagaaaggttctgttacttccgttcaagcagtttatgtcccagcagatgatttaactgatcctgctccagcaactactttcgcccacttagatgcaactactgtcttatctagaggtatttccgaattaggtatttacccagctgtcgatccattagattctaaatctagattattagatgttgcagttgttggtcaagaacattatgatgttgcaactcaagttcaagaaactttacaagcttacaaatctttacaagatattattgctattttaggtatggatgaattatctgaacaagataaattaaccgttgaaagagctagaaaaattcaaagattcttatctcaacctttctctgtcgcagaagttttcactggtatcccaggtaagcttgttagattagaagaaactatttcttcattcagagatgtcttagcaggtaagtacgatcacttaccagaaaa

SEQ ID NO: 472 - DNA, 1297 bp, Candida parapsilosis
  ref <308>: DATABASE ACCESSION NUMBER: ATCC 90018
acacttcgaagaaggaaacttgccagctattttgaacgctttgaccttgaaaaacggtaaacaagacttggtcttggaagttgcccaacatttgggtgaaaacaccgtcagagcaattgctatggatggtactgaaggtttagttagaggtacttctgtcactgacactggtgccccaatttctgtcccagttggtagaggtactttgggtagaatcatcaatgttactggtgacccaattgatgaaagaggtccaattgaatgtaagaagagaaacccaatccacgctgaaccaccttcattcattgaacaatccactgctgctgaagttttggaaaccggtattaaggttgtcgacttgttggctccatacgctagaggtggtaagattggtttgttcggtggtgccggtgtcggtaaaaccgtgtttatccaagaattgatcaacaacattgccaaggcacatggtggtttctcggttttcactggtgttggtgaaagaaccagagaaggtaacgatttgtaccgtgaaatgaaggaaactggtgttatcaacttggaaggtgactccaaggtcgctttggttttcggtcaaatgaacgaaccacctggagctagagctagagttgctttgactggtttgaccattgctgaatactttagagatgaagaaggtcaagatgtcttgttgtttattgacaacattttcagattcacccaagctggttcagaagtgtctgctttgttgggtcgtattccatccgctgtcggttatcaaccaaccttggccaccgatatgggtcttttgcaagaacgtattaccactaccaaaaagggttcagttacttcagtccaagccgtttacgtgccagctgatgatttaaccgatcctgctccagctaccactttcgctcacttggatgccaccactgtgttgtctagaggtatttcggagttgggtatttacccagctgtcgatccattggattccaaatccagattgttggatgctgccgttgttggtcaagaacattacgacgttgccactggtgttcaacaaactttacaagcttacaagtccttgcaagatatcattgctatcttgggtatggatgaattgtccgaacaagataaattgactgtcgaaagagctcgtaagattcaaagattcttgtctcaaccatttgctgtcgctgaagttttcactggtattccaggtaaattggttagattgtctgaaactgtcaagtcattcaaggaagtcttggaaggtaagtacgataacttgccagaaaat

SEQ ID NO: 473 - DNA, 1285 bp, Candida rugosa
  ref <308>: DATABASE ACCESSION NUMBER: ATCC 96275
ccagtttggcaacgacctccctgccattttgaacgccctcactcttcagcgtgaagacggtaacaagcttgttcttgaggttgcccagcatctcggtgagaacaccgtccgtaccattgctatggacggtaccgagggtttggtgcgtggcactggtgtccacgacaccggacaccccatcatgactcccgtcggtgacggtaccctgggacgtattcttaacgtcaccggtgaccctgtagacgagcgtggtcccgtcaagactgacaagttccgccccatccacgccgaggcccctgccttcgatgagcaggctaccagtgccgaggttcttgagaccggtatcaaggttgtcgacttgctcgctccttacgccaagggtggtaagattggtttgttcggtggtgccggtgtcggcaagaccgtcttcatccaggagctgattaacaacatcgccaaggcccacggtggttactccgtgttcactggtgtcggtgagcgtactcgtgagggtaacgatttgtacaaggaaatgatcgagtccggtgtcatcaacctcgatggtgagtccaaggtcgccttggtgttcggtcagatgaacgagccccctggagcccgtgcccgtgtcgcccttaccggtcttaccatcgctgagtatttccgtgatgaggagggtaaggatgtcttgttgttcgttgacaacattttccgcttcactcaggccggttctgaggtgtccgccttgcttggtcgtattccttccgctgtcggttaccagcctaccctggccaccgatatgggtgcccttcaggagcgtatcaccaccaccaagaagggttccgttacatccgtccaggccgtctacgtccctgccgatgatttgactgatcccgcccctgccaccaccttcgcccatttggatgccaccactgtcttgtctcgtgccatctctgagttgggtatctaccccgctgtcgaccctctcgactccaagtcccgtcttcttgacgccgctgtcgttggtcaggagcactacgatactgccacctccgttcagcagactttgcaggcttacaagtctttgcaggatatcattgccattcttggtatggatgagttgtccgagtctgacaagctcaccgtcgagcgtgctcgtaagatccagcgtttcctctcccagcctttcgctgttgctgaggtcttcactggtattcagggccgtcttgttcctctcaaggacactgtccgctccttcaaggagattctcgaaggtaagtacgatgct

SEQ ID NO: 474 - DNA, 1283 bp, Candida sphaerica
  ref <308>: DATABASE ACCESSION NUMBER: ATCC 2504
ttgaacaaggtcaattgccagctattttgaacgctttggaaatcgacactccagaaggaaagttggttttggaagtcgctcaacatttgggtgaaaacactgtcagaaccattgctatggatggtactgaaggtttagtccgtggtgaaaacgtttctgacactggtgctccaatttccgtcccagttggtagagaaaccttgggtagaattatcaacgttattggtgagccaattgacgaaagaggtccaatcaactccaagatgagaaagccaattcatgctgatcctccattattcgttgaacaatccactgctgctgaagttttggaaactggtatcaaggttgtcgacttgttggccccatacgccagaggtggtaagattggtttgttcggtggtgccggtgtcggtaagaccgttttcatccaagaattgattaacaacattgccaaggctcatggtggtttctctgtcttcactggtgtcggtgaaagaaccagagaaggtaacgatttgtaccgtgaaatgaaggaaactggtgttatcaacttggaaggtgattctaaggtcgcgttggttttcggtcaaatgaacgaacctcctggagctagagctagagtcgccttgactggtttgaccatcgctgaatacttcagagatgaagaaggtcaagatgtcttgttgtttatcgacaacattttcagattcacacaagccggttccgaagtgtccgctttgttgggtcgtattccatccgctgtcggttatcaaccaactttggccaccgatatgggtttgttgcaagaaagaattactaccaccaagaagggttccgtcacttctgtccaagccgtttacgtgccagctgatgatttgactgatcctgctccagctaccactttcgcgcatttggatgccaccactgtgttgtccagaggtatctctgaattgggtatctacccagctgtcgatcctttggattccaaatctagattgttggatgctgccgtcgttggtcaagaacattacgatgtcgctactcaagttcaacaaactttgcaagcttacaagtctttgcaagatatcattgccattttgggtatggatgaattgtccgaacaagataagttgaccgtcgaaagagctagaaagattcaaagattcttgtctcaacctttcgctgtcgctgaagtcttcactggtatcccaggtagattggtcagattaaaggacaccatctcttctttcaaggctgtcttggacggtaagtacgatcacttg

SEQ ID NO: 475 - DNA, 1290 bp, Candida tropicalis
  ref <308>: DATABASE ACCESSION NUMBER: ATCC 13803
cgacgaaggtaacttgccagctattttgaatgctttgactttgaagaacggtgaccaagacttggttttggaagttgctcaacatttgggtgaaaacaccgtcagggctattgctatggatggtaccgaaggtttagtcagaggtactgctgtcactgataccggtgctccaatttctgtcccagttggtagaggtaccttgggtagaattatcaacgttgttggtgaaccaattgatgacagaggtccaattgaatgtaaggaaagaaagccaattcacgctgaaccaccttcattcgttgaacaatctactgctgccgaaattttggaaaccggtattaaggttgtcgatttgttggctccttacgctagaggtggtaagattggtttgttcggtggtgctggtgtcggtaaaaccgtcttcatccaagaattgattaacaacattgccaaagctcatggtggtttctctgtctttaccggtgtcggtgaaagaaccagagaaggtaacgatttgtaccgtgaaatgaaagaaactggtgtcatcaacttggaaggtgactccaaggtcgccttggtcttcggtcaaatgaacgaaccacctggtgctagagctagagttgctttgactggtttgaccattgctgaatacttcagagatgaagaaggtcaagatgtcttgttgttcattgacaacattttcagattcacccaagctggttccgaagtgtctgctttgttgggtcgtattccatctgctgtcggttatcaaccaaccttggccactgatatgggtcttttgcaagaacgtattaccaccaccaagaaaggttctgttacttctgtccaagctgtttatgtcccagccgatgatttaaccgatccagctccagctaccaccttcgctcacttggatgccactactgtcttgtctagaggtatttctgaattgggtatttacccagctgtcgatccattggattctaaatccagattattggatgctactgttgttggtcaagaacattatgatgttgccactggtgttcaacaaactttacaagcttacaagtccttgcaagatatcattgctattttgggtatggatgaattgtccgaagccgataaattgactgtcgaaagagctcgtaagattcaaagattcttgtcccaaccattcgctgttgccgaagttttcactggtatcccaggtagattggttagattacaagatactgttaaatctttcaaagatgtcttggaaggtaaatacgatcacttgccagaaaa

SEQ ID NO: 476 - DNA, 1267 bp, Candida utilis
  strain Csp 388
tttgaacgcccttgagatcaagaaccacgagtctggaagattggtcctcgaggttgcccagcacttgggtgagaacactgtcagaactattgccatggatggtaccgaaggtctcgtccgtggtgagtctgttgttgacaccggttctccaattactgtcccagttggtcgtgagaccttgggtcgtatcatcaacgttattggtgagccaattgatgagcgtggtccaatcaacaccaagcacagaaacccaattcacgctgagccaccatccttcgctgagcagtctactgctgctgaggttttggagactggtatcaaggttgtcgaccttctcgccccatacgccagaggtggtaagattggtctctttggtggtgccggtgtcggtaagaccgttttcatccaggagttgattaacaacattgccaaggcccacggtggtttctctgttttcaccggtgtcggtgagagaaccagagagggtaacgatttgtaccgtgagatgaaggagactggtgtcatcaatctcgagggtgagtccaaggttgctctcgtcttcggtcagatgaacgagccaccaggtgcccgtgcccgtgtcgctttgaccggtttgaccattgctgagtacttcagagatgaggagggtcaggatgtcttgttgtttattgacaacattttcagattcacccaggccggttccgaggtgtctgccttgcttggtcgtattccatccgctgtcggttaccagccaactttggccaccgatatgggtttgttgcaggagagaattaccaccacccagaagggttccgtcacttctgtccaggccgtttacgtcccagctgatgatttgactgatcctgctccagccaccactttcgcccacttggacgccaccactgtgttgtcccgtggtatctctgagttgggtatttacccagctgtcgacccattggactccaagtccagattgttggacgctgccgttgttggtgacgagcactacaacaccgccaccgatgtccagcagacccttcaggcttacaagtctctccaggatatcattgctattttgggtatggatgagttgtctgaggctgacaagttgactgtcgagagagccagaaagattcagcgtttcctttcccagccattcgctgtcgctgaggttttcaccggtatcccaggtagattggttagacttcaggacaccatcaagtccttcagagaggttttggacggtaagtacgaccacttgccagag

SEQ ID NO: 477 - DNA, 1296 bp, Candida viswanathii
  ref <308>: DATABASE ACCESSION NUMBER: ATCC 28269
ccaattcgacgaaggtagcttgccagctatcttgaacgccttgaccttgaagaacggtgaccaagacttggtcttggaagttgcccaacacttgggtgaaaacactgtcagagctattgctatggatggtaccgaaggtttggtcagaggtactgctgtcactgacaccggtgctccaatctccgtcccagtcggtagaggtaccttgggtagaatcatcaacgttgttggtgaaccaattgacgacagaggtccaattgaatgtaaggaaagaaagccaattcacgctgaaccaccttctttcgttgaacaatccactgctgccgaaattttggaaaccggtatcaaggttgtcgacttgttggccccatacgccagaggtggtaagattggtttgttcggtggtgccggtgtcggtaagactgtctttatccaagagttgattaacaacattgccaaggcccatggtggtttctctgtcttcactggtgtcggtgaaagaaccagagaaggtaacgatttgtaccgtgaaatgaaggaaaccggtgtcatcaacttggaaggtgactccaaggtcgccttggttttcggtcaaatgaacgaaccacctggtgctagagctagagttgctttgactggtttgaccattgccgaatacttcagagacgaagaaggtcaagatgtcttgttgtttattgacaacattttcagattcacccaagccggttccgaagtgtctgctttgttgggtcgtattccatctgccgtcggttatcaaccaaccttggccaccgatatgggtcttttgcaagaacgtattaccaccaccaagaagggttccgtcacctctgtccaagctgtctatgtcccagccgatgatttgaccgatcctgctccagccaccaccttcgctcacttggatgccactactgtcttgtctagaggtatttccgaattgggtatctacccagctgtcgatccattggactccaagtccagattgttggatgctgctgttgttggtcaagaacattacgatgttgccactggtgtccaacaaaccttgcaagcttacaagtctttgcaagatatcattgccattttgggtatggatgaattgtctgaatccgataagttgactgtcgaaagagctcgtaagatccaaagattcttgtcgcaaccatttgctgttgccgaagttttcactggtatcccaggtagattagttagattgctggaaaccgtccaatctttcaaagacgtcttggctggtaaatacgatcacttgccagaaaa

SEQ ID NO: 478 - DNA, 1295 bp, Candida zeylanoides
  ref <308>: DATABASE ACCESSION NUMBER: ATCC 7351
tcaattcgagcaaggcaacctccctgccatcttgaacgctctcaccttgaagaatggtgacaacgacttggttttggaagttgcccagcacttgggtgagaacaccgtcagagccattgccatggatggtaccgagggtttggttagaggtgcgtccgtcaaggacactggcgcccctatctcggtccccgttggccgcgggactttgggtcgtatcatcaacgtcaccggtgaccccattgacgagagaggtcccatcgagctgacccagagaaaccctatccacgccgaccccccctcgttcgttgagcagtccaccaacgctgaggttttggagactggtatcaaggttgtcgatttgttggctccctacgccagaggtggtaagattggtttgttcggtggtgccggtgtcggtaagaccgtcttcattcaggagttgatcaacaacatcgccaaggcccacggtgggttctcggtcttcactggtgtcggtgagagaactagagagggtaacgacttgtaccgtgagatgaaggagaccggtgtcatcaacttggagggtgactccaaggtggccttggtgttcggtcagatgaacgagccccctggagccagagccagagtcgccttgaccgggttgaccattgccgaatactttagagacgaggagggtcaggatgtgttgttgttcgtcgacaacatcttcagattcacccaagctggttcggaggtgtcggccttgttgggtcgtattccctctgccgtcggttaccagcccaccttggcaactgatatgggattgttgcaggagcgtatcaccacgaccaagaagggttccgtcacctcagtgcaggccgtctacgtccccgctgatgacttgactgaccctgctcccgccaccacctttgcccacttggacgccaccaccgtgttgtccagaggtatctctgagttgggtatctaccccgccgtcgaccccttggactccaaatcgagattgttggacgctgccgtggtcggtcaggagcactacgatgttgcctcgaacgtccagcagaccttgcaggcctacaagtccttgcaggatatcattgccattttgggtatggatgagttgtccgaggctgacaagttgaccgttgagagagccagaaagatccagagattcttgtcgcagcccttcgctgttgccgaggttttcactggtatcaagggtagattggtcagattggaggacaccgtcagatctttcaaggaggttttggagggtaagtacgaccacttgcccgaga

SEQ ID NO: 479 - DNA, 534 bp, Coccidioides immitis
  strain Silveira
ttcaggaattgattgtaagttctgttatcaactaaagccgacagcggttgctgatatgctctagaacaacattgctaaggctcacggtggttactccgtgttcactggtgtcggtgagcgtacccgtgagggtaacgatttgtaccatgaaatgcaagagacccgtgtcattcaactcgacggagagtccaaggtcgctcttgtcttcggtcaaatgaacgagccccctggtgcccgtgcccgtgttgcccttaccggtttgaccattgctgaatacttccgtgacgaggaaggccaagacggtaggcttcatgcttctatcgctaggggcgtgtgatacaggaggctaatcgcttttctagtgcttctctttattgacaacattttccgtttcactcaagctggttctgaagtgtctgccttgctcggtcgtattccttccgctgtcggttaccaacctactctcgccgtcgacatgggtgttatgcaggaacgtatcaccaccaccaccaagggatccattacttcagtgca

SEQ ID NO: 480 - DNA, 494 bp, Cryptococcus albidus
  ref <308>: DATABASE ACCESSION NUMBER: ATCC 66030
cgtcttgattcaagaattgatcaacaacatcgccaaggcccacggtggttactcggtcttcaccggtgtcggtgagcgaactcgagagggtaacgatctgtaccacgaagtgagttgcgccgtccgagtgtttcccggggaatcgcaagactgatgttgtcccttcttctcagatgagggaaaccggtgtcatcaacctcgagggtgactccaaggtcgccttggtcttcggtcagatgaacgagccccctggagcccgagcccgagtcgccttgaccggtttgaccattgccgaatacttccgagacgaggagggtcaggatgtcttgttgttcattgacaacattttccgattcacccaagccggttccgaagtgtccgccttgttgggtcgtatcccctccgccgtcggttaccagcccactctgtccaccgacatgggtaccatgcaggagcgaattaccaccaccaagaagggttccatcacttccgtc

SEQ ID NO: 481 - DNA, 415 bp, Fusarium oxysporum
  strain WSA-212
ttcaggagcttatcaacaacatcgccaaggcccacggtggttactccgtcttcactggtgtcggtgagcgaactcgtgagggtaacgatctgtaccacgaaatgcaggagacttccgtcattcagcttgatggcgagtccaaggtcgccctggtcttcggtcagatgaacgagccccctggagctcgtgcccgtgtcgcccttaccggtcttactgtagctgaatacttcagagatgaggagggtcaggacgtgctgctcttcattgacaacattttccgattcactcaggccggttccgaggtgtctgcccttctcggtcgtatcccctctgccgtcggttaccagcccaccctcgccgtcgacatgggtggtatgcaagagcgtattaccaccaccaccaagggttccattac

SEQ ID NO: 482 - DNA, 1281 bp, Geotrichum spp.
  strain LEV-4
aggacaacctccccgctattcttaacgctcttgagcttaagagagataacggtgagaagctcgttctcgaggttgcccagcatctgggtgagaacactgtccgtactattgctatggacggtactgagggtctcgtccgtggtcagcccgttgttgacaccggtgcccccattaccattcccgttggtcgtggtactcttggtagaattatcaacgtcattggtgagcccatcgatgagcgtggacccattgaggctaccaagtacctccccatccacaccgagccccccaccttcgctgagcagtctacctccgctgaggttcttgagactggtatcaaggttgtcgatctccttgccccctacgcccgtggtggtaagattggtctcttcggtggtgccggtgtcggtaagaccgttttcattcaggagctgattaacaacattgccaaggcccatggtggtttctccgttttcaccggtgtcggtgagagaacccgtgagggtaacgatttgtaccgtgagatgaaggagaccggtgtcatcaacctcgagggtgagtctaaggtcgctctcgttttcggtcagatgaacgagccccctggagcccgtgcccgtgttgctcttactggtcttaccattgctgagtacttccgtgatgaggagggtcaggatgtgttgctcttcgttgacaacattttccgtttcactcaggccggttccgaggtgtctgcccttttgggtcgtattccctccgctgtcggttaccagcccacccttgccactgatatgggtgccctgcaagagcgtattaccaccacccagaagggttccgtcacttccgtccaggccgtctacgtccctgccgatgatttgaccgatcctgcccctgctaccaccttcgcccatttggatgccaccaccgtcttgtcgcgttccatttctgagttgggtatctaccccgctgtcgatccccttgattccaagtctcgtcttttggatatcaccgtcgttggccaggagcactacgatgttgctacccaggtccagcagaccctccagtcctacaagtctcttcaggatatcattgccattttgggtatggatgagttgtctgaggctgataagcttactgtcgagcgtgcccgtaagatccagagattcctttcccagcccttcactgtcgctgaggttttcactggtatcgagggccgtctcgttcctttgaaggacactgttcgctctttcaaggagatccttgagggcaagtacgaccacctcc

SEQ ID NO: 483 - DNA, 586 bp, Histoplasma capsulatum
  strain G186A5
attcaagaattgatcgtacgttcctccgccccacacacgatcaatggagaaagaaacaaattttttgggagtggtcattttttctaataattcgaatagaacaacattgccaaagcccacggtggttactccgtgttcactggtgtcggcgagcggacccgtgaaggaaatgacttgtaccacgaaatgcaggaaacccgtgttatccagctcgatggagagtccaaggtcgccctcgttttcggtcagatgaacgagcctcccggagcccgtgcccgtgttgccctcactggtctgaccgttgccgagtacttccgtgacgaggaaggccaagacggtatgtataagtatacaccgtagcaaatcaacacagagcttcactcacgctcggatttagtgcttctcttcatcgacaacattttccgcttcactcaggccggttccgaagtgtctgccctgctcggccgtattccctccgccgtcggttaccaacccaccctcgccgtggacatgggtggtatgcaggaacgtatcaccactaccaccaagggctccatcacctctgtgcargccgtctacgtccccg

SEQ ID NO: 484 - DNA, 1145 bp, Malassezia furfur
  ref <308>: DATABASE ACCESSION NUMBER: ATCC 42132
gcgtggccagaaggtcattgacactggtgctcccatcaccatccccgtcggtggtgccacactgggtcgtattctgaacgtcacgggtgaccctattgacgagcgtggccccgttaagactgacgttttccgccccattcaccgtgacccccctgcctttgtcgagcagtcgactgatgccgagattctcgagactggtatcaaagtcgttgacctgattgccccttacgcccgtggtggtaagattggtctgttcggtggtgccggtgtcggtaagaccgtgcttatccaggagctcatcaacaacatcgccaaggcccacggtggtttctccgtgttcactggtgtcggtgagcgtactcgtgagggtaacgatttgtaccacgagatgattgaaaccggtgtcattaacctcgagggtgactcgaaggtggctctggtgttcggtcagatgaacgagcccccgggtgcccgtgcgcgtgtcgctcttactggtctgactgtggccgagtacttccgtgacgacgagggccaggatgtgctgctgttcattgacaacattttccgtttcacccaggccggttcggagacttcggctctgctgggtcgtatcccttcgtcggtcggttaccagcccactttgtcgaccgatatgggtgccatgcaggagcgtatcaccaccaccaagaagggttcgattacgtcggtgcaggccgtctacgtgcccgccgatgatgtcactgaccctgcccctgccactaccttcgcccaccttgacgctaccactgtgcttgaccgttcgatcgctgagctgggtatctaccccgctgttgacccgttgaactcgaactcgcgtatgcttgaccccgctattgtgggtcaggagcactacgacgtggcctctggcgtgcagaagctgctccaggactacaagtcgcttcaagatatcattgccattctgggtatggatgagctttctgaggaggacaagctcactgtcgagcgtgcccgtaagatgcagcgtttcatgtcgcagcctttcgctgtcgcccaggtctttactggtatcgaaggtcgtcttgttgccctgaaggacacgatcaaggcctgcaaggagatcctgtcgggcaagcacgacaacctcc

SEQ ID NO: 485 - DNA, 1261 bp, Malassezia pachydermatis
  ref <308>: DATABASE ACCESSION NUMBER: ATCC 42756
tcccgccatcttcaacgccctggaggtccaggacatgaagaacggtggccgccttgttctggaggttgcccagcaccttggtgagaacactgttcgttgcattgctatggacggtaccgagggtcttgtccgtggtcagaaggtccttgacactggtgccccgatcactatccctgtcggtaacggtaccttgggccgyatcctgaacgtcactggtgagcctgtggatgagcgtggtccggttaagactgacgtctaccgtccaatccaccgtgagcccccggcgttcgttgagcagtcgactgatgctgagattcttgagactggtatcaaggtggtcgacctgctcgccccatacgctcgtggtggtaagattggtctwttcggtggtgcyggtgtyggtaagaccgtgctgattcaggagcttatcaacaacattgccaaggcccacggtggtttctcggtgttcactggtgtcggtgagcgtactcgtgagggtaacgatctgtaccatgaaatgattgagactggtgtcatcaacgttgacggtgactcgaaggtcgctctcgtgttcggtcagatgaacgagcccccgggtgcccgtgcccgtgtcgccctgacyggtctgaccatcgccgagtacttccgtgacgacgagggtcaggatgtgctgctcttcattgacaacattttccgtttcactcaggctggttcggagacttcggctctgctgggtcgtatcccgtcggctgtcggttaccagcckacccttgccacggatatgggtgccatgcaggarcgtatyaccaccaccaagaagggttcgattacctcggtgcaggcygtttacgttccggccgacgatgtgactgaccctgccccggccacgaccttcgcccacttggacgccaccacggtgttggaccgttcgattgcygagctgggtatctacccggccgtcgacccgctgaactcgaagtcgcgtatgcttgacccgtcaattgtcggtgtggagcactacaacgttgcttcgggtgtccagaagcttctycaggactacaagtcgctccaagatatcattgccattctgggtatggatgagttgtcggaggaggacaagctcactgtcgagcgtgcccgtaagatgcagcgtttcctgtcgcagcctttcgctgtggcccaggtcttcactggtatcgagggtcgtcttgtgtcgctcaaggacaccatcaacgcctgcaaggagattctgtccggtaag

SEQ ID NO: 486 - DNA, 1282 bp, Metschnikowia pulcherrima
  DSM 70336
aggagggcaacttgccagctatcttcaacgctttgacgttgaagaacggcgaccagaagttggtcttggaggtggcccagcacttgggtgagaacaccgtcagaaccattgccatggacggtaccgagggtttggtcagaggcgcctctgtcaccgacacyggtgcccctatctccgtgcctgtcggccgtgagaccttgggtcgtattatcaatgttgttggtgagccaatcgacgagagaggcccaatcaacaccaagaagagaaaccctattcacaccgacccaccttcgtttgtccagcaatccacttccgccgaggtcttggagactggtatcaaggttgtcgacttgttggccccttacgccagaggtggtaagattggtttgttcggtggtgccggtgtcggtaagaccgtgttcatccaggagttgattaacaacattgccaaggcccacggtggtttctccgttttcaccggtgtcggtgagagaaccagagagggtaacgatttgtaccgtgaaatgcaggagactggtgtcatcaacttcgagggtgactccaaggtcgccttggttttcggtcagatgaacgagcctccaggagctagagcyagagttgccttgaccggtttgaccatcgccgagtacttcagagacgaggagggtcaggatgtgttgttgttcgtcgacaacattttcagattcacccaagccggttctgaggtgtctgccttgttgggtcgtattccatccgctgtcggataccagccaaccttggccaccgatatgggtgccttgcaggagagaattaccaccaccaagaagggttccgtcacctccgtccaggccgtctacgtgccagccgatgacttgactgaccctgcgccagccaccactttcgcccacttggacgccaccactgtgttgtccagaggtatctctgagttgggtatctaccccgctgtcgaccccttggactccaactccagattgttggacgccaccgttgttggccaggagcactacgacgtcgccaccaacgtccagcaaactttacaagcttacaagtccttgcaggatatcattgccattttgggtatggatgagttgtccgagacccgacaagttgacccgtcgagagagccagaaagatccagaagttcttgtcccagccatttgccgtcgccgaggttttcaccggtattgagggtagattggttagattggaggacaccgttagatcctttaaggaggttttggaaggtaagtacgaccacttg

SEQ ID NO: 487 - DNA, 482 bp, Penicillium marneffei
  strain WSA-214
tgtctttatccaggagttgattgtacgtctttacctttctgcctgactgtttacgacaactaacgaaagcgtagaacaacattgccaaggctcacggtggttactctgtcttcactggtgtcggtgaacgtactcgtgagggtaacgatttgtaccacgaaatgcaggaaactggtgtcattcagctcgagggtgaatccaaggtcgccctcgtgttcggtcagatgaacgagccccccggtgcccgtgcccgtgtcgctcttactggtttgaccattgccgagtacttccgtgacgaggaaggtcaggacgtgcttctcttcattgacaacattttccgtttcactcaggccggttctgaggtgtctgcccttctgggtcgtatcccctctgccgtcggttaccagcccacccttgccgtcgacatgggtatcatgcaggagcgtattaccaccaccaccaagggttccatcacctccgtc

SEQ ID NO: 488 - DNA, 1290 bp, Pichia anomala
  ref <308>: DATABASE ACCESSION NUMBER: ATCC 18205
tcgaacaaggtaacttaccagctatcttgaatgctttagaaatcaaaaccccaagtggtactccattagttttagaagttgctcaacatttaggtgaaaacactgtcagaactattgctatggatggtactgaaggtttagttcgtggtgaacaagttactgatactggttctccaatcactgtcccagttggtcgtgaaactttaggtcgtattatcaacgttgttggtgaaccaattgatgaacgtggtccaattaacaccaaacaaagaaacccaattcacgctgaaccaccttcattcagtgaacaatcaactgctgctgaagttttagaaactggtatcaaagttgtygatttattagctccatacgctagaggtggtaaaattggtttattcggtggtgccggtgtcggtaaaactgtctttatccaagaattgattaacaacattgctaaagctcatggtggtttctcagttttcaccggtgttggtgaaagaaccagagaaggtaacgatttataccgtgaaatgaaagaaactggtgttattaacttggaaggtgattctaaggtcgctttagttttcggtcaaatgaatgaaccaccaggtgctagagctcgtgttgctttaactggtttgaccattgctgaatacttcagagatgaagaaggtcaagatgtcttgttattcgttgataacattttcagattcacccaagccggttcagaagtttctgccttattaggtcgtattccatctgctgtcggttatcaaccaactttagcaactgatatgggtttgttacaagaacgtattaccaccacacaaaaaggttcagttacttctgtccaagctgtttatgtcccagctgatgatttaacagatcctgctccagctaccactttcgcccatttggatgctactactgtcttgtctcgtggtatttcagaattaggtatttacccagctgtcgatccattagattctaaatcaagattattagatgcttcagttgttggtcaagaacattatgatgttgctaccaacgttcaacaaactttacaagcttacaaatctttacaagatattattgctattttaggtatggatgaattgtctgaacaagataaattgactgtcgaaagagcaagaaaaatccaaagattcttatctcaaccatttgctgttgccgaagttttcactggtatyccaggtagattggttagattaaaagacactatcaaatcattcaaagatgttttggaaggtaaatatgatcacttaccag

SEQ ID NO: 489 - DNA, 1291 bp, Pichia anomala
  ref <308>: DATABASE ACCESSION NUMBER: ATCC 2149
ccaattcgaacaaggtaacttaccagctatcttgaatgctttagaaatcaaaaccccaagtggtactccattagttttagaagttgctcaacatttaggtgaaaacactgtcagaactattgctatggatggtactgaaggtttagtccgtggtgaacaagttactgatactggttctccaatcactgtcccagttggtcgtgaaactttaggtcgtattatcaacgttgttggtgaaccaattgatgaacgtggtccaattaacaccaaacaaagaaacccaattcacgctgaaccaccttcattcagtgaacaatcaactgctgctgaagttttagaaactggaatcaaagttgttgatttattagctccatacgctagaggtggtaaaattggtttattcggtggtgccggtgtcggtaaaactgtctttatccaagaattgattaacaacattgctaaagctcatggtggtttctcagttttcaccggtgttggtgaaagaaccagagaaggtaacgatttataccgtgaaatgaaagaaactggtgttattaacttggaaggtgattctaaggtcgctttagttttcggtcaaatgaatgaaccaccaggtgctagagctcgtgttgctttaactggtttgaccattgctgaatacttcagagatgaagaaggtcaagatgtcttgttattcgttgataacattttcagattcacccaagccggttcagaagtttctgccttattaggtcgtattccatctgctgtcggttatcaaccaactttagcaactgatatgggtttgttacaagaacgtattaccaccacacaaaaaggttcagttacttctgtccaagctgtttatgtcccagctgatgatttaacagatcctgctccagctaccactttcgcccatttggatgctactactgtcttgtctcgtggtatttcagaattaggtatttacccagctgtcgatccattagattctaaatcaagattattagatgcttcagttgttggtcaagaacattatgatgttgctaccaacgttcaacaaactttacaagcttacaaatctttacaagatattattgctattttaggtatggatgaattgtctgaacaagataaattgactgtcgaaagagcaagaaaaatccaaagattcttatctcaaccatttgctgttgccgaagttttcactggtatcccaggtagattggttagattaaaagacactatcaaatcattcaaagatgttttggaaggtaaatatgatcactta

SEQ ID NO: 490 - DNA, 508 bp, Rhodotorula minuta
  ref <308>: DATABASE ACCESSION NUMBER: ATCC 10658
cgtattgattcgtgagtggccgttcccttacagcaagcttataaaggagcgaaaaagatctgacattcggcttatgtgctatacagaggaactcatcaacaacgtcgccaaggctcatggtggttactctgtcttcaccggtgtcggagagcgaacacgtgaaggtaacgatctctaccacgaaatgattgaaaccggtgtcattcagctcaagaacgacaagtccaaggccgctctggtcttcggacagatgaacgagccccccggagctcgtgcccgtgtcgctctgaccggtctcaccatcgccgagtacttccgtgacgtcgaaggacaggatgtgctactcttcatcgacaacattttccgattcacccaggccggttcagaggtatctgccctgctcggacgtatcccatctgctgtcggataccagcccacactctcaaccgatatgggtggtatgcaagagcgaatcacaaccaccaagaagggttcgattacctccgtc

SEQ ID NO: 491 - DNA, 686 bp, Rhodotorula mucilaginosa
  ref <308>: DATABASE ACCESSION NUMBER: ATCC 66034
tgtcctcattcaggagctcatcaacaacatcgccaaggcccacggtggttactcggtcttcaccggtgtcggcgagcgtacccgtgagggtaacggtgagtctcccccttcaaacttttggccggctagttggcgcagcgcaaactgacgcgcgcgccctgtccagacttgtaccacgagatgatcgagactggtgtcatccagctcgagaacgacaactcgaagtgcgctctcgtgttcggccagatgaacgagccccctggtgcccgtgcccgtgtcgctctcactgggttcgtcctttctctctctcgagcgtcctggcttgatacggaacgctgacacgtcacgcagtctcactattgctgagtacttccgtgacgaggagggccaggacgtgctcctcttcatcgacaacatcttccgtttcacccagggtgagccgcctccgcgggcattctcccgtttctttcgcgctgacgtctgtcccgtatagccggttcggaggtgtctgcccttctcggacgtatcccgtccgctgtcggataccagccgactctctcgaccgacatgggtcagatgcaggagcgtatcacgtaagtttggccgcagctccgtccgcggcgccctttgtgtctgaccgtgttccaccgctcagcaccaccaagaagggctcgatcacctgtgtc

SEQ ID NO: 492 - DNA, 625 bp, Sporobolomyces salmonicolor
  ref <308>: DATABASE ACCESSION NUMBER: ATCC 32311
tgtcttgattcaggagctcatcaacaacgtcgccaaggcgcacggtggttactccgttttcaccggtgtcggtgagcgtacccgtgagggtaacggtgagcacactttcgccgacctggccattccggaacgtgcggactgacgaggaccacctcgaacagatctctaccacgagatgatcgagaccggtgtcattcagctcgacaacgacaagtcgaagactgctctcgtcttcggccagatgaacgagccccctggcgcccgtgcccgtgtcgctcttactggtctcaccatcgcggagtacttccgtgacgacgagggccaggacgtgcttctcttcatcgacaacatcttccgtttcacccagggtacgttcgatcccgcccgtccaacacgaatgtcgtggtgactgacaacctgttgcgcgtgcagccggttcggaggtgtctgcccttctcggtcgtatcccgtccgctgtcggataccagcccactctctcgaccgacatgggtggcatgcaggagcgtatcacgtacgccctcttctgctttctctcgtttcgctctgcatcgctcacgcatgttcgcccgacagcaccaccaagaagggttcgatcacctgtgtc

SEQ ID NO: 493 - DNA, 1211 bp, Sporothrix schenckii
  strain WSA-148
tctcgtccgtggtgctaaggccactgacactggttcccccattaccatccccgtcggccccggtaccctcggtcgcatcatgaacgtcaccggtgacccgatcgacgagcgcggtcccatcaagaccgacaagttccgtcccatccacgctgaggctcccgagttcgttgaccagtcgaccaccgctgaggttctcgtgactggtatcaaggtcgtcgatctgcttgctccctacgcccgtggtggtaagattggtctgtttggcggtgccggtgttggcaagaccgtgttcatccaggagctcatcaacaacatcgccaaggcccacggtggttactccgtcttcaccggtgtcggcgagcgtacccgtgagggtaacgatctgtaccacgaaatgcaggagacctctgtcattcagcttgacggtgactccaaggtcgccctggtgttcggtcagatgaacgagccccctggtgctcgtgcccgtgtcgccttgaccggtttgactgtcgctgagtacttccgtgacgaggagggccaggatggtatgttttgaattatttccttgtcgtacagttccaaatcgaagaattactaacttgtcagtgcttctcttcatcgacaacattttccgcttcacccaggccggttctgaggtgtctgcccttctgggtcgtattccctccgctgtcggttaccagcccacgctcgccgtggacatgggtctgatgcaggagcgtattaccaccacccgcaagggctcaattacctccgtccaggccgtctacgtgcccgctgacgatctgacggatcccgcccccgccaccaccttcgcccatctggacgccaccactgtgctgtcccgaggtatctctgagctgggtatctaccccgctgtcgaccccctcgactccaagtcgcgtatgctggacccccgtattgtcggtgacgaccactacgagaccgccactcgcgtccagcagatcctccaagagtacaagtcgctgcaggacatcatcgccattctgggtatggacgagctgtctgaggccgacaagcttacagtcgagcgtgctcgtaagatccagcgtttcctgagccagccgttcacggtcgcgcaggtcttcactggtatcgaaggccagctggtcgatctgaaggacactatcgcttcgttcaaggctatcctgagcggtgagggtgacagcctt

SEQ ID NO: 494 - DNA, 1133 bp, Stephanoascus ciferrii
  ref <308>: DATABASE ACCESSION NUMBER: ATCC 52550
tcttgttagaggcaccccagtcaaggacactggtgctccaattaccattccagttggtaacggcactttgggccgtatcgtcaacgttctcggtgagccaattgatgagcgtggaccagtcaaggctgacaagttcagacctattcacgctgagccaccaaccttcgctgaccagtccacctctgccgaggttcttgagaccggtattaaggttgtcgacttgcttgccccttatgccagaggtggtaagattggtcttttcggtggtgccggtgtcggtaagactgtgttcattcaggagcttattaacaacattgctaaggcccacggtggttactctgtcttcactggtgtcggtgagcgaactcgtgaaggtaacgatttgtaccacgaaatgatggagaccggtgtcatcaaccttgagggtgactccaaggtgtctcttgtgttcggtcagatgaacgagcctccaggagcccgtgcccgtgttgccttgaccggtttgaccattgccgagtacttcagagatgaggagggccaggatgtcttgttgttcattgacaacattttccgattcacccaggccggttctgaggtctctgccttgttgggtcgtatcccatctgccgtcggttaccaaccaaccttggctactgatatgggtggtcttcaagaacgtattaccaccactcaaaagggttccgtcacctctgtccaggctgtctacgtcccagctgacgatttgactgatcctgccccagctaccaccttcgcccatttggacgccaccaccgaattgtcccgatctatctctgagttgggtatctacccagctgtcgaccctcttggttccaagtcccgtcttttggatgcctccgtcgtcggccaagagcactacgacgttgccgccaacgtccaacagaccttgcaggcctacaagtctctccaggatatcattgccattttgggtatggacgaattgtctgaggctgataagctcactgtcgagcgtgctcgtaagatgcagagattcctttctcagccattcaccgtcgctgaggtcttcactggtctcgagggtagactcgtttctttgaaggacaccatccgatccttcaaggagatccttgacg

SEQ ID NO: 495 - DNA, 608 bp, Trichophyton mentagrophytes
  strain WSA-225
ggagttgattgtaagtcatttgaaacccagccccaagaaacagaagctaggcgaaaattggacaattgagcaatttagccattggagaaaagaaatttcgagtattaattgtttttatagaacaacattgccaaggctcacggtggttactctgtcttcactggtgtcggagagcgtacccgtgaaggaaacgatctctaccatgaaatgcaggagacccgtgtcattcagcttgatggcgagtccaaggtcgccctggtcttcggccagatgaacgagcccccaggtgcccgtgcccgtgttgctcttactggtttgaccattgctgagtacttccgtgatgaggaaggtcaagacggtgagtttcttatggataaaaaaaaatttttttttttttttttttttttcaagaaattcatgttctaacaaagtgtattctagtgcttctcttcatcgacaacattttccgtttcactcaggctggttccgaagtgtctgccctgcttggtcgtatcccatctgccgtcggttaccaacccactcttgccgtcgacatgggtggtatgcaggaacgtattaccaccaccaagaagggatccattacctcc

SEQ ID NO: 496 - DNA, 794 bp, Wangiella dermatitidis
  strain WSA-229
gtttattcaagaactcattgtgggtggcattctcataatgtttcggccacaattactgattgaaaatagaacaacattgcaaaggctcatggtggttactccgtgttcactggtgtcggcgagcgaactcgtgagggtaacgacttgtaccacgaaatgcaggagacctctgtcattcagctcgatggcgagtccaaggtcgcgctggtgtttggtcaaatgaacgaacctcctggtgctcgtgctcgtgttgctctgactgggtaagttgttccttcgcttcttgcgcgtatccacatccccatcttgagaatacgtctgccaccatgtcatgtgatgttgggctggttctggtttttgggaggccctcaagttcaatttttggatgacagcaccagctttacaagattatgctaacttaatggagtcttacggtggctgagttcttcagggatgaggagggacaggatggtaagtttgataacaatctcgtcggtgtcaatatcgacggcgtactcttcgcatcaaaaaaccaaagaggtggtttggtgtgagaagtgcgccggaaataatggcaaccacgtgacaatgaccacgtgtggggctcccgtgctaacacgtgacagtcttgctcttcatcgacaacattttccgattcactcaasccggttctgargtgtctgccttgcttggtcgtattccatctgccgtcggttaccaacccacactcgccgtcgacatgggtctcatgcaggaacgtatcaccaccacccggaagggatccatcacatctg

SEQ ID NO: 497 - DNA, 1148 bp, Yarrowia lipolytica
  ref <308>: DATABASE ACCESSION NUMBER: ATCC 38295
tcttgtccgaggcaccgccgtcgctgacaccggtgctcccatcactatccccgtcggccgaggtacccttggtcgaatcatcaacgtctgtggtgagcccattgacgagcgaggacccatcgaggcttccaagtacctccccatccacgctgacccccctaccttcgctgagcagtctacctccgctgaggttctcgagaccggtattaaggtcgtcgacctcctcgccccttacgcccgaggtggtaagattggtctcttcggtggtgccggtgtcggtaagactgtcttcatccaggagctgattaacaacattgccaaggcccatggtggtttctccgttttctgcggtgtcggtgagcgaacccgagagggtaacgatctttaccgagagatgaaggagactggtgtcatcaacctcgagggtgagtctaaggtcaccctcgtcttcggtcagatgaacgagcctcccggagcccgtgcccgagtcgcccttactggtctgaccattgccgagtacttccgagacgaggagggtcaggatgtgttgctcttcgttgacaacattttccgattcacccaggccggttccgaggtgtccgctctgcttggtcgaattccctccgctgtcggttaccagcccactctggccaccgatatgggtgccctccaggagcgaattaccaccacccagaagggttccgtcacttccgtccaggccgtctacgtgcctgccgatgatttgaccgatcctgctcccgccaccaccttcgcccatcttgacgccaccaccgtcctgtcccgaggtatttccgagctgggtatctaccccgctgtcgatccccttgattccaagtctcgacttctggatatcgatgttgtcggaaaggagcactacgatgttgcttccaacgtccagcagaccctccaggcttacaagtctctccaggatatcattgccattcttggtatggatgagctgtccgagcaggacaagctgaccgtcgagcgagctcgaaagatccagcgattcctgtctcagcccttcaccgtcgccgaggttttcaccggtattgagggacgacttgtctctctcaaggacactgtccgatccttcaaggagatccttgacggtaagcacgatgctc

SEQ ID NO: 498 - DNA, 966 bp, Aspergillus fumigatus
  strain WSA-172
gcgctattgtcgttgttgctgcctccgacggtcagatgtaggtggaacatcttgggaaatacgtcgtaaaacacgtcgcttacgttttcgcgaataggccccagactcgtgagcatttgctgctcgcccgccaggttggtgtccagaagatcgttgtcttcgtcaacaaaatcgatgctattgatgatccggagatgctggaactggtcgaactcgagatgcgtgagctgctgaacagctacggtttcgagggtgaagagactccgatcattttcggttccgctctctgtgctctcgaaggacgccgtgacgacatcggtaaagacagaattgagcagcttatgaacgctgtcgacacctggatccccactcctcagcgtgacctcgacaaacctttcttgatgtctgtcgaggaagtgttctctatcgccggccgtggtaccgtggcttctggtcgtgtcgagcgtggtatcttgaagaaggactctgaggttgagattgttggaggctccttcgaacccaagaagaccaaagtcaccgacattgaaaccttcaagaagagctgtgatgaatcgcgtgctggtgacaactctggtctcctcctgcgtggtatccgacgtgaagacgtcaagcgtggtatggtcattgctgttcccggcagcaccaaggctcacgacaagttcctcgtctccatgtacgtcctgaccgaggcggagggtggtcgtcgtactggcttcggtgccaactaccgtccccaagtcttcatccgtactgcaggtaagttcccgcacaccgtgtccagatcttccgagagattagcgatatatgctaatgattcatcagacgaggctgctgacctcagcttccctgacggcgaccaatctcgcagagttatgcctggtgacaacgtcgagatgatcctgaagacccaccaccctgttgctgctgaggctggtcaacgcttca

SEQ ID NO: 499 - DNA, 846 bp, Blastoschizomyces capitatus
  ref <308>: DATABASE ACCESSION NUMBER: ATCC 10663
tggtgctattattgttgttgctgcttctgatggtcaaatgccccaaacccgtgagcacttgcttcttgctcgtcaagttggtgttaagcacattgttgttttcgttaacaagattgatactattgatgatcctgaaatgttggaacttgtcgaaatggaaatgagagaacttctttcttcttacggttttgatggcgataacacccctgtcattatgggttctgctctctgtgctcttgaaggtcgtgaaccagaaattggtgaacaaagaatcaaccaactccttgatgctatcgatgaatacattcctaccccagttcgtgatatggaccaacctttcttgatgccacttgaaggtgttttctctattccaggtcgtggtactgttgccactggacgtgtctatcgtggtactttgaagagaggtgaagaagttgaagttgttggctacaatgatgctccaatcaagaccaccgttactggtattgaaatgttcaagaaggaacttgatcaagctcaagctggtgacaacgctggtattcttttgagaggtgttaagcgtgaagaccttaagcgtggtatggttgttgctaaaccaggtaccgttaagccacacaccaagttccttgcctccatctatgttttgactaaggaagaaggtggcagacactctggctttggtcttaactacagacctcaacttttccttggttctgctgatgttaccactgtcttgaccttcccagagggtgttgaccaaagcactcaagtcatgccaggtgacaacactgaaatggtttgcgaacttgttcacccagttgctgtcgaacaaggccaacgtttcaa

SEQ ID NO: 500 - DNA, 846 bp, Candida rugosa
  ref <308>: DATABASE ACCESSION NUMBER: ATCC 96275
ggtgccattattgttgttgctgcctctgatggacagatgccccagacccgtgagcatcttttgcttgcccgccaagtcggtatgcaaaaggtcgttgtgtttgttaacaagattgataccattgatgaccctgaaatgcttgatcttgtcgagatggagatgcgtgaactgttgaatgaatatgacttcgatggagataactctcctgtcattatgggctctgctcttgctgctcttgaggacaagaaccccgagattggtaaggaccgtatcatgcagctcttggacgctgttgatgaatggatccctacccccgagcgtgaccttgacaagcctttcatgatgcctattgaggcctctttctccatttctggtcgtggtactgttgccactggccgtgtcgagcgtggtattctcaagaagggtgaggaagtcgagatcgttggtttcaacaagcagcccctgaaatctgttgttactggtattgaaatgttcaagaaggaacttgatcaggcccagggcggtgataatgctggtatcttgcttcgtggtattcgtcgtgaggacttgcagcgtggtatggttttggccaagcctggaactgttaaggctcacaccaagttcctttcctccatctacgttctctccaaggaagagggcggccgtcactctcctttcggtatgaactatcgtccccagatgttcgtttctgcagctgatgtcaccgttactcttactttccctgagggtgttgaacagcacactcaggtcttccctggtgagaacaccgagatggttggcgagctcgttcaccctactgctattgaggttggtcaacgcttcaac

SEQ ID NO: 501 - DNA, 944 bp, Coccidioides immitis
  strain Silveira
agttgtcgtcgttgctgcttcagacggtcaaatgtatgcaaccgagagcactcccggatcttggtttaaatggcactaatataagacaggcctcaaactcgagagcatttacttctcgcccgtcagatcggtatccaaaaaatcgtcgtcttcgtgaacaaggttgatgccatcgaggacaaagagatgttggagcttgttgaattggagatgcgtgaactcctaaccagctacggtttcgagggtgaagaaactcccatcatttttggctctgctctctgtgccctcgaaggaagacaacccgagatcggtgttaccaagattgatgagctcttgcaggccgtcgacacctggattcccactcctcagcgtgagactgacaagcccttcttgatgtccattgaggaagtgttctctatttccggacgaggaaccgttgtctccggccgtgtggagcgtggtatcctcaagaaggactccgaagttgaaattgtcggcggttcgcccgagccaatcaaaaccaaggttaccgatatcgaaacctttaagaagtcttgcgacgagtctcgcgctggtgataactccggcttgctcctacgaggcgttaagcgtgaagatattagccgtggcatggtcgtcgctgtaccaggaagtgtcaaggcccatactgaattcttagtttcgctttacgtcctcaccgaagctgagggtgggcgcaaatctggattcagcagcaagtaccgcccacagatgttcattcgcactgccggtatgtaatactgtgataatttcgttgacatggtactgattgaattctatagacgaagcggctcagctcagctggcccggagaagatcaagacaagatggctatgccaggagacaatatcgaaatgatttgcaccaccttgcacccagttgccgccgaggctggccagcgattca

SEQ ID NO: 502 - DNA, 849 bp, Fusarium oxysporum
  strain WSA-212
gctatcatcgtcgttgctgcctccgatggacagatgccccagacccgtgaacacttgctcctcgctcgtcaggtcggtgtccagcgaattgtcgtcttcgtcaacaaggtcgatgccattgatgaccccgagatgcttgagctcgtcgagatggagatgcgcgagcttcttaacacctacggcttcgaaggcgacgacactcccgtcatcatgggctctgctcttatgtctctccagaaccagcgccccgagattggcaccgagaagatcgatgagctccttgctgccgtcgacgagtggatcccaacccccgagcgtgaccttgacaagcccttccttatgtccgtcgaggatgtcttctccattgccggccgtggtaccgtcgtgtctggccgtgtggagcgtggtattctgaagcgtgatcaggagatcgagcttgtcggaaaggggcaggaggttatcaagaccaaggttaccgacattgagaccttcaagaagtcttgtgagcagtcccaggctggtgacaactctggtctcctcatccgaggtgttcgccgtgaggatgtccgccgtggtatggttgtctgcgctcctggcaccgtcaagtctcatacccagtttctcgcttccctctacgtcctcaccaaggaggagggtggccgacacaccggtttccaggagcactaccgaccccagctctatctccgaactgcagatgagtccattgacctgactttccccgagggtactgaggatgcctccagtaagatggtcatgcctggtgacaacaccgagatggttgtcaccatgggtcaccccaatgccatcgaggttggtcagcgattcaac

SEQ ID NO: 503 - DNA, 1064 bp, Histoplasma capsulatum
  strain G186A5
tggtgctattgtcgttgttgctgctgctgacggccaaatgtaagacgccgcgagggactgctgagggttttatgctttttaggcccccttgtttctgagagcatgatgatactaatattcggaaacgtatctattaggcctcaaacacgtgagcatttgctccttgcccgacaggtcggtgtccaaaagatcgtcgttttcgtgaacaaagtcgacgcccttgaggacaaggagatgttggagcttgtcgagttagaaatgagagagctcttaaacacctacggcttcgagggtgaagagacacccatcatctttggttctgccctttgcgccatggaaggccgtgagcctgagttgggagaaaagaaaattgatgaattgctggaggctgttgatacttggatccccacaccacaacgtgataccgaaaaacctttcttgatgtccgttgaggaagtattctctatctccggccgtggaaccgttgcctccggtcgtgttgagcgcggtgtcctcaagaaggattcagaagtcgagctaattgggggcggctccacccccatcaggacgaaggtaactgatatcgaaactttcaagaaatcctgtgacgagtctagagctggggacaactccggtcttttattgcgtggtatcaagcgtgaagatatccgccgtggtatggtagttgccgttcctggcagcgtcaaggcccacgacaagttcttggtgtcgatgtatgtcctgaccgaagctgagggtggtcgccgaaccggattcggccagaactatcgtcctcaaatgttcatccgcacagctggtatgtcaaaatgggaccccttttcataatcctttctttttttccttttcctctctatctctctttctgtttcctttcaactcgcctgattcacgaaattaactaacccgtttgattatagacgaagccgcccatctcagcttccctagtggagcagatgaaagcaaactcgttatgcctggtgacaacgtcgagatgatcctccagacacaccgccccgtggctgctgaggccggccagcgattca

SEQ ID NO: 504 - DNA, 982 bp, Paracoccidioides brasiliensis
  ref <308>: DATABASE ACCESSION NUMBER: ATCC 32071
tggtgctatcgtcgttgttgctgcctctgacggccaaatgtagggattttgcaagactggtgaaaaaatctaaagaaaatagaaaagattgtgctgatgtttggtatcaggccccaaacacgcgagcatctgcttcttgccagacaagtcggtgttcagaaaatcgttgttttcgtcaacaaggtcgatgctgtagaggataaggagatgttggagcttgtcgaattggagatgagagagctcttgaccacctatgggttcgagggtgagaagacacctatcatctttggttctgcgctctgtgctatggagggccgtcagcccgagttgggagagcagaaaattgatgaattactcgaggctgtggatacttggatccctacgccacagcgtgatactgacaagcccttcctgatgtccattgaggaggtgttctctatctctggacgaggaaccgttgcctccggccgcgttgagcgtggtatcctcaagaaggactccgaagttgaaattattggcggcggtgttcccacaatcctgaccaaggtgactgatatcgaaaccttcaagaagtcttgcgacgagtccagagccggggacaactccggcctcttgttgcgcggtgtcaagcgtgaggatatccgccgtggtatggtcgttgcagttcccggaagcgtcaaagcacatgacagattcttggtgtcgatgtacgttctgaccgaggctgagggtggtcgccgcactggcttcggtcagaactatcgtcctcaaatgttcatccgcacagctggtacgttcattctttcactatattcctatatgcatagcccgatcctcccattaactaattgacacagacgaggctgctgaactcagctggcctgatggagacgacgaagccaaaatggtcatgcccggtgacaatgttgaaatggtcctgaagtcacaccgcccggggccgctgaggctggacagcgattca

SEQ ID NO: 505 - DNA, 931 bp, Penicillium marneffei
  ref <308>: DATABASE ACCESSION NUMBER: ATCC 58950
cgctgttgttgtcgtcgctgcttctgatggtcaaatgtaacatatccacgagctgccaattatggacactgctgataagaataggccccaaacccgtgagcacttgctcctcgcccgtcaggtcggtgttcaaaagatcgtcgtcttcgtcaacaaggttgatgccgtcgaggaccccgagatgttggaacttgtcgaattggaaatgcgtgaactcttgaccacctacggtttcgagggtgaagagacccctatcattttcggatccgctctttgcgccttggaaggccgcaagcccgagattggcgaacagaagattgacgagctcatgaacgccgttgatacctggatccccaccccccagcgtgaccttgacaagcccttcttgatgtccgttgaggaagttttctccatctctggtcgtggtaccgttgcatctggtcgtgttgagcgtggtattttgcgcaaggattctgaggttgagattatcggataccagaagaaccctatcaagaccaaggttaccgacattgagaccttcaagaagtcttgcgatgaatctcgtgctggtgacaactctggcttgcttctccgtggtatcaagcgtgaggacattcgtcgtggtatggttatcgctgctcctggaaccaccaaggctcatgacaacttcttggtctccatgtatgtcttgactgaggctgaaggtggtcgtcgtactggattcggcgccaactaccgtcctcaagctttcatccgtactgccggtatgttccctttcaaagtcaattaatgagcgatttgctaacgagttatagatgaggctgctactctcagcttccccggtgacgatcagtccaagcaggtcatgcccggtgacaacgttgagatgatcttgaagacacaccgtcccgttgccgccgaagctggtcag

SEQ ID NO: 506 - DNA, 846 bp, Pichia anomala
  misc_feature (1)...(846): n=a,t,c or g
  ref <308>: DATABASE ACCESSION NUMBER: ATCC 18205
tggtgctattattgttgttgctgcttctgatggtcaaatgcctcaaaccagagaacatttrttattggctagacaagttggtgttcaacacattgttgtctttgttaacaaagttgatactattgatgacccagaaatgttggaattagttgaaatggaaatgagagaattgttaagtacttatggttttgatggtgataacgtcccagttgttatgggttctgctttatgtgccttggaaggtcgtgaagaagaaattggtgtcaaagctattgataaattattagctgctgttgatgaatatatcccaaccccacaaagagatttagaaaaaccattcttgatgggtgttgaagatgtcttytcaatctcaggtagaggtaccgttgttactggtcgtgttgaacgtggtaacttgaagaaaggtgatgaagttgaaattgttggtttaaacaaaactccattgaaaactactgtyacnggtattgaaatgttcaaaaaagaattggaccaagctatggctggtgataactgtggtatcttattacgtggtatcaaaagagatgacatyaaaagaggtatggttattgctaaaaccggtaccatctcwgctcacactaaattcttagcctcaatgtatattttgactaaagaagaaggtggtcgtcactcaggttttggtgaacattacagacctcaattattcatcagaactggtgatgttaccgttgttttaaccttyccagaaggtggtgattcatctcaacaaatcttaccaggtgacaatgtcgaaatggtttgtgaattggttcacccaactgctttagaagctggtcaaagattcaa

SEQ ID NO: 507 - DNA, 964 bp, Trichophyton mentagrophytes
  strain WSA-225
ggagctgttgtcgttgtcgcagcttctgacggtcaaatgtaattgaatgcccgcccagacggatgaaaggatttgacgtttctaacatcagtctaggcctcagaccagagaacatttgctccttgcccgccaggtcggtgtccagaagctggtcgttttcgttaacaaggtcgatgccgttgaggacccagagatgttggagcttgtcgaacttgaaatgcgtgaactcctcagccactacagttttgagggtgaggagacccccatcatttttggctctgctctctgtgccctcgagtcccgtcgacctgagcttggtgtcgagaagattgacgagctattgaacgccgtcgacacctggatccccacccccgagcgcgccactgataagcctttcctcatgtccattgaggaagtgttctctatctctggtcgtggtaccgtcgtctccggtcgtgttgagcgtggtatcctcaagaaggattccgacgtcgaaattgttggtggctctaccacccctatcaagaccaaggtcacagatatcgaaaccttcaagaagtcctgcgatgaatctcgagctggtgacaactctggtctccttctccgaggtatcaagcgtgaggacttgaagcgtggaatggttgttgctgcccccggatccaccaaggctcacaccgacttcatggtctccctctacgtcctgactgaggctgagggtggtcgttccaacggcttcacccacaagtaccgccctcaaatgttcatccgtactgctggtatgtaaccaaagtttccgctatttactaagtagatcattgctaacttgtattcccttccgtagacgaagccgcatctttcagctggcctggagaagaccaagacaagaaggctatgcctggtgacaacgtcgagatgatttgcaaaaccctccaccccattgctgccgaggctggccaacgattca

SEQ ID NO: 508 - DNA, 844 bp, Yarrowia lipolytica
  ref <308>: DATABASE ACCESSION NUMBER: ATCC 38295
ggtgctatcattgtcgttgctgctggagacggttccaagccccagacccgagagcatctgctgcttgctcgacaggtcggtgtccagaacctggttgtgtttgttaacaaggttgatcagattgatgataaggagattcttgagctcgttgacatggagatgcgagatctgctgacccagtacggttttgatggtgacaacacccccgttgtcatgggctctgctctgtgcgctcttgagggcaagcagaaggatattggagaggacgccatcatggcccttatggatgccgttgatgagcacatccctacccctaaccgtgaccttgagaagcccttcctgatgcccgttgaggacgttttctccatctctggccgaggaactgttgttactggccgagtcgagcgaggaaacctgaagaagggtgaggaaatcgagattgttggctacaacaacaagcccatcaaggctgttgttaccggtattgagatgttcaagaaggagctcgagtccgccatggccggtgacaacgccggtatcctgctccgaggtatcaagcgagacgagatcaagcgaggtatggtcatgtgcaagcctggcaccgtcaacgcccacaccaagttccttgcttctctttacatcatccccaccgaggagggtggtcgaaccagctctttcggcgccaactaccgaccccagatgttcatccgaacttcttccgtcaccgccactctcaccttccccgagggtaccgacgagtcccagaccgtcaaccccggtgacaacactgagatggttctcgagcttgttcaccctaccgccattgaggtcaaccagcgattca

SEQ ID NO: 509 - DNA, 1067 bp, Babesia bigemina
  strain Suarez-2
cttggacaagctgaagagcgagcgtgagcgtggtatcaccattgacattaccctgtggaagttcgaaactggcaagtactactacaccgtcattgacgcccccggtcaccgtgacttcattaagaacatgattacgggtacctcccaggccgatgttgctatgcttgtcgtgcccgccgaggctggtggtttcgaagctgccttctctaaggaaggtcagacccgtgagcacgctcttttggccttcacccttggtgtcaagcagatcatttgcgccatcaacaagatggacaagtgcgactacaaggaggaccgttacagcgaaatccagaaggaagttcagggttacctgaagaaggtcggttacaacatcgagaaggtgcctttcgtcgccatctccggtttcatgggtgacaacatggttgagcgctccaccaacatgccgtggtacaagggcaagaccttggtcgaggccctcgacatgatggagcccccgaagaggcccgtcgacaagcccctgcgtcttcccctccagggtgtgtacaagatcggtggtatcggtaccgtccctgtcggtcgtgtggagactggtcagctcaaggccggtatggtcctcaccttcgcccccaacccgatcactactgagtgcaaatccgtcgaaatgcaccacgaagttatcgatgttgccagccctggtgacaacgttggtttcaacgtgaagaacgtgtccacctctgacatccgcactggtcacgtcgcttctgactccaagaacgaccccgccaaggccgccgtgtccttcaccgcccaggtcatcatcttgaaccaccctggtaccatcaaggccggttactcccctgtggttgactgccacactgcccacatctcgtgcaaattcgacgagatcaccagccgtatggacaagcgtaccggtaaggcccttgaggagaaccccaagaccatcaagaacggcgacgccgctatggtcgtcctgaagccgtgcaagcccatggtcgtcgaggccttcactgaatacgctccccttggtcgtttcgccgtgcgtgacg

SEQ ID NO: 510 - DNA, 1049 bp, Babesia bovis
  strain Suarez-3
gtgaacgtgaacgtggtattactattgatattaccttatggaagttcgagaccaccaagtactactacaccgtcattgatgcccctggtcaccgtgacttcatcaagaacatgattacgggtacttctcaagccgatgttgctatgcttgttgtaccagctgaggctggtggtttcgaggccgctttctccaaggaaggacagacccgtgagcacgctcttttggctttcacccttggtgtcaaacagatcatctgtgccattaacaagatggacaagtgcgactacaaggaggaccgttacagtgaaatccagaaggaagtccagggttacctcaagaaggtcggttacaatattgagaaggtgcccttcgttgccatctccggtttcatgggagacaacatggttgagcgttccaccaacatgccctggtataagggaaagacattggtcgaggcccttgatcagatggaacccccaaagaggcccgttgacaagccacttcgtcttcccctccagggtgtctacaagatcggtggtatcggtaccgtccccgtcggtcgtgttgaaactggtatgttgaaggctggtatgattctaacctttgctcctaacccaatcaccactgaatgcaaatccgttgaaatgcaccacgaaaccgttgaggttgcttaccccggtgacaacgtcggtttcaacgtaaagaacgtttctacttctgacattcgcagtggtcacgttgcctctgattctaagaacgaccctgccaaggctgctgtttccttcactgcccaggtcattgtgctcaaccaccctggtaccattaaggccggttactgccccgtcgtcgattgccacaccgctcacatttcatgtaaattcgaagagatcaccagccgtatggacaagcgtaccggtaaatctcttgaggaaaaccccaagaccatcaagaacggtgacgctgccatggttgtgctcaagccaatgaagcccatggttgtcgaatccttcactgagtatgctcctcttggtcgtttcgctgttcgtgac

SEQ ID NO: 511 - DNA, 1070 bp, Crithidia fasciculata
  ref <308>: DATABASE ACCESSION NUMBER: ATCC 11745
tggacaagctgaaggcggagcgcgagcgcggtatcacgatcgatattgccctgtggaagttcgagtcgcccaagtccgtgttcacgatcatcgatgcccccggccaccgcgacttcatcaagaacatgatcaccggcacctcccaggccgatgccgccattctgatgattgactcgacccagggtggcttcgaggctggcatctccaaggacggccagacccgcgagcacgccctgcttgccttcacgctgggcgtgaagcagatggttgtgtgctgcaacaagatggacgacaagacggtgcagtacgcccaggcccgctacgaggagatcagcaaggaggtcggcgcgtacctgaagcgcgtgggctacaacccggagaaggtgcgcttcatcccgatctcgggctggcagggcgacaacatgatcgagaagtccgacaacatgtcgtggtacaagggtcccacgctgctggaggcgctcgacctgctggaggcccccgtgcgtccggtggacaagccgctgcgcctgcccctgcaggacgtgtacaagatcggcggtatcggcactgtgcccgtgggccgtgtggagaccggcgtgatgaagccgggcgacgttgtggtgttcgcgcctgccaacgtgacgaccgaggtgaagtcgatcgagatgcaccacgagcagctggctgaggccgtgcccggcgacaacgtgggcttcaacgtgaagaacgtgtccgtgaaggatatccgccgtggtaacgtgtgcggcaacacgaagagcgaccccccgaaggaggcggccgacttcactgcccaggtgatcgtgctgaaccaccccggccagatcagcaacggctacgcgccggtgctggactgccacacgagccacatcgcgtgcaagttcgcggacatcgagtccaagatcgaccgccgctctggcaaggagctggagaagagcccgaaggccatcaagtccggcgatgcggccatcgtgaagatgatcccgcagaagccgatgtgcgtggaggtgttcaacgactacccgccgctgggccgcttcgctgtccgcgat

SEQ ID NO: 512 - DNA, 1052 bp, Entamoeba histolytica
  strain HM1-IMMS
gctgaaagagaaagaggaattactattgatatttcattatggaaattcgaaacatctaaatactacttcactattattgatgccccaggtcayagagatttcattaagaacatgattactggaacttcacaagctgatgttgccatccttattgttgctgctggtactggwgaatttgaagctggtatttcaaagaatggacaaaccagagaacayattcttctttcatacactcttggagttaaacaaatgattgttggwgttaacaagatggatgctattcaatataaacaagaaagatatgaagaaattaagaaagaaattagtgcattccttaagaagacwggatataatccagacaagattccatttgtcccaatttcaggattccaaggagataatatgattgaaccatcaaccaacatgccatggtacaaaggaccaacattaattggagcacttgattcagtcacaccaccagaaagaccagttgataaaccacttagacttccacttcaagatgtttayaagatttcaggtattggaactgtaccatgtggaagagttgaaactggagttcttagaccaggaactattgttcaatttgcaccatcaggagtttcatctgaatgtaaatcagttgaaatgcatcacacagcacttgctcaagctattccaggtgataatgttggattcaatgttagaaayttaacagttaaagatattaagagaggaaatgtagcatcagatgctaagaatcaaccagctgttggatgtgaagatttcactgctcaagtcattgtcatgaaccatccaggacaaattagaaagggatatacaccagttcttgattgccatacatcacacattgcatgtaaattcgaagaattattaagcaagattgatagaagaacaggtaaatccatggaaggaggagaaccagaatatattaagaatggagattcagcacttgttaagattgttccaactaaaccactttgtgttgaagaatttgctaaattcccaccattgggaagatttgctgttagaga

SEQ ID NO: 513 - DNA, 1082 bp, Giardia lamblia
  strain Faubert-1
gacgagcgcgagcgcgggatcacgatcaacatcgcgctctggaagttcgagacgaagaagtacatcgtcacgatcatcgacgccccgggccaccgcgacttcatcaagaacatgatcacggggacgtcccaggccgacgtcgcgatcctcgtcgtcgcggcgggccagggcgagttcgaggccgggatctcgaaggacggccagacgcgcgagcacgcgacccttgcgaacacgctcgggatcaagacgatgatcatctgcgtcaacaagatggacgacggccaggtcaagtactcgaaggagcgctacgacgagatcaagggcgagatgatgaagcagctcaagaacatcggctggaagaaggccgaggagttcgactacatcccgacgtccggctggaccggggacaacatcatggagaagtccgacaagatgccctggtacgagggcccgtgcctgatcgacgcgatcgacgggctcaaggccccgaagcgcccgaccgacaagcccctccgcctcccgatccaggacgtctacaagatctcgggcgtcgggaccgtccccgcgggccgcgtcgagacgggcgagctcgcgcccgggatgaaggtcgtcttcgccccgacgtcccaggtctcggaggtcaagtccgtcgagatgcaccacgaggagctcaagaaggccgggcccggggacaacgtcggcttcaacgtccgcgggctcgccgtcaaggacctcaagaagggctacgtcgtcggggacgtgacgaacgacccgcccgtcggctgcaagagcttcaccgcccaggtcatcgtcatgaaccacccgaagaagatccagcccggctacacgcccgtcatcgactgccacaccgcgcacatcgcgtgccagttccagctcttcctccagaagctcgacaagcgcacgctcaagcccgagatggagaacccgcccgacgcaggccgcggcgattgcatcatcgtcaagatggtcccccagaagcccctgtgctgcgagacgttcaacgactacgcgcccctcggccgcttcgccgtccgcgacatgcgccaaaccgttgccgtcgg

SEQ ID NO: 514 - DNA, 1098 bp, Leishmania tropica
  ref <308>: DATABASE ACCESSION NUMBER: ATCC 30816
acgcgtgggtgctcgacaagctgaaggcggagcgcgagcgcggcatcacgatcgacattgcgctgtggaagttcgagtcgcccaagtccgtgttcacgatcatcgatgcgcccggccaccgcgacttcatcaagaacatgatcacgggcacgtcgcaggcggacgccgccatcctgatgatcgactcgacgcatggtggcttcgaggctggcatctcgaaggacggccagacccgcgagcacgcgctgcttgccttcactcttggcgtgaagcagatggtggtgtgctgcaacaagatggacgacaagacggtgacgtacgcgcagtcgcgctacgatgagatcagcaaggaggtgggcgcgtacctgaagcgcgtgggctacaacccggagaaggtgcgcttcatcccgatctcgggctggcagggcgacaacatgatcgagaagtcggacaacatgccgtggtacaagggtcccacgctgctggacgcgctcgacatgctggagccgccggtgcgcccggtggacaagccgctgcgcctgcccctgcaggacgtgtacaagatcggcggtatcgggacggtgcccgtggggcgcgtggagaccggcatcatgaagccgggcgacgtggtgacgttcgcgcccgccaacgtgacgactgaggtgaagtcgatcgagatgcaccacgagcagctggcggaggcgcagcccggcgacaacgtcggcttcaacgtgaagaacgtgtcggtgaaggacatccgccgtggtaacgtgtgcggcaactcgaagaacgacccgccgaaggaggcggccgacttcacggcgcaggtgatcgtgctgaaccaccccggccagatcagcaacggctacgcgccggtgctggactgccacacgagccacattgcgtgccgcttcgcggaaatcgagtccaagatcgaccgccgctccggcaaggagctggagaagaaccccaaggcgatcaagtctggcgatgccgcgatcgtgaagatggtgccgcagaagccgatgtgcgtggaggtgttcaacgactacgcgccgctgggccgctttgccgtgcgcgacatgcgccaaaccgttg

SEQ ID NO: 515 - DNA, 1104 bp, Leishmania aethiopica
  ref <308>: DATABASE ACCESSION NUMBER: ATCC 50119
tacgcgtgggtgctcgacaagctgaaggcggagcgcgagcgcggcatcacgatcgacattgcgctgtggaagttcgagtcgcccaagtccgtgttcacgatcatcgatgcgcccggccaccgcgacttcatcaagaacatgatcacgggcacgtcgcaggcggacgccgccatcctgatgatcgactcgacgcatggtggcttcgaggctggcatctcgaaggacggccagacccgcgagcacgcgctgcttgccttcactcttggcgtgaagcagatggtggtgtgctgcaacaagatggacgacaagacggtgacgtacgcgcagtcgcgctacgaggagatcagcaaggaggtgggcgcgtacctgaagcgcgtgggctacaacccggagaaggtgcgcttcatcccgatctcgggctggcagggcgacaacatgatcgagaagtcggacaacatgccgtggtacaagggtcccacgctgctggacgcgctcgacatgctggagccgccggtgcgcccggtggacaagccgctgcgcctgcccctgcaggacgtgtacaagatcggcggtatcgggacggtgcccgtgggccgcgtggagaccggcatcatgaagccgggcgacgtggtgacgttcgcgcccgccaacgtgacgactgaggtgaagtcgatcgagatgcaccacgagcagctggcggaggcgcagcccggcgacaacgtcggcttcaacgtgaagaacgtgtcggtgaaggacatccgccgtggcaacgtgtgcggcaactcgaagaacgacccgccgaaggaggcggccgacttcacggcgcaggtgatcgtgctgaaccaccccggccagatcagcaacggctacgcgccggtgctggactgccacacgagccacattgcgtgccgcttcgcggaaatcgagtccaagatcgaccgccgctccggcaaggagctggagaagaaccccaaggcgatcaagtctggcgatgccgcgatcgtgaagatggtgccgcagaagccgatgtgcgtggaggtgttcaacgactacgcgccgctgggccgctttgccgtgcgcgacatgcgccaaaccgttgccgtc

SEQ ID NO: 516 - DNA, 1106 bp, Leishmania tropica
  ref <308>: DATABASE ACCESSION NUMBER: ATCC 30815
tacgcgtgggtgctcgacaagctgaaggcggagcgcgagcgcggcatcacgatcgacattgcgctgtggaagttcgagtcgcccaagtccgtgttcacgatcatcgatgcgcccggccaccgcgacttcatcaagaacatgatcacgggcacgtcgcaggcggacgccgccatcctgatgatcgactcgacgcatggtggcttcgaggctggcatctcgaaggacggccagacccgcgagcacgcgctgcttgccttcackcttggcgtgaagcagatggtggtgtgctgcaacaagatggacgacaagacggtgacgtacgcgcagtcgcgctacgatgagatcagcaaggaggtgggcgcgtacctgaagcgcgtgggctacaacccggagaaggtgcgcttcatcccgatctcgggctggcagggcgacaacatgatcgagaagtcggacaacatgccgtggtacaagggtcccacgctgctggacgcgctcgacatgctggagccgccggtgcgcccggtggacaagccgctgcgcctgcccctgcaggacgtgtacaagatcggcggtatcgggacggtgcccgtggggcgcgtggagaccggcatcatgaagccgggcgacgtggtgacgttcgcgcccgccaacgtgacgactgaggtgaagtcgatcgagatgcaccacgagcagctggcggaggcgcagcccggcgacaacgtcggcttcaacgtgaagaacgtgtcggtgaaggacatccgccgtggtaacgtgtgcggcaactcgaagaacgacccgccgaaggaggcggccgacttcacggcgcaggtgatcgtgctgaaccaccccggccagatcagcaacggctacgcgccggtgctggactgccacacgagccacattgcgtgccgcttcgcggaaatcgagtccaagatcgaccgccgctccggcaaggagctggagaagaaccccaaggcgatcaagtctggcgatgccgcgatcgtgaagatggtgccgcagaagccgatgtgcgtggaggtgttcaacgactacgcgccgctgggccgctttgccgtgcgcgacatgcgccaaaccgttgccgtcgg

SEQ ID NO: 517 - DNA, 1099 bp, Leishmania donovani
  ref <308>: DATABASE ACCESSION NUMBER: ATCC 50212
tacgcgtgggtgctcgacaagctgaaggcggagcgcgagcgcggcatcacgatcgacattgcgctgtggaagttcgagtcgcccaagtccgtgttcacgatcatcgatgcgcccggccaccgcgacttcatcaagaacatgatcacgggcacgtcgcaggcggacgccgccatcctgatgatcgactcgacgcatggtggcttcgaggctggcatctcgaaggacggccagacccgcgagcacgcgctgcttgccttcacgcttggcgtgaagcagatggtggtgtgctgcaacaagatggacgacaagaccgtgacgtacgcgcagtcgcgctacgatgagatcagcaaggaggtgggcgcgtacctgaagcgcgtgggctacaacccggagaaggtgcgcttcatcccgatctcgggctggcagggcgacaacatgatcgagaggtcggacaacatgccgtggtacaagggtcccacgctgctggacgcgctcgacatgctggagccgccggtgcgcccggtggacaagccgctgcgcctgcccctgcaggacgtgtacaagatcggcggtatcgggactgtgcccgtgggccgcgtggagaccggcatcatgaagccgggcgacgtggtgacgttcgcgcccgccaacgtgacgactgaggtgaagtcgatcgagatgcaccacgagcagctggcggaggcgcagcccggcgacaacgtcggcttcaacgtgaagaacgtgtcggtgaaggacatccgccgtggcaacgtgtgcggcaactcgaagaacgacccgccgaaggaggcggccgacttcacggcgcaggtgatcgtgctgaaccaccccggccagatcagcaacggctacgcgccggtgctggactgccacacgagccacattgcgtgccgcttcgcggaaatcgagtccaagatcgaccgccgctccggcaaggagctggagaagaaccccaaggcgatcaagtctggcgatgccgcgatcgtgaagatggtgccgcagaagccgatgtgcgtggaggtgttcaacgactacgcgccgctgggccgctttgccgtgcgcgacatgcgccaaaccgttg

SEQ ID NO: 518 - DNA, 1098 bp, Leishmania infantum
  strain MOU
tacgcgtgggtgctcgacaagctgaaggcggagcgcgagcgcggcatcacgatcgacattgcgctgtggaagttcgagtcgcccaagtccgtgttcacgatcatcgatgcgcccggccaccgcgacttcatcaagaacatgatcacgggcacgtcgcaggcggacgccgccatcctgatgatcgactcgacgcatggtggcttcgaggctggcatctcgaaggacggccagacccgcgagcacgcgctgcttgccttcacgcttggcgtgaagcagatggtggtgtgctgcaacaagatggacgacaagaccgtgacgtacgcgcagtcgcgctacgatgagatcagcaaggaggtgggcgcgtacctgaagcgcgtgggctacaacccggagaaggtgcgcttcatcccgatctcgggctggcagggcgacaacatgatcgagaggtcggacaacatgccgtggtacaagggtcccacgctgctggacgcgctcgacatgctggagccgccggtgcgcccggtggacaagccgctgcgcctgcccctgcaggacgtgtacaagatcggcggtatcgggactgtgcccgtgggccgcgtggagaccggcatcatgaagccgggcgacgtggtgacgttcgcgcccgccaacgtgacgactgaggtgaagtcgatcgagatgcaccacgagcagctggcggaggcgcagcccggcgacaacgtcggcttcaacgtgaagaacgtgtcggtgaaggacatccgccgtggcaacgtgtgcggcaactcgaagaacgacccgccgaaggaggcggccgacttcacggcgcaggtgatcgtgctgaaccaccccggccagatcagcaacggctacgcgccggtgctggactgccacacgagccacattgcgtgccgcttcgcggaaatcgagtccaagatcgaccgccgctccggcaaggagctggagaagaaccccaaggcgatcaagtctggcgatgccgcgatcgtgaagatggtgccgcagaagccgatgtgcgtggaggtgttcaacgactacgcgccgctgggccgctttgccgtgcgcgacatgcgccaaaccgtt

SEQ ID NO: 519 - DNA, 1071 bp, Leishmania enriettii
  ref <308>: DATABASE ACCESSION NUMBER: ATCC 50120
ctcgacaagctgaaggcggagcgcgagcgcggcatcacgatcgacattgcgctgtggaagttcgagtcgcccaagtctgtgttcacgatcatcgatgcgcccggccaccgcgacttcatcaagaacatgatcaccggcacgtcgcaggccgacgccgccatcctgatgatcgactcgacccagggcggcttcgaggctggcatctcgaaggacggccagacccgcgagcacgcgctgctcgccttcacgcttggtgtgaagcagatggtggtgtgctgcaacaagatggacgacaagacggtgcagtactcgcaggcgcgctacgaggagatcagcaaggaggtgggcgcgtacctgaagcgcgtcggctacaacccggagaaggtgcgcttcatcccgatctcgggctggcagggcgacaacatgatcgacaagtcggacagcatgccgtggtacaaggggcccacgctgctggacgcgctcgacatgctggaggcgccggtgcgcccggtggacaagccgctgcgcctgcccctgcaggacgtgtacaagatcggcggtatcgggacggtgcccgtgggccgcgtggagaccggcatcatgaagcctggcgacgtggtgacgtttgcgcccgccaacgtgacgacggaggtgaagtcgatcgagatgcaccacgagcagctggcggaggcggtgcccggcgacaacgtcggcttcaacgtgaagaacgtgtcggtgaaggacatccgccgtggtaacgtgtgcggcaactcgaagaacgacccgccgaaggaggcggccgacttcacggcgcaggtgatcgtgctgaaccaccctggccagatcagcaacggctacgcgccggtgctggactgccacacgagccacatcgcgtgccgcttcgcggatatcgagtccaagatcgaccgccgctctggcaaggagctggagaagaaccccaaggcgatcaagtccggcgatgcggccatcgtgaagatggtgccgcagaagccgatgtgcgtggaggtgttcaacgactacccgccgctggggcgcttcgctgtgcgcgac

SEQ ID NO: 520 - DNA, 1071 bp, Leishmania gerbilli
  ref <308>: DATABASE ACCESSION NUMBER: ATCC 50121
ctcgacaagctgaaggcggagcgcgagcgcggcatcacgatcgacattgcgctgtggaagttcgagtcgcccaagtccgtgttcacgatcatcgatgcgcccggccaccgcgacttcatcaagaacatgatcacgggcacgtcgcaggcggacgccgccatcctgatgatcgactcgacgcatggtggcttcgaggctggcatctcgaaggacggccagacccgcgagcacgcgctgcttgccttcactcttggcgtgaagcagatggtggtgtgctgcaacaagatggacgacaagacggtgacgtacgcgcagtcgcgctacgatgagatcagcaaggaggtgggcgcgtacctgaagcgcgtgggctacaacccggagaaggtgcgcttcatcccgatctcgggctggcagggcgacaacatgatcgagaagtcggacaacatgccgtggtacaagggtcccacgctgctggacgcgctcgacatgctggagccgccggtgcgcccggtggacaagccgctgcgcctgcccctgcaggacgtgtacaagatcggcggtatcgggacggtgcccgtgggccgcgtggagaccggcatcatgaagccgggcgacgtggtgacgttcgcgcccgccaacgtgacgactgaggtgaagtcgatcgagatgcaccacgagcagctggcggaggcgcagcccggcgacaacgtcggcttcaacgtgaagaacgtgtcggtgaaggacatccgccgtggtaacgtgtgcggcaactcgaagaacgacccgccgaaggaggcggccgacttcacggcgcaggtgatcgtgctgaaccaccccggccagatcagcaacggctatgcgccggtgctggactgccacacgagccacattgcgtgccgcttcgcggaaatcgagtccaagatcgaccgccgctccggcaaggagctggagaagaaccccaaggcgatcaagtctggcgatgccgcgatcgtgaagatggtgccgcagaagccgatgtgcgtggaggtgttcaacgactacgcgccgctgggccgctttgccgtgcgcgac

SEQ ID NO: 521 - DNA, 1114 bp, Leishmania hertigi
  ref <308>: DATABASE ACCESSION NUMBER: ATCC 50125
tcgttcaagtacgcgtgggtgctcgacaagctgaaggcggagcgcgagcgcggtatcacgatcgacattgcgctgtggaagttcgagtcgcccaagtcggtgttcacgatcatcgatgcgcccggccaccgcgacttcatcaagaacatgatcaccggcacgtcgcaggcggatgctgccattctgatgatcgattcgacgcagggtggcttcgaggctggcatctcgaaggacggccagacgcgcgagcacgcgctgctggccttcacgctgggcgtgaagcagatggttgtgtgctgcaacaagatggacgacaagacggtgcagtacgcgcaggcgcgctacgaggagatcagcaaggaggtgggcgcgtacctgaagcgcgtgggctacaacccggagaaggtgcgcttcatcccgatctcgggctggcagggcgacaacatgatcgagaagtccgacaacatgtcgtggtacaagggtcccacgctgctggaggcgctggacatgctggaggcgccggtgcgcccggtggacaagccgctgcgcctgcccctgcaggacgtgtacaagatcggcggcattggcacggtgccggtgggccgtgtggagaccggcatcatgaagcccggcgacgtggtgacgttcgcgcccgccaacgtgacgacggaggtgaagtcgatcgagatgcaccacgagcagctgcaggaggctgtgcccggcgacaacgtcggcttcaacgtgaagaacgtgtcggtgaaggacatccgccgtggtaacgtgtgtggcaactcgaagaacgacccgccgaaggaggcggctgacttcacggcgcaggtgatcgtgctgaaccaccccggccagatcagcaacggctacgcgccggtgctggactgccacaccagccacatcgcgtgccgcttcgcggacatcgagtcgaagatcgaccgccgctccggcaaggagctggagaagaaccccaagtccatcaagtccggcgacgccgccatcgtgaagatggtgccgcagaagccgatgtgcgtggaggtgttcaacgactacccgccgctgggccgctttgcggtgcgcgacatgcgccaaaccgttgccgtcg

SEQ ID NO: 522 - DNA, 1106 bp, Leishmania major
  ref <308>: DATABASE ACCESSION NUMBER: ATCC 50122
tacgcgtgggtgctcgacaagctgaaggcggagcgcgagcgcggcatcacgatcgacattgcgctgtggaagttcgagtcgcccaagtccgtgttcacgatcatcgatgcgcccggccaccgcgacttcatcaagaacatgatcacgggcacgtcgcaggcggacgccgccattctgatgatcgactcgacgcatggcggcttcgaggctggcatctcgaaggacggccagacccgcgagcacgcgctgcttgccttcactcttggcgtgaagcagatggtggtgtgctgcaacaagatggacgacaagacggtgacgtacgcgcagtcrcgctacgatgagatcagcaaggaggtgggcgcgtacctgaagcgcgtgggctacaacccggagaaggtgcgcttcatcccgatctcgggctggcagggcgacaacatgatcgagaagtcggacaacatgccgtggtacaagggtcccacgctgctggacgcgctcgacatgctggagccgccggtgcgcccggtggacaagccgctgcgcctgcccctgcaggacgtgtacaagatcggcggtatcgggacggtgcccgtgggccgcgtggagaccggcatcatgaagccgggcgacgtggtgacgttcgcgcccgccaacgtgacgactgaggtgaagtcgatcgagatgcaccacgagcagctggcggaggcgcagcccggcgacaacgtcggcttcaacgtgaagaacgtgtcggtgaaggacatccgccgtggtaacgtgtgcggcaactcgaagaacgacccgccgaaggaggcggccgacttcacggcgcaggtgatcgtgctgaaccaccccggccagatcagcaacggctatgcgccggtgctggactgccacacgagccacattgcgtgccgcttcgcggaaatcgagtccaagatcgaccgccgctccggcaaggagctggagaagaaccccaaggcgatcaagtctggcgatgccgcgatcgtgaagatggtgccgcagaagccgatgtgcgtggaggtgttcaacgactacgcgccgctgggccgctttgccgtgcgcgacatgcgccaaaccgttgccgtcgg

SEQ ID NO: 523 - DNA, 1105 bp, Leishmania amazonensis
  ref <308>: DATABASE ACCESSION NUMBER: ATCC 50131
tacgcgtgggtgctcgacaagctgaaggcggagcgcgagcgcggcatcacgatcgacattgcgctgtggaagttcgagtcgccgaagtccgtgttcacgatcatcgatgcgcccggccaccgcgacttcatcaagaacatgatcacgggcacgtcgcaggcggacgcggccatcctgatgatcgactcgacgcatggtggcttcgaggctggcatctcgaaggacggccagacccgcgagcacgcgctgcttgccttcactcttggcgtgaagcagatggtggtgtgctgcaacaagatggacgacaagacggtgatgtacgcgcagtcgcgctacgatgagatcagcaaggaggtgagcgcgtacctgaagcgcgtgggctacaacccggagaaggtgcgcttcatcccgatctcggggtggcagggcgacaacatgatcgacaagtcggacaacatgccgtggtacaagggtcccacgctgctggacgcgctcgacatgctggagccgccggtgcgcccggtggacaagccgctgcgcctgcccctgcaggacgtgtacaagatcggcggtatcgggacggtgcccgtgggccgcgtggagaccgggatcatgaagccgggcgacgtggtgacgttcgcgcccgccaacgtgacgactgaggtgaagtcgatcgagatgcaccacgagcagctggcggaggcgcagcccggcgacaacgtcggcttcaacgtgaagaacgtgtcggtgaaggacatccgccgtggtaacgtgtgcggcaactcgaagaacgacccgccgaaggaggcggccgacttcacggcgcaggtgatcgtgctgaaccaccccggccagatcagcaacggctacgcgccggtgctggactgccacacgagccacatcgcgtgccgcttcgcggagatcgagtccaagatcgaccgccgctccggcaaggagctggagaagaaccccaaggcgatcaagtctggcgacgccgcgatcgtgaagatggtgccgcagaagccgatgtgcgtggaggtgttcaacgactacgcgccgctgggccgctttgccgtgcgcgacatgcgccaaaccgttgccgtcg

SEQ ID NO: 524 - DNA, 1098 bp, Leishmania mexicana
  ref <308>: DATABASE ACCESSION NUMBER: ATCC 50156
tacgcgtgggtgctcgacaagctgaaggcggagcgcgagcgcggcatcacgatcgacattgcgctgtggaagttcgagtcgccgaagtccgtgttcacgatcatcgatgcgcccggccaccgcgacttcatcaagaacatgatcacgggcacgtcgcaggcggacgcggccatcctgatgatcgactcgacgcatggtggcttcgaggctggcatctcgaaggacggccagacccgcgagcacgcgctgcttgccttcactcttggcgtgaagcagatggtggtgtgctgcaacaagatggacgacaagacggtgatgtacgcgcagtcgcgctacgatgagatcagcaaggaggtgagcgcgtacctgaagcgcgtgggctacaacccggagaaggtgcgcttcatcccgatctcggggtggcagggcgacaacatgatcgacaagtcggacaacatgccgtggtacaagggtcccacgctgctggacgcgctcgacatgctggagccgccggtgcgcccggtggacaagccgctgcgcctgcccctgcaggacgtgtacaagatcggcggtatcgggacggtgcccgtgggccgcgtggagaccgggatcatgaagccgggcgacgtggtgacgttcgcgcccgccaacgtgacgactgaggtgaagtcgatcgagatgcaccacgagcagctggcggaggcgcagcccggcgacaacgtcggcttcaacgtgaagaacgtgtcggtgaaggacatccgccgtggtaacgtgtgcggcaactcgaagaacgacccgccgaaggaggcggccgacttcacggcgcaggtgatcgtgctgaaccaccccggccagatcagcaacggctacgcgccggtgctggactgccacacgagccacatcgcgtgccgcttcgcggagatcgagtccaagatcgaccgccgctccggcaaggagctggagaagaaccccaaggcgatcaagtctggcgacgccgcgatcgtgaagatggtgccgcagaagccgatgtgcgtggaggtgttcaacgactacgcgccgctgggccgctttgccgtgcgcgacatgcgccaaaccgtt

SEQ ID NO: 525 - DNA, 1081 bp, Leishmania tarentolae
  strain II WT
gctgaaggcggagcgcgagcgcggcatcacgatcgacattgcgctgtggaagttcgagtcgcccaagtcggtgttcacgatcatcgatgcgcccggccaccgcgacttcatcaagaacatgatcacgggcacgtcgcaggcggacgcggccatcctgatgatcgactcgacgcacggtgggttcgaggctggcatctcgaaggacgggcagacgcgcgagcacgcgctgcttgccttcactcttggcgtgaagcagatggttgtgtgctgcaacaagatggacgacaagacggtgatgtacgcgcagtcgcgctacgatgagatcagcaaggaggtgggcgcgtacctgaagcgcgtgggctacaacccggagaaggtgcgcttcatcccgatctcgggctggcagggcgacaacatgatcgagaagtcggacaacatgccgtggtacaagggtcccacgctgctggacgcgctcgacatgctggaggcgccggtgcgcccggtggacaagccgctgcgcctgcccctgcaggacgtgtacaagatcggcggcatcggcacggtgcccgtgggccgcgtggagaccggcatcatgaagccgggcgacgtggtgacgttcgcgcccgcgaacgtgacgacggaggtgaagtcgatcgagatgcaccacgagcagctggcggaggcgcagcccggcgacaacgtcggcttcaacgtgaagaacgtgtcggtgaaggacatccgccgtgggaacgtgtgcggtaactcgaagaacgacccgccgaaggaggccgccgacttcacggcgcaggtgatcgtgctgaaccaccccggccagatcagcaacggctacgcgccggtgctggactgccacacgagccacatcgcgtgccggttcgcggacatcgagtccaagattgaccgccgctccggcaaggagctggagaagaaccccaaggcgatcaagtccggcgatgccgcgatcgtgaagatggtgccgcagaagccgatgtgcgtggagatgttcaacgactacgcgccgcttggccgctttgctgtgcgcgacatgcgccaaaccgttgcc

SEQ ID NO: 526 - DNA, 1102 bp, Leishmania tropica
  ref <308>: DATABASE ACCESSION NUMBER: ATCC 50129
aaatacgcgtgggtgctcgacaagctgaaggcggagcgcgagcgcggcatcacgatcgacattgcgctgtggaagttcgagtcgcccaagtccgtgttcacgatcatcgatgcgcccggccaccgcgacttcatcaagaacatgatcacgggcacgtcgcaggcggacgccgccatcctgatgatcgactcgacgcatggtggcttcgaggctggcatctcgaaggacggccagacccgcgagcacgcgctgcttgccttcackcttggcgtgaagcagatggtggtgtgctgcaacaagatggacgacaagacggtgacgtacgcgcagtcgcgctacgatgagatcagcaaggaggtgggcgcgtacctgaagcgcgtgggctacaacccggagaaggtgcgcttcatcccgatctcgggctggcagggcgacaacatgatcgagaagtcggacaacatgccgtggtacaagggtcccacgctgctggacgcgctcgacatgctggagccgccggtgcgcccggtggacaagccgctgcgcctgcccctgcaggacgtgtacaagatcggcggtatcgggacggtgcccgtggggcgcgtggagaccggcatcatgaagccgggcgacgtggtgacgttcgcgcccgccaacgtgacgactgaggtgaagtcgatcgagatgcaccacgagcagctggcggaggcgcagcccggcgacaacgtcggcttcaacgtgaagaacgtgtcggtgaaggacatccgccgtggtaacgtgtgcggcaactcgaagaacgacccgccgaaggaggcggccgacttcacggcgcaggtgatcgtgctgaaccaccccggccagatcagcaacggctacgcgccggtgctggactgccacacgagccacattgcgtgccgcttcgcggaaatcgagtccaagatcgaccgccgctccggcaaggagctggagaagaaccccaaggcgatcaagtctggcgatgccgcgatcgtgaagatggtgccgcagaagccgatgtgcgtggaggtgttcaacgactacgcgccgctgggccgctttgccgtgcgcgacatgcgccaaaccgttg

SEQ ID NO: 527 - DNA, 1105 bp, Neospora caninum
  strain Suarez-4
  misc_feature (1)...(1105): n=a,t,c or g
ggacraacttaaagctgaacgtgagcgtggtatcaccattgatatctccctgtggaaatttgagaccagcaagtactatgttaccatcattgatgccccaggacacagagacttcatcaaaaacatgattacaggcacatcccaggctgactgtgctgtcctgattgttgctgctggtgttggtgaatttgaagccggtatctccaagaacgggcagacccgtgagcatgcccttntggcttacaccctgggtgtgaaacaactaattgttggcgttaacaaaakggattccactgagccaccctatagccaraagagatacgargaaattgttaaggaagtcagcmcctaynttaaaaaaattggytacaaccccgacacagtancatttgkgccaatttntggctggaatggtgacaacatgctgganccaagtgctaatatgccatggttcaagggatggaaagtcmcccgtaaggacggcaatgccagkggaaccmccctgcttgaagctytggattgcattytgccaccaayttgcccaactgacaaacccttgcgtttgcctytccaggatgtctataaaattggkggtattggtactgtccctgtgggtcgtgtggagactggtgttctcaaacctggcatggtggtcacctttgctccagtcaatgtaacaactgaagtgaagtctgtagaaatgcaccatgaagcattgagtgaagcccttcctggggacaatgtgggcttcaatgtcaagaacgtgtctgtcaaagatgtccgtcgtggcaatgtggctggtgacagcaaaaatgatccacccatggaagctgctggcttcacagctcaggtgattattttgaaccatccaggccaaatcagtgctggatatgcacctgtgctggattgtcacacagctcacattgcttgcaagtttgctgagctgaaggagaagattgatcgtcgttctgggaaaaagctggaagatggccctaaattcttgaaatctggtgacgctgccatcgttgatatggttcctggcaagcccatgtgtgtcgagagcttctctgattatcctcccctgggccgttttgctgtgcgtgac

SEQ ID NO: 528 - DNA, 935 bp, Trichomonas vaginalis
  ref <308>: DATABASE ACCESSION NUMBER: ATCC 30001
gcacatcccaggctgatgctgctatccttgtcatcgactccacactcggtggyttcgaagccggtatcgctgaacaaggccagacacgtgaacacgctcttcttgccttcacactcggcatcaagcaggtcattgtcgccgtcaacaagatggatgacaagacagtcaactacaacaaggcycgtttcgacgaaatcacagccgaaatgacacgcatccttacaggcatcggctacaagccagaaatgttccgcttcgtcccaatctccggctgggctggcgacaacatgacagagaagtctccaaacatgccatggtacaatggcccataccttcttgaagccctcgattcccttcagccaccaaagcgcccattcgacaagccactccgtcttccactccaggatgtctacaagatcaacggtatcggtacagttccagtcggccgtgtcgaatccggcacaatgaagccaggcatgatcgttaacttcgccccatccacagttacagctgaagttaagtccatcgaaatgcaccacgaatcccttccagaggctcttccaggtgacaacatcggcttcaacgtcaagaacgtttccacagctgatgtcaagcgtggctacgtcgttggtgatacaaagcgtgacccaccagtcgaatgcgcttccttcacagctcaratgatcatctccaaccacccaggcaagatccacgccggctaccagccagttttcgactgccacacagctcacatcgcctgcaagttcgacaagctcatccagcgtatcgatcgtcgccacggcaagaaggctacagagaacccagaatacattcagaaggatgatgccgctatcgtcgaggttgtcccatccaagccactcgtcgtcgagtccttccaggagtacccaccactcggccgtttcgccatccgtgat

SEQ ID NO: 529 - DNA, 1065 bp, Trypanosoma brucei subsp. brucei
  strain EATRO795
aagctgaaggctgagcgcgaacgtggtatcacgatcgacattgcactgtggaaattcgagtcacccaagtctgtcttcactattattgatgctcctgggcaccgtgacttcatcaagaacatgatcaccggcacatcgcaagccgacgcagccatcctcatcattgcctctgcgcagggtgagttcgaggctggtatctccaaggatggacagacccgcgagcacgcgttgctggccttcactttgggtgtgaagcagatggttgtgtgctgcaacaagatggacgacaagactgtgaactacggacaggagcggtatgacgagattgtgaaggaggtgtctgcttacatcaagaaggttgggtacaacgtggagaaggtgcgcttcgtccccatctccggatggcagggcgacaacatgattgagaaatccgagaagatgccatggtacaagggtccaacgctcctggaggcactagacatgctggagccaccagtgcgtccgagcgacaagcccctgcgtctgccactgcaggacgtgtacaagatcggtggtattggcaccgtgcccgttggtcgtgtggagaccggcgtgatgaagcctggtgatgtggtgacgtttgcccccgccaacgtgacgaccgaggtgaaatcgatcgagatgcaccacgagcagctcgctgaggcgacccccggtgacaacgtcggctttaacgtgaagaacgtttctgtaaaggacatccgccgtggcaacgtctgcggtaacaccaagaacgaccccccaaaggaggccgccgacttcacggcacaggtgatcatcctgaaccaccccggacagattggaaacggttatgcgcccgtgctggactgccacacatcgcacattgcctgcaagttcgcggagatcgagtcgaagatcgaccgtcgctctggcaaggagctggagaaggctcccaagtcgatcaagtctggcgacgccgcgatcgtgcgcatggtgccgcagaagcctatgtgcgtggaggtcttcaacgactacgcgccactcggccgctttgccgtgcgtgac

SEQ ID NO: 530 - DNA, 1297 bp, Crithidia fasciculata
  ref <308>: DATABASE ACCESSION NUMBER: ATCC 11745
ttcgcggagggcgtgccgccggtgctgacggcgctggacgtgacggaggacctcggccgcgacgagccgctgacgctggagattgtgcagcacttggacgcgaacaccggccgctgcattgccatgcagacgacggatctgctgaagctgaagtcgaaggttgtgtcgacgggcggcaacatctccgtgccggttggccgcgagacgctgggccgcatcttcaacgtgctcggcgacgcgatcgaccagcgcggtgtggtgggcgagaagatgcgcatgccgatccacgccgaggcgccgaagctggcggaccaggccgcggaggacgcgattctgacgaccggcatcaaggtgatcgacctgattctgccgtactgcaagggtggcaagatcgggctgttcggcggtgctggtgtgggcaagactgtgatcatcatggagctgatcaacaacgtggccaagggccacggtggtttctccgtgttcgccggcgttggcgagcgcacccgcgagggcacggatctgtacctggagatgatgcagtcgaaggtcattgacctgaagggcgagtcgaagtgcgtgctggtgtacggccagatgaacgagcccccgggtgcgcgtgcgcgtgttgcgcagtctgcgctgacgatggcggagtacttccgtgacgtggagggccagaacgtgctgctgttcatcgacaacatcttccgcttcacccaggccaactccgaggtgtccgccctgctgggccgcattcccgccgccgtgggctaccagccgacgcttgccgaggatcttggtatgctgcaggagcgcattacgtcgacgacgaagggctcgattacgtctgtgcaggccgtgtacgtgccggccgatgatatcacggatccggcgccggcgacgaccttctcgcacctggatgcgacgacggtgctggaccgcgcggttgccgagtctggcatctaccccgccgtgaacccgctggagtgcgcgtcgcgtatcatggaccccgatgtgatcgacgtggaccactacaacgttgcgcaggatatcgtgcagatgctgaccaagtacaaggagctgcaggatatcattgccgtgctgggtatcgacgagctgagcgaggaggacaagcttgtggtggaccgcgctcgcaaggtgacgcgcttcctgtcgcagccgttccaggtggccgaggtgttcaccggcatgacgggccactacgtgcagctggaggacacagtggagtcgttctctggcctgctgatgggctcgtacgaccagatcccggaga

SEQ ID NO: 531 - DNA, 1298 bp, Leishmania tropica
  ref <308>: DATABASE ACCESSION NUMBER: ATCC 30816
cttctcggagggcgtgccgcccgtgctgacggcgctggatgtgacggaggaccttggccgcgatgagccgctgacgctggagatcgtgcagcacttggacgcgaacacgggccgctgcattgcgatgcagacgacggacctgctgaagctgaagtcgaaggtcgtgtcgaccggcggcaacatctctgtgccggtgggccgtgagacgctgggccgcatcttcaaygttctgggcgacgcgatcgaccagcgcggccccgtgggcgagaagatgcgcatggcgatccacgccgaggccccgaagctggcggatcaggccgcggaggacacgatcctgacgaccggcatcaaggtgatcgacctgattctgccctactgcaagggtggcaagatcggcctgttcggcggtgccggtgtgggcaagactgtgatcatcatggagctgatcaacaacgtcgcgaagggccacggcggtttctccgtgtttgccggcgttggcgagcgcacgcgcgagggcacggacctgtacctggagatgatgcagtcgaaggtgattgacctgaagggcgagtcgaagtgygtgcttgtgtatgggcagatgaacgagcccccgggtgcgcgcgcgcgcgttgcgcagtctgcgctgacgatggcggagtacttccgcgacgtggagggccagaacgtgctgctgttcatcgacaacatcttccgcttcacgcaggcgaactccgaggtgtctgcgctgctgggccgcattccggccgccgtgggctaccagccgacgcttgcggaggatcttggtatgctgcaggagcgcatcacgtcgacaacgaaggggtcgatcacgtccgtgcaggccgtgtacgtgccagcggatgatatcacggatcccgcgcccgcgacgacgttctcgcacctggacgcgacgactgtgctggaccgcgcggtggcggagtcgggcatctaccctgccgtgaacccgctggagtgcgcgtcgcgtatcatggaccctgatgtgatcgatgtggaccactacaacgttgcgcaggatatcgtgcagatgctgaccaagtacaaggagctgcaggatatcattgcggtgcttggcatcgacgagctgagcgaggaagacaaggttgttgtggaccgcgcgcgcaaggtgacccggttcctgtcgcagccgttccaggttgcggaggtgttcacgggcatgacgggccactacgtgcagctggtcgacacggtggagtcgttctctggcctgctgatggggtcgtacgaccagatcccggaga

SEQ ID NO: 532 - DNA, 1297 bp, Leishmania aethiopica
  ref <308>: DATABASE ACCESSION NUMBER: ATCC 50119
ttctcggagggcgtgccgcccgtgctgacggcgctggatgtgacggaggaccttggccgcgatgagccgctgacgctggagatcgtgcagcacttggacgcgaacaccggccgctgcattgcgatgcagacgacggacctgctgaagctgaagtcgaaggttgtgtcgaccggcggcaacatctctgtgccggtgggccgtgagacgctgggccgcatcttcaacgttctgggcgacgcgatcgaccagcgcggccccgtgggcgagaagatgcgcatggcgatccacgccgaggccccaaagctggcggatcaggccgcggaggacacgatcctgacgaccggcatcaaggtgatcgacctgattctgccctactgcaagggtggcaagatcggcctgttcggcggtgccggtgtgggcaagactgtgatcatcatggagctgatcaacaacgtcgcgaagggccacggtggtttctccgtgtttgccggcgttggcgagcgcacgcgcgagggcacggacctgtacctggagatgatgcagtcgaaggtgattgacctgaagggcgagtcgaagtgcgtgcttgtgtacgggcagatgaacgagcccccgggtgcgcgcgcgcgcgttgcgcagtctgcgctgacgatggcggagtacttccgcgacgtggagggccagaacgtgctgctgttcatcgacaacatcttccgcttcacgcaggcgaactccgaggtgtctgcgctgctgggccgcattccagccgccgtgggctaccagccgacgcttgcggaggatcttggtatgctgcaggagcgcatcacgtcgacaacgaaggggtcgatcacgtccgtgcaggccgtgtacgtgccagcggatgatatcacggatcccgcgcccgcgacgacgttctcgcacctggacgcgacgactgtgctggaccgcgcggtggcggagtcgggcatctaccctgccgtgaacccgctggagtgcgcgtcgcgtatcatggaccccgacgtgatcgatgtggaccactacaacgttgcgcaggatatcgtgcagatgctgaccaagtacaaggagctgcaggatatcattgcggtgcttggcatcgacgagctgagcgaggaagacaaggttgttgtggaccgcgcgcgcaaggtgacccggttcctgtcgcagccgttccaggttgcggaggtgttcacgggcatgacgggccactacgtgcagctggtcgacacggtggagtcgttctctggcctgctgatggggtcgtacgaccagatcccggaga

SEQ ID NO: 533 - DNA, 1298 bp, Leishmania donovani
  ref <308>: DATABASE ACCESSION NUMBER: ATCC 50212
cttctcggagggcgtgccgcccgtactgacggcgctggatgtgacggaggaccttggccgcgatgagccgctgacgctggagatcgtgcagcacttggatgcgaacaccggccgctgcattgcgatgcagacgacggacctgctgaagctgaagtcgaaggttgtgtcgaccggcggcaacatctctgtgccggtgggccgtgagacgctgggccgcatcttcaacgttctgggcgacgcgatcgaccagcgcggccccgtgggcgagaagatgcgcatggcgatccacgccgaggccccgaagctggcggaccaggccgcggaggacacgatcctgacgaccggcatcaaggtgatcgacctcattctgccctactgcaagggcggcaagatcggcctgttcggcggtgccggtgtgggcaagactgtgatcatcatggagctgatcaacaacgtcgcgaagggccacggtggcttctccgtgtttgccggcgttggcgagcgcacgcgcgagggcacggacctatacctggagatgatgcagtcgaaggtgattgacctgaagggcgagtcgaagtgcgtgcttgtgtacgggcagatgaacgagcccccgggtgcgcgcgcgcgcgttgcgcagtctgcgctgacgatggcggagtacttccgcgacgtggagggccagaacgtgctgctgttcatcgacaacatcttccgcttcacgcaggcgaactccgaggtgtctgcgctgctgggccgcattccggccgccgtgggctaccagccgacgcttgccgaggatcttggtatgctgcaggagcgcatcacatcgacgacgaaggggtcgatcacgtccgtgcaggccgtgtacgtgccggcggatgatatcacggatcccgcgcccgcgacgacgttctcgcacctggacgcgacgactgtgctggaccgcgcggtggcggagtcgggcatctaccctgccgtgaacccgctggagtgcgcgtcgcgtatcatggaccccgatgtgatcgatgtggaccactacaacgttgcgcaggatatcgtgcagatgctgaccaagtacaaggagctgcaggatatcattgcggtgcttggcatcgacgagctgagcgaggaggacaaggttgtggtggaccgcgcgcgcaaggtgacccggttcctgtcgcagccgttccaggttgcggaggtgttcacgggcatgacgggccactacgtgcagctggccgacacggtggagtcgttctctggcctgctgatggggtcgtacgaccagatcccggaga

SEQ ID NO: 534 - DNA, 1298 bp, Leishmania infantum
  strain MOU
cttctcggagggcgtgccgcccgtactgacggcgctggatgtgacggaggaccttggccgcgatgagccgctgacgctggagatcgtgcagcacttggatgcgaacaccggccgctgcattgcgatgcagacgacggacctgctgaagctgaagtcgaaggttgtgtcgaccggcggcaacatctctgtgccggtgggccgtgagacgctgggccgcatcttcaacgttctgggcgacgcgatcgaccagcgcggccccgtgggcgagaagatgcgcatggcgatccacgccgaggccccaaagctggcggaccaggccgcggaggacacgatcctgacgaccggcatcaaggtgatcgacctcattctgccctactgcaagggcggcaagatcggcctgttcggcggtgccggtgtgggcaagactgtgatcatcatggagctgatcaacaacgtcgcgaagggccacggtggcttctccgtgtttgccggcgttggcgagcgcacgcgcgagggcacggacctatacctggagatgatgcagtcgaaggtgattgacctgaagggcgagtcgaagtgcgtgcttgtgtacgggcagatgaacgagcccccgggtgcgcgcgcgcgcgttgcgcagtctgcgctgacgatggcggagtacttccgcgacgtggagggccagaacgtgctgctgttcatcgacaacatcttccgcttcacgcaggcgaactccgaggtgtctgcgctgctgggccgcattccggccgccgtgggctaccagccgacgcttgccgaggatcttggtatgctgcaggagcgcatcacatcgacgacgaaggggtcgatcacgtccgtgcaggccgtgtacgtgccggcggatgatatcactgatcccgcgcccgcgacgacgttctcgcacctggacgcgacgactgtgctggaccgcgcggtggcggagtcgggcatctaccctgccgtgaacccgctggagtgcgcgtcgcgtatcatggaccccgatgtgatcgatgtggaccactacaacgttgcgcaggatatcgtgcagatgctgaccaagtacaaggagctgcaggatatcattgcggtgcttggcatcgacgagctgagcgaggaggacaaggttgtggtggaccgcgcgcgcaaggtgacccggttcctgtcgcagccgttccaggttgcggaggtgttcacgggcatgacgggccactacgtgcagctggccgacacggtggagtcgttctctggcctgctgatggggtcgtacgaccagatcccggaga

SEQ ID NO: 535 - DNA, 1301 bp, Leishmania gerbilli
  ref <308>: DATABASE ACCESSION NUMBER: ATCC 50121
gcacttctcggagggcgtgccgcccgtgctgacggcgctggatgtgacggaggaccttggccgcgatgagccgctgacgctggagatcgtgcagcacttggacgcgaacaccggccgctgcattgcgatgcagacgacggacctgctgaagctgaagtcgaaggttgtgtcgaccggtggcaacatctctgtgccggtgggccgtgagacgctgggccgcatcttcaacgttctgggcgatgcgatcgaccagcgcggccccgtgggcgagaagatgcgcatggcgatccacgccgaggccccgaagctggcggatcaggccgcggaggacacgatcctgacgaccggcatcaaggtgatcgacctgattctgccctactgcaagggtggcaagatcggyctgttcggcggtgccggtgtgggcaagactgtgatcatcatggagctgatcaacaacgtcgcgaagggccacggtggtttctccgtgtttgccggcgttggcgagcgcacgcgcgagggcacggacctgtacctggagatgatgcagtcgaaggtgattgacctgaagggcgagtcgaagtgcgtgcttgtgtacgggcagatgaacgagcccccgggtgcgcgcgcgcgcgttgcgcagtctgcgctgacgatggcggagtacttccgcgacgtggagggccagaacgtgctgctgttcatcgacaacatcttccgcttcacgcaggcgaactccgaggtgtccgcgctgctgggccgcattccggccgccgtgggctaccagccgacgcttgcggaggatcttggtatgctgcaggagcgcatcacgtcgacaacgaaggggtcgatcacgtccgtgcaggccgtgtacgtgccagcggatgatatcacggatcccgcgcccgcgacgacgttctcgcaccttgacgcgacgactgtgctggaccgcgcggtggcggagtcgggcatctaccctgccgtgaacccgctggagtgcgcgtcgcgtatcatggaccccgatgtgatcgatgtggaccactacaacgttgcgcaggatatcgtgcagatgctgaccaagtacaaggagctgcaggacatcattgcggtgcttggcatcgacgagctgagcgaggaagacaaggttgtggtggaccgcgcgcgcaaggtgacccggttcctgtcgcagccgttccaggttgcggaggtgttcacgggcatgacgggccactacgtgcagctggtcgacacggtggagtcgttctctggcttgctgatggggtcgtacgaccagatcccggaga

SEQ ID NO: 536 - DNA, 1298 bp, Leishmania hertigi
  ref <308>: DATABASE ACCESSION NUMBER: ATCC 50125
cttcgcggagggcgtgccgccggtgctgacgtcgctggatgtgacggagaacctcggccgcgatgagccgctgacgctggagattgtgcagcacttggacgcgaacaccggtcgctgcattgcgatgcagacgacggacctgctgaagctgaagtcgaaggtcgtgtcgaccggtggcaacatctctgtgcctgttggccgcgagacgctgggtcgcatcttcaacgtgcttggcgatgcgattgaccagcgcggccctgtgggtgagaagatgcgcatggcgatccacgccgaggcgccgaagctggcggatcaggcggcagaggacacgatcctgacgaccggcatcaaggtgatcgatcttattctgccgtactgcaagggtggtaagatcggtctgttcggtggtgccggtgtaggcaagactgtgattattatggagctgatcaataacgtggcgaagggccacggtgggttttccgtgtttgctggcgtgggcgagcgcacgcgcgagggcactgacctgtacctggagatgatgcagtcgaaggtgattgacctgaagggcgaatcaaagtgcgtgcttgtgtacggacagatgaacgagcccccgggtgcgcgtgcgcgcgttgcgcagtctgcgctgacgatggccgagtacttccgcgatgtggagggccagaacgtgctgctgttcattgacaacatcttccgcttcacgcaggcgaactccgaggtgtctgcgctgctgggtcgcattcctgccgccgtgggctaccagccgacgcttgcggaggatctgggcatgctgcaggagcgcattacgtcgacgacgaagggctcgattacgtctgtgcaggccgtgtacgtgcctgcggatgatatcacggacccggcgcccgcgacgacgttctcgcacctggacgcgacgactgtgctggaccgtgcggtggcagagtcgggcatttaccctgcggtgaacccgctggagtgcgcgtcgcgtatcatggaccccgatgtgatcgatgtggaccactacaacgttgcgcaggatatcgtgcagatgctgaccaagtacaaggagctgcaggatatcattgccgtgcttggtatcgacgagctgagcgaggaggacaaggttgtggtggaccgcgcgcgcaaggtgacccggttcctgtcgcagccgttccaggttgcggaggtgttcactggcatgacgggtcactacgttcagctggaggacacggtggagtcgttctctggcctactgatggggtcatacgaccagatcccggaga

SEQ ID NO: 537 - DNA, 1297 bp, Leishmania major
  ref <308>: DATABASE ACCESSION NUMBER: ATCC 50122
cttctcggagggcgtgccgcccgtgctgacggcgctggatgtgacggaggaccttggccgtgatgagccgctgacgctggagatcgtgcagcacttggacgcgaacaccggccgctgcattgcgatgcagacgacggacctgctgaagctgaagtcgaaggttgtgtcgaccggcggcaacatctctgtgccggtgggccgtgagacgctgggccgcatcttcaacgttctgggcgatgcgatcgaccagcgcggccccgtgggcgagaagatgcgcatggcgatccacgccgaggccccgaagctggcggatcaggccgcagaggacacgatcctgacgaccggcatcaaggtgatcgacttgatcctgccctactgcaagggtggcaagatcggcctgttcggcggtgccggtgtgggcaagactgtgatcatcatggagctgatcaacaatgtcgcgaagggccacggtggtttctccgtgtttgccggcgttggcgagcgcacgcgcgagggcacggacctgtacctggagatgatgcagtcgaaggtgattgacctgaagggcgagtcgaagtgcgtgcttgtgtacgggcagatgaacgagcccccgggtgcgcgcgcgcgcgttgcgcagtctgcgctgacgatggcggagtacttccgcgacgtggagggccagaacgtgctgctgttcatcgacaacatcttccgcttcacgcaggcgaactccgaggtgtccgcgctgctgggccgcattccggccgccgtgggctaccagccgacgcttgcggaggatcttggtatgctgcaggagcgcatcacgtcgacaacgaaggggtcgatcacgtccgtgcaggccgtgtacgtgccagcggatgatatcacggatcccgcgcccgcgacgacgttctcgcacctggatgcgacgactgtgctggaccgcgcggtggcggagtcgggcatctaccctgccgtgaacccgctggagtgcgcgtcgcgtatcatggaccccgatgtgatcgatgtggaccactacaacgttgcgcaggatatcgtgcagatgctgaccaagtacaaggagctgcaggacatcattgcggtgcttggcatcgacgagctgagcgaggaagacaaggttgtggtggaccgcgcgcgcaaggtgacccggttcctgtcgcagccgttccaggttgcggaggtgttcacgggcatgacgggccactacgtgcagctggtcgacacggtggagtcgttctctggcctgctgatggggtcgtacgaccagatcccggag

SEQ ID NO: 538 - DNA, 1297 bp, Leishmania amazonensis
  ref <308>: DATABASE ACCESSION NUMBER: ATCC 50131
ttctcggagggcgtgccgcccgtgctgacggcgctggatgtgacggaggaccttggccgcgatgagccgctgacgctggagatcgtgcagcacctggacgcgaacaccggccgctgcattgcgatgcagacgacggacctgttgaagctgaagtcgaaggttgtgtcgaccggcggcaacatctctgtgccggtgggccgtgagacgctgggccgcatcttcaacgtgctgggcgacgcgatcgaccagcgcggccccgtgggtgagaagatgcgcatggcgatccacgccgaggccccgaagctggcggatcaggccgcggaggacacgatcctgacgaccggcatcaaggtgatcgacctgattctgccctactgcaagggtggcaagatcggcctgtttggtggcgccggtgtgggcaagaccgtgatcatcatggagttgattaacaacgtcgcgaagggccacggtggtttctcggtgtttgccggcgttggcgagcgcacgcgcgagggcacggacctgtacctggagatgatgcagtcgaaggtgattgacctgaagggcgagtcgaagtgcgtgcttgtgtacgggcagatgaacgagcccccgggtgcgcgcgcgcgcgttgcgcagtctgcgctgacgatggcggagtacttccgagacgtggagggccagaatgtgctgctgttcatcgacaacatcttccgcttcacgcaggcgaactccgaggtgtctgcgctgctgggccgcattccggccgccgtgggctaccagccgacgcttgcggaggatcttggtatgctgcaggagcgcatcacgtcgacgacgaaggggtcgatcacgtccgtgcaggccgtgtacgtgcctgcggatgatatcacggatccggcgcccgcgacgacgttctcgcacctggacgcgacgactgtgctggaccgcgcggtggcggagtcggggatctaccctgccgtgaacccgctggagtgcgcgtcgcgtatcatggaccccgatgtgatcgacgtggaccactacaacgttgcgcaggatatcgtgcagatgctgaccaagtacaaggagctgcaggatatcattgcggtgcttggtatcgacgagctgagcgaggaggacaaggtcgtggtggaccgcgcgcgcaaggtgacccggttcctgtcgcagccgttccaggttgcggaggtgttcacgggcatgacgggccactacgtgcagctggccgacacggtggagtcgttctctgggctgctgatggggtcgtacgaccagatcccggaga

SEQ ID NO: 539 - DNA, 27 bp, Artificial Sequence
  modified_base (3): i
  modified_base (18): i
  modified_base (21): i
  Synthetic DNA Sequence
ccntacatcctbgtygcnctnaacaag

SEQ ID NO: 540 - DNA, 23 bp, Artificial Sequence
  modified_base (6): i
  modified_base (18): i
  Synthetic DNA Sequence
ggdgcntcytcrtcgwantcctg

SEQ ID NO: 541 - DNA, 23 bp, Artificial Sequence
  Synthetic DNA Sequence
gtkgaaatgttccgcaagctgct

SEQ ID NO: 542 - DNA, 24 bp, Artificial Sequence
  Synthetic DNA Sequence
cggaartagaactgsggacggtag

SEQ ID NO: 543 - DNA, 23 bp, Artificial Sequence
  Synthetic DNA Sequence
atcttagtagtttctgctgctga

SEQ ID NO: 544 - DNA, 23 bp, Artificial Sequence
  Synthetic DNA Sequence
aygttgtcgccmggcattmccat

SEQ ID NO: 545 - DNA, 26 bp, Artificial Sequence
  Synthetic DNA Sequence
  modified_base (15): i
  modified_base (18): i
tacatcctbgtygcnctnaacaagtg

SEQ ID NO: 546 - DNA, 23 bp, Artificial Sequence
  modified_base (6): i
  Synthetic DNA Sequence
ccrcgnccggtratggtgaagat

SEQ ID NO: 547 - DNA, 23 bp, Artificial Sequence
  Synthetic DNA Sequence
gtacagttgcttcaggacgtatc

SEQ ID NO: 548 - DNA, 21 bp, Artificial Sequence
  Synthetic DNA Sequence
acgttcgatttcatcacgttg

SEQ ID NO: 549 - DNA, 24 bp, Artificial Sequence
  Synthetic DNA Sequence
gaacgtgatactgacaaaccttta

SEQ ID NO: 550 - DNA, 20 bp, Artificial Sequence
  Synthetic DNA Sequence
gaagaagaacaccaacgttg

SEQ ID NO: 551 - DNA, 25 bp, Artificial Sequence
  Synthetic DNA Sequence
gaagaaaaaatcttcgaactggcta

SEQ ID NO: 552 - DNA, 19 bp, Artificial Sequence
  Synthetic DNA Sequence
tacacggccggtgactacg

SEQ ID NO: 553 - DNA, 25 bp, Artificial Sequence
  Synthetic DNA Sequence
ggccgtgttgaacgtggtcaaatca

SEQ ID NO: 554 - DNA, 24 bp, Artificial Sequence
  Synthetic DNA Sequence
gttccttacatcgttgtttttctc

SEQ ID NO: 555 - DNA, 24 bp, Artificial Sequence
  Synthetic DNA Sequence
tctcgaactttctctatgtatgca

SEQ ID NO: 556 - DNA, 21 bp, Artificial Sequence
  Synthetic DNA Sequence
  modified_base (7): n=a,t,c or g
cggcgcnatcytsgttgttgc

SEQ ID NO: 557 - DNA, 22 bp, Artificial Sequence
  Synthetic DNA Sequence
ccmaggcatraccatctcggtg

SEQ ID NO: 558 - DNA, 20 bp, Artificial Sequence
  Synthetic DNA Sequence
  modified_base (3): i
  modified_base (15): i
tcnttyaartaygcntgggt

SEQ ID NO: 559 - DNA, 23 bp, Artificial Sequence
  Synthetic DNA Sequence
  modified_base (12): i
  modified_base (18): i
ccgacrgcrayngtytgnckcat

SEQ ID NO: 560 - DNA, 23 bp, Artificial Sequence
  Synthetic DNA Sequence
gayttcatyaaraayatgatyac

SEQ ID NO: 561 - DNA, 23 bp, Artificial Sequence
  Synthetic DNA Sequence
  modified_base (3): i
  modified_base (6): i
acngtncggccrccctcacggat

SEQ ID NO: 562 - DNA, 30 bp, Artificial Sequence
  Synthetic DNA Sequence
  modified_base (15): i
  modified_base (18): i
  modified_base (21): i
  modified_base (24): i
  modified_base (27): i
caratgraygarccnccnggngynmgnatg

SEQ ID NO: 563 - DNA, 26 bp, Artificial Sequence
  modified_base (9): i
  modified_base (12): i
  modified_base (15): i
  modified_base (18): i
  modified_base (21): i
  Synthetic DNA Sequence
ggytgrtanccnacngcnganggcat

SEQ ID NO: 564 - DNA, 29 bp, Artificial Sequence
  Synthetic DNA Sequence
  modified_base (6): i
  modified_base (21): i
  modified_base (24): i
  modified_base (27): i
tayggncaratgaaygarccnccnggnaa

SEQ ID NO: 565 - DNA, 26 bp, Artificial Sequence
  Synthetic DNA Sequence
  modified_base (9): i
  modified_base (12): i
  modified_base (15): i
  modified_base (18): i
  modified_base (21): i
ggytgrtanccnacngcnganggdat

SEQ ID NO: 566 - DNA, 26 bp, Artificial Sequence
  Synthetic DNA Sequence
  modified_base (6): i
  modified_base (9): i
  modified_base (12): i
  modified_base (15): i
  modified_base (18): i
  modified_base (21): i
ttyggnggngcnggngtnggnaarac

SEQ ID NO: 567 - DNA, 26 bp, Artificial Sequence
  Synthetic DNA Sequence
  modified_base (6): i
  modified_base (9): i
  modified_base (12): i
  modified_base (18): i
  modified_base (21): i
tcrtcngcnggnacrtanayngcytg

SEQ ID NO: 568 - DNA, 23 bp, Artificial Sequence
  Synthetic DNA Sequence
  modified_base (3): i
  modified_base (6): i
  modified_base (9): i
  modified_base (12): i
  modified_base (15): i
  modified_base (18): i
rtnatnggngcngtnrtngaygt

SEQ ID NO: 569 - DNA, 23 bp, Artificial Sequence
  Synthetic DNA Sequence
  modified_base (3): i
  modified_base (6): i
  modified_base (9): i
  modified_base (12): i
  modified_base (15): i
  modified_base (18): i
rtnrtnggnscngtnrtngatat

SEQ ID NO: 570 - DNA, 23 bp, Artificial Sequence
  Synthetic DNA Sequence
  modified_base (3): i
  modified_base (6): i
  modified_base (9): i
  modified_base (12): i
  modified_base (15): i
  modified_base (18): i
rtnrynggnccngtnrtngaygt

SEQ ID NO: 571 - DNA, 23 bp, Artificial Sequence
  Synthetic DNA Sequence
  modified_base (3): i
  modified_base (6): i
  modified_base (9): i
  modified_base (12): i
  modified_base (15): i
  modified_base (18): i
rtnrtnggnccngtnrtngatgt

SEQ ID NO: 572 - DNA, 20 bp, Artificial Sequence
  Synthetic DNA Sequence
  modified_base (3): i
  modified_base (6): i
  modified_base (9): i
  modified_base (12): i
  modified_base (15): i
  modified_base (18): i
rtnrtnggnscngtnrtnga

SEQ ID NO: 573 - DNA, 20 bp, Artificial Sequence
  Synthetic DNA Sequence
  modified_base (3): i
  modified_base (6): i
  modified_base (18): i
ccnccnaccatrtaraangc

SEQ ID NO: 574 - DNA, 23 bp, Artificial Sequence
  Synthetic DNA Sequence
  modified_base (3): i
  modified_base (6): i
  modified_base (15): i
  modified_base (18): i
atngcnatggayggnacngargg

SEQ ID NO: 575 - DNA, 25 bp, Artificial Sequence
  modified_base (2): i
  Synthetic DNA Sequence
tnaccatttcagtaccttctggtaa

SEQ ID NO: 576 - DNA, 26 bp, Artificial Sequence
  Synthetic DNA Sequence
aacttcrtcaagaaggtyggttacaa

SEQ ID NO: 577 - DNA, 20 bp, Artificial Sequence
  Synthetic DNA Sequence
catgattgaaccatccacca

SEQ ID NO: 578 - DNA, 20 bp, Artificial Sequence
  Synthetic DNA Sequence
catgattgaagcttccacca

SEQ ID NO: 579 - DNA, 20 bp, Artificial Sequence
  Synthetic DNA Sequence
gaaggccgtgctggtgagaa

SEQ ID NO: 580 - DNA, 25 bp, Artificial Sequence
  Synthetic DNA Sequence
gctaaaccagctacaatcactccac

SEQ ID NO: 581 - DNA, 22 bp, Artificial Sequence
  Synthetic DNA Sequence
acatcggtgcattattacgtgg

SEQ ID NO: 582 - DNA, 28 bp, Artificial Sequence
  Synthetic DNA Sequence
tttcaacttcgtcgttgacacgaacagt

SEQ ID NO: 583 - DNA, 35 bp, Artificial Sequence
  Synthetic DNA Sequence
caactgctttttggatatcttctttaataccaacg

SEQ ID NO: 584 - DNA, 20 bp, Artificial Sequence
  Synthetic DNA Sequence
acatgacacatctaaaacaa

SEQ ID NO: 585 - DNA, 20 bp, Artificial Sequence
  Synthetic DNA Sequence
accacatactgaattcaaag

SEQ ID NO: 586 - DNA, 20 bp, Artificial Sequence
  Synthetic DNA Sequence
cagaagtatacgtattatca

SEQ ID NO: 587 - DNA, 20 bp, Artificial Sequence
  Synthetic DNA Sequence
cgtattatcaaaagacgaag

SEQ ID NO: 588 - DNA, 20 bp, Artificial Sequence
  Synthetic DNA Sequence
tcttctcaaactatcgtcca

SEQ ID NO: 589 - DNA, 20 bp, Artificial Sequence
  Synthetic DNA Sequence
gcacgaaacttctaaaacaa

SEQ ID NO: 590 - DNA, 20 bp, Artificial Sequence
  Synthetic DNA Sequence
tatacgtattatctaaagat

SEQ ID NO: 591 - DNA, 20 bp, Artificial Sequence
  Synthetic DNA Sequence
tcctggttctattacaccac

SEQ ID NO: 592 - DNA, 20 bp, Artificial Sequence
  Synthetic DNA Sequence
caaagctgaagtatacgtat

SEQ ID NO: 593 - DNA, 20 bp, Artificial Sequence
  Synthetic DNA Sequence
ttcactaactatcgcccaca

SEQ ID NO: 594 - DNA, 20 bp, Artificial Sequence
  Synthetic DNA Sequence
attggtatccatgacacttc

SEQ ID NO: 595 - DNA, 20 bp, Artificial Sequence
  Synthetic DNA Sequence
ttaaagcagacgtatacgtt

SEQ ID NO: 596 - DNA, 20 bp, Artificial Sequence
  Synthetic DNA Sequence
gaaattattggtatcaaaga

SEQ ID NO: 597 - DNA, 20 bp, Artificial Sequence
  Synthetic DNA Sequence
attggtatcaaagaaacttc

SEQ ID NO: 598 - DNA, 20 bp, Artificial Sequence
  Synthetic DNA Sequence
aattacacctcacacaaaat

SEQ ID NO: 599 - DNA, 20 bp, Artificial Sequence
  Synthetic DNA Sequence
cggtgaagaaatcgaaatca

SEQ ID NO: 600 - DNA, 20 bp, Artificial Sequence
  Synthetic DNA Sequence
atgcaagaagaatcaagcaa

SEQ ID NO: 601 - DNA, 20 bp, Artificial Sequence
  Synthetic DNA Sequence
gtttcacgtgatgatgtaca

SEQ ID NO: 602 - DNA, 20 bp, Artificial Sequence
  Synthetic DNA Sequence
aagttgaagttgttggtatt

SEQ ID NO: 603 - DNA, 20 bp, Artificial Sequence
  Synthetic DNA Sequence
ggtattaaagacgaaacatc

SEQ ID NO: 604 - DNA, 20 bp, Artificial Sequence
  Synthetic DNA Sequence
ggtgatgaagtagaaatcgt

SEQ ID NO: 605 - DNA, 20 bp, Artificial Sequence
  Synthetic DNA Sequence
gaaatgttccgtaaattatt

SEQ ID NO: 606 - DNA, 20 bp, Artificial Sequence
  Synthetic DNA Sequence
attagactacgctgaagctg

SEQ ID NO: 607 - DNA, 821 bp, Enterococcus faecalis
  ref <308>: DATABASE ACCESSION NUMBER: ATCC 29212
cggagctatcttagtagtttctgctgctgatggtcctatgcctcaaacacgtgaacatatcttattatcacgtaacgttggtgtaccatacatcgttgtattcttaaacaaaatggatatggttgatgacgaagaattattagaattagtagaaatggaagttcgtgacttattatcagaatacgatttcccaggcgatgatgttccagttatcgcaggttctgctttgaaagctttagaaggcgacgagtcttatgaagaaaaaatcttagaattaatggctgcagttgacgaatatatcccaactccagaacgtgatactgacaaaccattcatgatgccagtcgaagacgtattctcaatcactggacgtggtactgttgctacaggacgtgttgaacgtggtgaagttcgcgttggtgacgaagttgaaatcgttggtattaaagacgaaacatctaaaacaactgttacaggtgttgaaatgttccgtaaattattagactacgctgaagcaggcgacaacttcggtgctttattacgtggtgtagcacgtgaagatatcgaacgtggacaagtattagctaaaccagctacaatcactccacacacaaaattcaaagctgaagtatacgtattatcaaaagaagaaggcggacgtcacactccattcttcactaactaccgtcctcaattctacttccgtacaacagacgttactggtgttgtagaattgccagaaggtactgaaatggtaatgcctggtgataacgttgctatggacgttgaattaattcacccaatcgctatcgaagacggaa

SEQ ID NO: 608 - DNA, 751 bp, Enterococcus faecium
  ref <308>: DATABASE ACCESSION NUMBER: ATCC 19434
cggagctatcttggtagtttctgctgctgacggcccaatgcctcaaactcgtgaacacatcctattgtctcgtcaagttggtgttccttacatcgttgtattcttgaacaaagtagacatggttgatgacgaagaattactagaattagttgaaatggaagttcgtgacctattaacagaatacraattccctggtgrcgatgttcctgtagttgctggatcagctttgaaagctctagaaggcgacgcttcatacgaagaaaaaattcttgaattaatggctgcagttgacgaatacatcccaactccagaacgtgacaacgacaaaccattcatgatgccagttgaagacgtgttctcaattactggacgtggtactgttgctacaggtcgtgttgaacgtggacaagttcgcgttggtgacgaagttgaagttgttggtattgctgaagaaacttcaaaaacaacagttactggtgttgaaatgttccgtaaattgttagacyacgctgaagctggagacracattggtgctttactacgtggtgttgcacgtgaagacatccaacgtggacaagttttagctaaaccaggtacaatcacacctcrtacaaaattctctgcagaagtatacgtgttgacaaaagaagaaggtggacgtcatactccattcttcactaactaccgtccacaattctacttccgtacaactgacgtaacaggtgttgttgaattaccagaaggaactgaa

SEQ ID NO: 609 - DNA, 751 bp, Enterococcus gallinarum
  ref <308>: DATABASE ACCESSION NUMBER: ATCC 49573
cggtgcgatcttagtagtatctgctgctgacggtcctatgcctcaaactcgtgaacacatcttgttatcacgtaacgttggcgwaccatacatcgttgttttcttgaacaaaatggatatggttgaygacgaagaattgctagaattagttgaaatggaagttcgtgacctattgtctgaatatgacttcccaggcgacgatgttcctgtaatcgccggttctgctttgaaagctcttgaaggagatccttcatacgaagaaaaaatcatggaattgatggctgcagttgacgaatacgttccaactccagaacgtgatactgacaaaccattcatgatgccagtcgaagacgtattctcaatcactggacgtggtactgttgctacaggccgtgttgaacgtggacaagttcgcgttggtgatgaagtagaaatcgttggtattgctgacgaaactgctaaaacaactgtaacaggtgttgaaatgttccgtaaattgttagactatgctgaagcaggggataacattggtgcattgctacgtggggttgctcgtgaagacatccaacgtggacaagtattggctaaagctggtacratcacacctcatacaaaattcaaagctgaagtttatgttttgacaaaagaagaaggtggrcgtcacactccattcttcactaactaccgtcctcagttctacttccgtacaactgacgtaactggtgttgttgaattaccagaaggaactgaa

SEQ ID NO: 610 - DNA, 891 bp, Haemophilus influenzae Rd
  strain KW20
aatatgattactggtgcggcacaaatggatggtgctattttagtagtagcagcaacagatggtcctatgccacaaactcgtgaacacatcttattaggtcgccaagtaggtgttccatacatcatcgtattcttaaacaaatgcgacatggtagatgacgaagagttattagaattagtcgaaatggaagttcgtgaacttctatctcaatatgacttcccaggtgacgatacaccaatcgtacgtggttcagcattacaagcgttaaacggcgtagcagaatgggaagaaaaaatccttgagttagcaaaccacttagatacttacatcccagaaccagaacgtgcgattgaccaaccgttccttcttccaatcgaagatgtgttctcaatctcaggtcgtggtactgtagtaacaggtcgtgtagaacgaggtattatccgtacaggtgatgaagtagaaatcgtcggtatcaaagatacagcgaaaactactgtaacgggtgttgaaatgttccgtaaattacttgacgaaggtcgtgcaggtgaaaacatcggtgcattattacgtggtaccaaacgtgaagaaatcgaacgtggtcaagtattagcgaaaccaggttcaatcacaccacacactgacttcgaatcagaagtgtacgtattatcaaaagatgaaggtggtcgtcatactccattcttcaaaggttaccgtccacaattctatttccgtacaacagacgtgactggtacaatcgaattaccagaaggcgtggaaatggtaatgccaggcgataacatcaagatgacagtaagcttaatccacccaattgcgatggatcaaggtttacgtttcgcaatccgtgaaggtggccgtacagtaggtgcaggc

SEQ ID NO: 611 - DNA, 818 bp, Staphylococcus epidermidis
  ref <308>: DATABASE ACCESSION NUMBER: ATCC 14990
cggcggtatcttagttgtatctgctgctgacggtccaatgccacaaactcgtgaacacatcttattatcacgtaacgttggtgtaccagcattagttgtattcttaaacaaagttgacatggtagacgacgaagaattattagaattagttgaaatggaagttcgtgacttattaagcgaatatgacttcccaggtgacgatgtacctgtaatcgctggttctgcattaaaagcattagaaggcgatgctgaatacgaacaaaaaatcttagacttaatgcaagcagttgatgattacattccaactccagaacgtgattctgacaaaccattcatgatgccagttgaggacgtattctcaatcactggtcgtggtactgttgctacaggccgtgttgaacgtggtcaaatcaaagttggtgaagaagttgaaatcatcggtatgcacgaaacttctaaaacaactgttactggtgtagaaatgttccgtaaattattagactacgctgaagctggtgacaacatcggtgctttattacgtggtgttgcacgtgaagacgtacaacgtggtcaagtattagctgctcctggttctattacaccacacacaaaattcaaagctgaagtatacgtattatctaaagatgaaggtggacgtcacactccattcttcactaactatcgcccacaattctatttccgtactactgacgtaactggtgttgtaaacttaccagaaggtacagaaatggttatgcctggcgacaacgttgaaatgacagttgaattaatcgctccaatcgctatcgaagacggaa

SEQ ID NO: 612 - DNA, 825 bp, Salmonella choleraesuis subsp. choleraesuis
  ref <308>: DATABASE ACCESSION NUMBER: ATCC 9150
ggcgcgatcctggttgttgctgcgactgacggcccgatgccgcagacccgtgagcacatcctgctgggtcgtcaggtaggcgttccgtacatcatcgtgttcctgaacaaatgcgacatggttgatgacgaagagctgctggaactggttgaaatggaagttcgtgaacttctgtctcagtacgacttcccgggcgacgacacgccgatcgttcgtggttctgctctgaaagcgctggaaggcgacgcagagtgggaagcgaaaatcatcgaactggctggcttcctggattcttacatcccggaaccagagcgtgcgattgacaagccgttcctgctgccgatcgaagacgtattctccatctccggtcgtggtaccgttgttaccggtcgtgtagaacgcggtatcatcaaagtgggcgaagaagttgaaatcgttggtatcaaagagactcagaagtctacctgtactggcgttgaaatgttccgcaaactgctggacgaaggccgtgccggtgagaacgtaggtgttctgctgcgtggtatcaaacgtgaagaaatcgaacgtggtcaggtactggctaagccgggcaccatcaagccgcacaccaagttcgaatctgaagtgtacattctgtccaaagatgaaggcggccgtcatactccgttcttcaaaggctaccgtccgcagttctacttccgtactactgacgtgactggcaccatcgaactgccggaaggcgtagagatggtaatgccgggcgacaacatcaaaatggttgttaccctgatccacccgatcgcaatggacgacggtctgcgtttc

SEQ ID NO: 613 - DNA, 778 bp, Serratia ficaria
  ref <308>: DATABASE ACCESSION NUMBER: ATCC 33105
ggcgctatcctggttgttgctgcgactgacggcccaatgcctcagacccgtgagcacatcctgctgggtcgycaggttggcgttcctttcatcatcgtrttcatgaacaaatgcgacatggttgatgatgaagagctgctggaactggtagaaatggaagttcgcgaactgctgtccgcttacgacttccctggcgatgacctgccggtgattcgcggttccgcgctgaaagcgctggaaggcgaagccgagtgggaagctaaaatcatcgagctggctgamcmsctggatacttacatcccagaaccagagcgcgctatcgacaagccgttcctgctgccaatcgaagacgtattctccatctccggtcgtggtaccgtggttaccggtcgtgttgagcgcggtatcatcaaagttggcgaagaagttgaaatcgttggtatcaaagacaccgtcaagtctacctgtaccggcgttgaaatgttccgcaaactgctggacgaaggccgtgccggtgagaacgtaggtgttctgctgcgtggtatcaagcgtgaagacatcgaacgtggtcaggttctggctaaaccaggttccatcaagccgcacacccagttcgattcagaagtgtacatcctgagcaaagaagaaggtggtcgtcacackccattcttcaaaggctaccgtccacagttctacttccgtactactgacgtgaccggtaccatcgaactgccagaaggcgttgagatggtaatgcctggcgacaacgtgaacatga

SEQ ID NO: 614 - DNA, 653 bp, Enterococcus malodoratus
  ref <308>: DATABASE ACCESSION NUMBER: ATCC 43197
gtgcgatcttagtagtatcagctactgatggtccaatgcctcaaactcgtgaacacattttgttatcacgtcaagttggtgttaagcacttgatcgttttcttgaacaaagtagatttagttgatgacgaagaattgatcgacttagttgaaatggaagtacgtgaattactttctgaatatggtttcccaggtgatgatattccagtgcttaaaggttctgctttgaaagcattagaaggcgatccagaacaagaacaagttattcttgatttgatggataccgttgatgaatatatcccaacacctgaacgtgacaatgacaaaccgttcttgttaccagttgaggatgttttctcgatcacaggacgtggtactgtagcttctggtcgtatcgaccgtggcgaagttaaagtcggcgatgaaattgaaatcatcgggatcaaacctgaagttcaaaaagcaatcgttactggacttgaaatgttccgtaaaacattggattatggtgaagctggcgataacgttggggttctattacgtgggattacacgtgatgaaatcgaacgtggccaagtattagctaaaccaggttcaatcacaccacatactaagttcaaagccgaagtatatgtgttgacgaaagaagaaggt

SEQ ID NO: 615 - DNA, 829 bp, Enterococcus durans
  ref <308>: DATABASE ACCESSION NUMBER: ATCC 19432
ccattctagttgtatctgcaacagatggaccaatgccacaaacacgtgaacatattttattgtcacgtcaagtaggtgttaaatatttgatcgtcttcttgaacaaaatcgacttagtagatgatgaagaattgattgatcttgtcgaaatggaagttcgtgaattattaagcgaatatggtttcccaggtgacgatacaccagtcatcaaaggttcagcattaaaagctttacaaggagatcctgatgcagaagcagctatcatggaattgatggatactgttgatgaatatatcccaacaccagaacgtgatacagacaaaccattattgttaccagtggaagatgtcttctcaatcacaggtcgtgggactgttgcttcaggtcgtatcgatcgtggtgcagttcgtgtaggtgatgaaatcgaaatcgtcggtatcaaacctgaaacacaaaaagctgttgtaactggggtcgaaatgttccgcaagacattagactatggtgaagcaggagataacgttggggtattgttacgtggtatccaacgtgaagatatcgaacgtggacaagtaatcgcaaaaccaggttcaatcacaccacatacaaaattcaaagcagaagtgtacgtattgacaaaagaagaaggtggacgtcatacaccattcttcaataactatcgtccacaattctacttccgtacaactgacgtaactggaacaatcgttttacctggaggcactgaaatggttatgcctggagataacgtaacgatcgacgttgaattgatccatccagttgccatcgaaaacggaacaactttctctat

SEQ ID NO: 616 - DNA, 669 bp, Enterococcus pseudoavium
  ref <308>: DATABASE ACCESSION NUMBER: ATCC 49372
ggtgcaattttagtagtatctgctactgatggcccaatgccacaaacacgtgaacatatcttgttatcacgtcaagtaggggttaaacacttaatcgtcttcttgaacaaagttgatttagttgatgatgaagaattgatcgatttagttgaaatggaagttcgggaattgctttctgaatatggtttcccaggcgatgatattccagtacttaaaggttctgctttgaaagctttagaaggcgatcctgaacaagaacaagtaatccttgacttgatggatacggttgatgaatacatcccaacgcctgaacgtgatactgacaaaccattcttgttaccagtcgaagatgtcttctcaatcacaggacgtggtacggttgcatctggtcgtatcgatcgtggggaagttaaagtcggtgatgaagttgaaatcatcgggatcaaacctgaagtgcaaaaagctgtcgtaactggactagaaatgttccgtaagacattggattacggtgaagctggcgataacgttggggttctattacgtgggattactcgtgatgaaatcgaacgtggacaagtattagctaaaccaggttcaatcactccacatacgaaattcagtgcagaagtttatgtattgacgaaagaagaaggtggccgtcatacgcca

SEQ ID NO: 617 - DNA, 835 bp, Enterococcus dispar
  ref <308>: DATABASE ACCESSION NUMBER: ATCC 51266
cggggcaattttagttgtatctgcaactgatggcccaatgccacaaacacgtgaacacattttgttagctcgtcaagtaggggttaaatatttaatcgtcttcttgaacaaaacagatttagttgatgatgaagaattattggaactagttgaaatggaagttcgtgaattattaaatgaatacaatttccctggcgatgatattcctgttattcgcggatctgctttaaaagcattagaaggcgatccagaacaagaagaagtaattatgaacttgatggatactgtggatgaatatatcccaactccagaacgtgacaatgataaaccattcttgttaccagtggaagatgtcttcacaattactggtcgtggtactgttgcttcaggtcgtatcgaccgtggtaaagtcaacgttggtgatgaaattgaaattatcggaattaaaccagaaacacaaaaagctgttgtaaccggtttggaaatgttccgtaaaactttggattatggtgaagctggtgataacgttggggtcttattacgtgggattactcgtgatgaagtagaacgtggtcaagtattagcaaaaccaggttccattacaccgcataccaaatttaaaggtgaagtttatatcttaacaaaagaagaaggtggacgtcatactcctttctttaataactatcgtcctcaattttatttccgtacaactgatgtgactggtaacatcgcattacctgaaggaactgaaatggtaatgcctggtgataatgtaacaattgaagttgaattgattcatccaatcgccgttgaaaaagggactactttctcaatt

SEQ ID NO: 618 - DNA, 673 bp, Enterococcus avium
  ref <308>: DATABASE ACCESSION NUMBER: ATCC 14025
ggtgcaatcctagtagtatcagctactgatggtccaatgccgcaaacacgtgaacatattttgctatcacggcaagtgggtgttaaacacttaatcgtatttttaaacaaagttgatttagtcgatgatgaagaattgatcgatctagttgaaatggaagtccgtgaattactttctgaatatggtttcccaggtgacgatattccagttctcaaaggttcagctttgaaagcattagaaggcgatcctgaacaagaacaagtaatccttgatttaatggatacagttgacgaatatatcccaactccagaacgtgacactgacaagccattcttgttaccagtcgaagatgtattttctatcactggtcgtgggactgtagcgtctggacggattgatcgtggtgaagttaaagtcggcgatgaagttgaaatcatcgggatcaaacctgaaattcaaaaagcagtcgtaactggacttgaaatgttccgtaaaactttagattatggtgaagctggcgataacgttggggttctattacgtgggattacacgtgatgaaatcgaacgtggtcaagtcttagctaaaccaggttcaatcacaccacatacaaaattcagtgcagaagtttacgtattgacgaaagaagaaggtggacgtcatacaccatctt

SEQ ID NO: 619 - DNA, 1713 bp, Saccharomyces cerevisiae
tttcatatttttaaggattttgttttagcacccatccgacctcagtcaatatatcctttcgcgaccaggctttcctcccttttgctgctaactggttacagattttcctatttttggtcatttttatctttgaaactgattaagctgaaaaaatttgagcttctttgttgtaaactattttgtgctttcagttttattctagctcgacaaaggtaacagacaaaaatgtcagctttattaccaagattactcacaagaacagcttttaaagcttctgggaaacttctgaggctctcttcagtaatttctaggaccttttctcaaactactacttcctatgcagctgcttttgatcgttccaaaccgcatgtaaatataggtacgatcggccatgttgatcatgggaagacaactttaaccgcagccattacgaaaacgttagccgcaaaaggtggtgccaacttcttggactatgctgccatcgataaggctccggaagaaagagctcgtggtattacaatttctactgcacacgtggaatacgaaacggccaagagacattattctcacgtcgactgtccaggccacgctgattacatcaagaatatgattaccggtgctgctcaaatggatggtgctatcattgttgtagctgctaccgatggacaaatgccccaaactagagaacatttacttttggccagacaagttggtgtccaacatattgtcgtttttgttaacaaggttgataccattgatgatccagaaatgttagagttagtcgaaatggaaatgagagaacttttaaacgaatatgggtttgacggtgataatgctccaattatcatgggttctgccctttgcgctttggaaggtcgccaacctgaaattggggagcaggccatcatgaaacttttggatgcagtggatgagtatattcctacacctgaaagagatttgaacaagcctttcttgatgcccgttgaagatatcttctctatctccggtagaggtactgtggtcactggtcgtgtggaaaggggtaatttaaagaaaggtgaggaattggaaattgttggtcacaactccaccccattgaaaacaacagttactggtattgaaatgtttagaaaggaattggactctgctatggcaggtgacaatgccggtgttttacttagaggtatcaggagagatcaattgaagagaggtatggtcttagctaagccaggtaccgttaaagcccatacaaagattctagcctctttgtacattttatccaaagaggaaggtggtagacattctgggtttggtgaaaactacagaccacaaatgtttataagaacagctgatgttacagttgtgatgagatttcctaaggaggttgaagatcattctatgcaagttatgccaggtgacaatgttgaaatggaatgtgatttgatccatcctaccccattagaagttggtcaacgtttcaatatcagagagggtggaagaactgttggtaccggtctaatcacacgtattattgaatagacttattgatgcaactggagtatatttctatatattctgttcatttcccctctcataatatatacttgtttcgttaaaattttatacgtgtaaataaagtgccataaatttttcagctttacttttggtagagtcctgctagcactagattttacaatttcatgtgcacacacc

SEQ ID NO: 620 - DNA, 18 bp, Artificial Sequence
  Synthetic DNA Sequence
attggtgcattgctacgt

SEQ ID NO: 621 - DNA, 751 bp, Enterococcus faecium
  ref <308>: DATABASE ACCESSION NUMBER: ATCC 19434
tggtgcaatcttagttgtttctgcaactgacggtccgatgcctcaaacacgtgaacacattttattgtcacgccaagttggtgtaaaatacctgattgttttcttgaacaaagttgatttagtcgatgatgaagaattgatcgatttggtagaaatggaagttcgcgagttattgagcgaatatggtttcccaggcgatgacactcctgtgatcaaaggttccgcattaaaagcattgcaaggcgatccagatgctgaagctgctattatggaattgatggatacagtagatgaatatatcccaacaccagaacgtgatacagataaaccattactattgccagtggaagacgtcttctcaattacaggtcgaggaactgttgcctcaggtcgtattgatcgtggtgctgttcgtgtcggtgatgaggtagagatcgtagggatcaaacctgaaacacaaaaagcagttgtaacaggtgtagaaatgttccgtaaaacgttagattacggggaagctggggataacgtaggcgtgttgttacgggggatccaacgtgacgatatcgaacgtggacaagtacttgctaaaccaggttccattactccacatacaaaattcaaagcagaagtgtacgtgttgacaaaagaagaaggtggacgtcatactccattcttcaacaactatcgtccacagttctacttccgcacaactgatgttacaggaacaatcacattgccagaagatacagaa

SEQ ID NO: 622 - DNA, 750 bp, Saccharomyces cerevisiae
  ref <308>: DATABASE ACCESSION NUMBER: ATCC 13264
gtcaaatgggacgaatccagattccaagaaattgtcaaggaaacctccaactttatcaagaaggttggttacaacccaaagactgttccattcgtcccaatctctggttggaacggtgacaacatgattgaagctaccaccaacgctccatggtacaagggttgggaaaaggaaaccaaggccggtgtcgtcaagggtaagactttgttggaagccattgacgccattgaacaaccatctagaccaactgacaagccattgagattgccattgcaagatgtttacaagattggtggtattggtactgtgccagtcggtagagttgaaaccggtgtcatcaagccaggtatggttgttactttcgccccagctggtgttaccactgaagtcaagtccgttgaaatgcatcacgaacaattggaacaaggtgttccaggtgacaacgttggtttcaacgtcaagaacgtttccgttaaggaaatcagaagaggtaacgtctgtggtgacgctaagaacgatccaccaaagggttgcgcttctttcaacgctaccgtcattgttttgaaccatccaggtcaaatctctgctggttactctccagttttggattgtcacactgctcacattgcttgtagattcgacgaattgttggaaaagaacgacagaagatctggtaagaagttggaagaccatccaaagttcttgaagtccggtgacgctgctttggtcaagttcgttccatctaagcca

SEQ ID NO: 623 - DNA, 1269 bp, Cryptococcus neoformans
  ref <308>: DATABASE ACCESSION NUMBER: ATCC 44104
tcttgaaagcttaaggccgagcgagagcgaggtatcaccatcgacattgctctttggaagttcgagacccccaggtaccaggtcaccgtcattgacgcccccggtcaccgagacttcatcaagaacatgatcaccggtacctcccaggctgactgtgccatcctcatcattgccaccggtatcggtgagttcgaggccggtatctccaaggacggtcagacccgagagcacgccctcctcgccttcaccctcggtgtcaggcagctcattgttgcttgcaacaagatggacacctgcaagtggtccgaggaccgattcaacgaaatcgtcaaggagaccaacggtttcatcaagaaggttggttacaaccccaaggctgtccccttcgtccccatctctggttggcacggtgacaacatgttggaggagaccaccaagtcagtgaatccgcttctacgtgatgagatgtttttctgactttccgtgcagcatgccctggtacaagggatggaccaaggagaccaagtctggtgtttccaagggtaagaccctcctcgaggccatcgacgccatcgagccccctacccgacccaccgacaagcccctccgtctccctctccaggacgtctacaagatcggtggtatcggcacagtccctgtcggccgagtcgagaccggtgtcatcaaggccggtatgttgtctcatctctcttgtctcgtaacatgcgtctcgtaacatgcgcttacttcattttcaggtatggtcgtcaagttcgcccccaccaacgtcaccactgaagtcaagtccgttgagatgcaccacgagcagatccccgagggtcttcccggagacaacgttggtttcaacgtcaagaacgtttccatcaaggacatccgacgaggtaacgtctgtggtgactccaagaacgacccccctatggaggctgcttctttcaacgcccaggttatcgtccttaaccaccctggtcagatcggtgccggttacacccccgttctcgactgtcacactgcccgtaagcctgacccaatacctccaacatacctttgaagctgaccctttctagacattgcctgcaagtttgctgagttgatcgagaagattgaccgacgaaccggtaaggtcatggaggccgcccccaagttcgtcaagtctggtgacgccgccattgtcaagcttgttgcccagaagcccctctgtgttgagacctacgccgactacccccctcttggtcgattcgccgtccgaga

SEQ ID NO: 624 - DNA, 753 bp, Candida albicans
  ref <308>: DATABASE ACCESSION NUMBER: ATCC 36801
tctgtcaaatgggacaaaaacagatttgaagaaatcatcaaggaaacctccaacttcgtcaagaaggttggttacaacccaaagactgttccattcgttccaatctctggttggaatggtgacaacatgattgaaccatccaccaactgtccatggtacaagggttgggaaaaggaaaccaaatccggtaaagttactggtaagaccttgttagaagctattgacgctattgaaccaccaaccagaccaaccgacaaaccattgagattgccattgcaagatgtttacaagatcggtggtattggtactgtgccagtcggtagagttgaaactggtatcatcaaagccggtatggttgttactttcgccccagctggtgttaccactgaagtcaaatccgttgaaatgcatcacgaacaattggctgaaggtgttccaggtgacaatgttggtttcaacgttaagaacgtttccgttaaagaaattagaagaggtaacgtttgtggtgactccaagaacgatccaccaaagggttgtgactctttcaatgcccaagtcattgttttgaaccatccaggtcaaatctctgctggttactctccagtcttggattgtcaccctgcccacattgcttgtaaattcgacactttggttgaaaagattgacagaagaactggtaagaaattggaagaaaatccaaaattcgtcaaatccggtgatgctgctatcgtcaagatggtcccaaccaaacca

SEQ ID NO: 625 - DNA, 26 bp, Artificial Sequence
  Synthetic DNA Sequence
cgttgaagacacgacccaaagtatcc

SEQ ID NO: 626 - DNA, 26 bp, Artificial Sequence
  Synthetic DNA Sequence
taccaccttttaagtaaggtgctaat

SEQ ID NO: 627 - DNA, 26 bp, Artificial Sequence
  Synthetic DNA Sequence
attgtctataaaaatggcgataagtc

SEQ ID NO: 628 - DNA, 26 bp, Artificial Sequence
  Synthetic DNA Sequence
aaaatggcgataagtcacaaaaagta

SEQ ID NO: 629 - DNA, 25 bp, Artificial Sequence
  Synthetic DNA Sequence
aagttccatctcaacaaggtcaata

SEQ ID NO: 630 - DNA, 22 bp, Artificial Sequence
  Synthetic DNA Sequence
cggagctatcctagtcgtttca

SEQ ID NO: 631 - DNA, 26 bp, Artificial Sequence
  modified_base (13): i
  Synthetic DNA Sequence
cagaccaacyganaarccattragat

SEQ ID NO: 632 - DNA, 23 bp, Artificial Sequence
  Synthetic DNA Sequence
ccctttggtggrtcstkcttgga

SEQ ID NO: 633 - DNA, 26 bp, Artificial Sequence
  modified_base (13): i
  modified_base (19): i
  Synthetic DNA Sequence
cagaccaacyganaarccnttragat

SEQ ID NO: 634 - DNA, 26 bp, Artificial Sequence
  modified_base (15): i
  Synthetic DNA Sequence
aacacygtcagrrcnattgcyatgga

SEQ ID NO: 635 - DNA, 26 bp, Artificial Sequence
  modified_base (9): i
  modified_base (21): i
  Synthetic DNA Sequence
aaaccrgtnarrgcractctngctct

SEQ ID NO: 636 - DNA, 23 bp, Artificial Sequence
  Synthetic DNA Sequence
  modified_base (12): i
actggygttganatgttccgyaa

SEQ ID NO: 637 - DNA, 23 bp, Artificial Sequence
  Synthetic DNA Sequence
  modified_base (9): i
acgtcagtngtacggaartagaa

SEQ ID NO: 638 - DNA, 26 bp, Artificial Sequence
  Synthetic DNA Sequence
  modified_base (15): i
ccaatgccacaaacncgtgarcacat

SEQ ID NO: 639 - DNA, 28 bp, Artificial Sequence
  Synthetic DNA Sequence
  modified_base (25): i
tttacggaacatttcwacaccwgtnaca

SEQ ID NO: 640 - DNA, 23 bp, Artificial Sequence
  Synthetic DNA Sequence
  modified_base (9): i
  modified_base (15): i
tccatggtntwyggncaratgaa

SEQ ID NO: 641 - DNA, 26 bp, Artificial Sequence
  Synthetic DNA Sequence
  modified_base (12): i
  modified_base (15): i
  modified_base (18): i
tgataaccwacngcnganggcatacg

SEQ ID NO: 642 - DNA, 23 bp, Artificial Sequence
  Synthetic DNA Sequence
  modified_base (6): i
  modified_base (9): i
  modified_base (15): i
  modified_base (18): i
ggcgtnggngarcgnacncgtga

SEQ ID NO: 643 - DNA, 23 bp, Artificial Sequence
  Synthetic DNA Sequence
  modified_base (6): i
  modified_base (9): i
actggngtngaratgttccgyaa

SEQ ID NO: 644 - DNA, 23 bp, Artificial Sequence
  Synthetic DNA Sequence
  modified_base (6): i
  modified_base (9): i
  modified_base (12): i
acgtcngtngtnckgaartagaa

SEQ ID NO: 645 - DNA, 23 bp, Artificial Sequence
  Synthetic DNA Sequence
  modified_base (6): i
  modified_base (9): i
  modified_base (12): i
acgtcngtngtnckgaartaraa

SEQ ID NO: 646 - DNA, 23 bp, Artificial Sequence
  Synthetic DNA Sequence
  modified_base (12): i
  modified_base (18): i
atcgacaagccnttcytnatgsc

SEQ ID NO: 647 - DNA, 26 bp, Artificial Sequence
  Synthetic DNA Sequence
acgtccgtsgtrcggaagtagaactg

SEQ ID NO: 648 - DNA, 26 bp, Artificial Sequence
  Synthetic DNA Sequence
acgtcsgtsgtrcggaagtagaactg

SEQ ID NO: 649 - DNA, 26 bp, Artificial Sequence
  Synthetic DNA Sequence
  modified_base (20): i
gtcctatgcctcaracwcgngagcac

SEQ ID NO: 650 - DNA, 23 bp, Artificial Sequence
  Synthetic DNA Sequence
  modified_base (21): i
ttacggaacatytcaacaccngt

SEQ ID NO: 651 - DNA, 25 bp, Artificial Sequence
  Synthetic DNA Sequence
  modified_base (12): i
tgacgaccaccntcytcyttyttca

SEQ ID NO: 652 - DNA, 27 bp, Artificial Sequence
  Synthetic DNA Sequence
  modified_base (9): i
  modified_base (12): i
  modified_base (15): i
  modified_base (24): i
ccwayagtnyknccnccytcyctnata

SEQ ID NO: 653 - DNA, 20 bp, Artificial Sequence
  Synthetic DNA Sequence
  modified_base (9): i
gayttcatnaaraayatgat

SEQ ID NO: 654 - DNA, 20 bp, Artificial Sequence
  Synthetic DNA Sequence
  modified_base (12): i
tacaaratykgnggtatygg

SEQ ID NO: 655 - DNA, 20 bp, Artificial Sequence
  Synthetic DNA Sequence
  modified_base (9): i
ccrataccncmratyttgta

SEQ ID NO: 656 - DNA, 22 bp, Artificial Sequence
  Synthetic DNA Sequence
aattaatggctgcagttgayga

SEQ ID NO: 657 - DNA, 22 bp, Artificial Sequence
  Synthetic DNA Sequence
ttgtccacgttcgatrtcttca

SEQ ID NO: 658 - DNA, 23 bp, Artificial Sequence
  Synthetic DNA Sequence
gatytagtcgatgatgaagaatt

SEQ ID NO: 659 - DNA, 23 bp, Artificial Sequence
  Synthetic DNA Sequence
  modified_base (9): i
gctttttgngtttcwggtttrat

SEQ ID NO: 660 - DNA, 23 bp, Artificial Sequence
  Synthetic DNA Sequence
gtagaattgaggacggtagttag

SEQ ID NO: 661 - DNA, 23 bp, Artificial Sequence
  Synthetic DNA Sequence
gtagaaytgtggwcgatarttrt

SEQ ID NO: 662 - DNA, 832 bp, Corynebacterium diphtheriae
  ref <308>: DATABASE ACCESSION NUMBER: ATCC 27010
cggcgcaatcctcgttgttgctgccaccgacggcccaatgcctcagacccgtgagcacgttctgctcgctcgccaggtcggcgttccttacatcctcgttgctctgaacaagtgcgacatggttgatgatgaggaaatcatcgagctcgtcgagatggagatccrtgagctgctcgctgagcaggattacgacgaagaggctccaatcatccacatctccgcactgaaggctcttgagggcgacgagaagtggacccagtccatcatcgacctcatgcaggcttgckatgattccatcccagacccagagcgtgagaccgacaagccattcctcatgcctatcgaggacatcttcaccatcaccggccgcggtaccgttgttaccggccgtgttgagcgtggctccctgaaggtcaacgaggacgtcgagatcatcggtatccgcgagaakgctaccaccaccaccgttaccggtatcgagatgttccgtaagcttctcgactacaccgaggctggcgacaactgtggtctgcttctccgtggcgttaagcgcgaagacgttgagcgtggccaggttgttgttaagccaggcgcttacacccctcacaccgagttcgagggctctgtctacgttctgtccaaggacgagggtggccgccacaccccattcttcgacaactaccgcccacagttctacttccgcaccaccgacgttaccggtgttgtgaagcttcctgagggcaccgagatggtcatgcctggcgacaacgtcgacatgtccgtcaccctgatccagcctgtcgctatggatgagggcctgcgcttcgctatc

SEQ ID NO: 663 - DNA, 1192 bp, Candida catenulata
  ref <308>: DATABASE ACCESSION NUMBER: ATCC 10565
aacggcgagcaagacttggtgttggaggtttctcagcacttgggtgagaacaccgtgcgtaccattgccatggacggtaccgagggtttggtgagaggtaccgctgtcactgacaccggtgctcccatctcggtccccgttggtcagggtaccttgggccggatcatcaacgttgtcggtgagcccatcgacgagcgtggtcccatccagtgcaagcagagaaaccccattcacgccgagcccccgtctttcaccgagcagtccgtcgaggctgaggtgttggagaccggtatcaaggttgtcgacttgttggctccctacgcccgtggtggtaagattggtcttttcggtggtgccggtgtcggtaagaccgtgttcatccaggagttgattaacaacattgccaaggcccacggtggtttctccgtgttcactggtgtcggtgagcgtactcgtgagggtaacgacttgtaccgtgaaatgaaggagaccggtgtcatcaacttggagggcgactccaaggtggccttggtgttcggtcagatgaacgagcccccgggggctcgtgcccgtgtcgccttgaccggtttgaccattgccgagtacttccgtgacgaggaaggccaggacgtgttgttgttcgttgacaacattttcagattcacccaggccggttccgaggtgtcggcgttgttgggtcgtatcccctccgccgtcggttaccagcccactttggccaccgacatgggtttgttgcaggagagaattaccaccaccaagaagggttccgtcacctctgtgcaggccgtgtacgtccctgccgatgacttgactgaccctgcccccgccaccactttcgctcacttggacgccaccaccgtgttgtcgcgtggtatctccgagttgggtatctaccccgccgtcgaccccttggactccaagtcgagattgttggacgtcgaggttgttggccaggagcactacgacgtcgccaccggtgtccaggagtgcttgcaggcctacaagtcgttgcaggacatcattgccattttgggtatggacgagttgtccgagcaggacaagttgaccgtcgagagagcccgtaagatccagcgtttcttgtcgcagcccttcgctgtcgccgaggttttcactggtatccccggtagattggtgagattgcaggacaccg

SEQ ID NO: 664 - DNA, 29 bp, Artificial Sequence
  Synthetic DNA Sequence
  modified_base (9): i
  modified_base (12): i
  modified_base (15): i
  modified_base (18): i
  modified_base (21): i
aayatgatnacnggngcngcncaratgga

SEQ ID NO: 665 - DNA, 1377 bp, Saccharomyces cerevisiae
atgggtaaagagaagtctcacattaacgttgtcgttatcggtcatgtcgattctggtaagtctaccactaccggtcatttgatttacaagtgtggtggtattgacaagagaaccatcgaaaagttcgaaaaggaagccgctgaattaggtaagggttctttcaagtacgcttgggttttggacaagttaaaggctgaaagagaaagaggtatcactatcgatattgctttgtggaagttcgaaactccaaagtaccaagttaccgttattgatgctccaggtcacagagatttcatcaagaacatgattactggtacttctcaagctgactgtgctatcttgattattgctggtggtgtcggtgaattcgaagccggtatctctaaggatggtcaaaccagagaacacgctttgttggctttcaccttgggtgttagacaattgattgttgctgtcaacaagatggactccgtcaaatgggacgaatccagattccaagaaattgtcaaggaaacctccaactttatcaagaaggttggttacaacccaaagactgttccattcgtcccaatctctggttggaacggtgacaacatgattgaagctaccaccaacgctccatggtacaagggttgggaaaaggaaaccaaggccggtgtcgtcaagggtaagactttgttggaagccattgacgccattgaacaaccatctagaccaactgacaagccattgagattgccattgcaagatgtttacaagattggtggtattggtactgtgccagtcggtagagttgaaaccggtgtcatcaagccaggtatggttgttacttttgccccagctggtgttaccactgaagtcaagtccgttgaaatgcatcacgaacaattggaacaaggtgttccaggtgacaacgttggtttcaacgtcaagaacgtttccgttaaggaaatcagaagaggtaacgtctgtggtgacgctaagaacgatccaccaaagggttgcgcttctttcaacgctaccgtcattgttttgaaccatccaggtcaaatctctgctggttactctccagttttggattgtcacactgctcacattgcttgtagattcgacgaattgttggaaaagaacgacagaagatctggtaagaagttggaagaccatccaaagttcttgaagtccggtgacgctgctttggtcaagttcgttccatctaagccaatgtgtgttgaagctttcagtgaatacccaccattaggtagattcgctgtcagagacatgagacaaactgtcgctgtcggtgttatcaagtctgttgacaagactgaaaaggccgctaaggttaccaaggctgctcaaaaggctgctaagaaataa

SEQ ID NO: 666 - DNA, 1536 bp, Saccharomyces cerevisiae
atggttttgccaagactatatactgctacatcccgtgctgcttttaaagcagccaaacaatccgctccgcttctatccacttcgtggaaaagatgtatggcctcagctgctcaatctactccaatcaccggtaaagttaccgctgtcattggtgccattgttgacgttcattttgaacaatcagagttgcccgctattttgaacgctttagaaattaaaacacctcaaggtaagttggttttggaagttgctcaacatttgggtgaaaacactgtcagaaccattgctatggatggtaccgaaggtttggtccgtggtgaaaaggttcttgacactggtggccctatctccgtcccagttgggagagaaactttagggagaatcatcaacgttatcggtgaacctattgatgaaagaggtccaattaagtccaaactaagaaagccaattcacgcagaccctcctagttttgcagaacaatctacttcggctgaaattttggaaacaggtatcaaagtcgtcgatctattagctccttatgccagaggtggtaagattggtcttttcggtggtgcaggtgtcggtaagactgtgttcattcaagaattgattaacaatatcgccaaggcccatggtggtttttccgttttcgccggtgttggtgaaaggaccagagagggtaatgacttgtaccgtgaaatgaaggaaactggagtcattaacttggaaggtgaatccaaggtcgccttagttttcggtcaaatgaacgaacctccaggagccagagccagagtcgctttaactggtttgacgatcgctgaatatttcagagatgaagaaggtcaagacgtcttgttgtttatcgacaatatctttagatttactcaagctggttcagaagtctctgcccttttgggtcgtattccatctgccgtcggttatcaaccaactttggccactgatatgggtctcttacaagaaagaattaccaccacaaagaagggttctgtcacttctgtgcaagccgtttatgttccagccgatgatttaacagatccgtctccgtccacatcttttgcccatttggacgcatcatccgtcttgtcaagaggtatttcagaattaggtatttaccctgcagtggatccattggattctaaatcaaggttattggatgccgccgttgtcggtcaagaacattatgacgtcgcctccaaggttcaagaaactttacagacctataaatctttacaagatatcattgctattttgggtatggatgaattgtccgaacaagataaactaactgtcgaaagggcaagaaagattcaaagattcttatctcaaccatttgctgtcgccgaagtctttactggtatcccaggtaaattagtgagattaaaggacaccgttgcctcgttcaaagccgttttggaaggtaaatacgataatataccagaacatgctttctatatggttggtggtattgaagatgttgttcgtaaagctgaaaagttagcccgtgaagccaactag

SEQ ID NO: 667 - DNA, 1293 bp, Trypanosoma cruzi
  strain Y
cggaaggcgtgccgccggtgttaactgctttggatgtggtggaaaaacttggccgtgacgagcccttgacacttgaaattgtacagcacttggacgcccacaccggccgttgcattgcgatgcagacgacagatctgcttaagctgaaatcgaaggtagtctcgagtggcgggaacatttctgtgcctgtgggtcgggagacacttggcagaatcttcaatgtgctgggcgatgccattgaccagcgcggccatgttggagagaagcaacgcatgcctattcacgctgtggcaccaaagttggcggatcaggcggcagaggacaccattctcacaacgggtatcaaggtgattgatctgattttgccctactgcaagggtgggaagattggtctttttggtggtgctggcgtgggcaagacggttattatcatggaacttattaacaacgttgccaagggccatggtgggttctccgtctttgcgggtgttggtgaacgcacgcgtgaggggacggatctttacctggagatgatgcaatccaaagttattgacctgaagggtgactcgaagtgtgtgttggtgtatggtcagatgaacgagcctccgggtgcccgtgctcgtgtggcgcagtctgccttgacaatggccgagtacttccgtgatgtggaagggcaagacgtgttgctttttatcgacaacattttccgctttacgcaggcaaactctgaggtgtcagcgctgttgggtcgtattcccgctgccgtcggctaccagcctacccttgctgaggatcttgggcagttgcaggagcgcattacgtccacgacaaaaggttccattacctctgtgcaggctgtgtacgtgccagccgatgatattaccgaccctgcgccagcaacgaccttttcccacctcgatgccacgacggtgctggaccgtgccgttgccgaatccggcatttaccccgctgtcaacccactggagtgtgcctcgcgtatcatggacccggatgtaatcagcgttgaccactacaacgtggcgcaggatgtggtgcagatgcttaccaagtacaaggagctgcaggatatcattgcggtgcttggcattgatgagctcagtgaggaggataaacttatcgtggaccgtgcgcgtaaggtgacaaagtttctctcccagcctttccaggtggcggaggtgtttactggcatgacaggccactacgtgcagctggaggagaccattgagtctttttccggcctgttgatgggcacatatgatcaggtgccggaga

SEQ ID NO: 668 - DNA, 1191 bp, Corynebacterium glutamicum
gtggcaaaggcgaagttcgagcgtaccaagccccacgtaaacatcggcaccatcggtcacgttgaccacggtaagaccaccaccaccgcggctatcaccaaggttctggctgacacttaccctgagctcaacgaggctttcgccttcgactccatcgataaggctcctgaggagaaggagcgtggcatcacgatcaacatctcccacgttgagtaccagactgaaaagcgccactacgcacacgttgacgctccaggccacgccgactacatcaagaacatgattaccggcgctgctcagatggacggcgcaatcctcgttgttgctgctaccgacggcccaatgcctcagacccgtgagcacgttcttcttgctcgccaggttggcgttccttacatcctcgttgctcttaacaagtgcgacatggttgaggatgaggaaatcatcgagctcgtcgagatggaagttcgtgaacttcttgctgagcaggactacgacgaagaggctccaattgttcacatctccgctctgaaggctcttgagggcgacgagaagtggggcaagcagatccttgagctcatgcaggcttgcgatgacaacatccctgacccagttcgtgagaccgacaagccattcctcatgcctatcgaggacatcttcaccatcaccggtcgtggcaccgttgttaccggtcgtgttgagcgcggtaccctgaacgtgaacgatgatgttgacatcatcggcatcaaggagaagtccacctccaccaccgttaccggtatcgagatgttccgtaagcttcttgactccgctgaggctggcgacaactgtggtctgcttctccgtggtatcaagcgcgaagatgttgagcgtggccaggttatcgttaagccaggcgcttacacccctcacaccgagttcgagggctctgtctacgttctgtccaaggatgaaggtggccgccacaccccattcttcgacaactaccgtcctcagttctacttccgcaccaccgacgttaccggtgttgtgaagcttccagagggcaccgagatggtcatgcctggcgacaacgtcgacatgtccgtcaccctgatccagcctgtcgctatggacgagggcctgcgtttcgctatccgcgaaggctcccgcaccgttggcgctggtcgtgtcaccaagatcatcaagtaa

SEQ ID NO: 669 - DNA, 1383 bp, Escherichia coli
atggctactggaaagattgtccaggtaatcggcgccgtagttgacgtcgaattccctcaggatgccgtaccgcgcgtgtacgatgctcttgaggtgcaaaatggtaatgagcgtctggtgctggaagttcagcagcagctcggcggcggtatcgtacgtaccatcgcaatgggttcctccgacggtctgcgtcgcggtctggatgtaaaagacctcgaacacccgattgaagtcccggtaggtaaagcgactctgggccgtatcatgaacgtactgggtgaaccggtcgacatgaaaggcgagatcggtgaagaagagcgttgggcgattcaccgcgcagcaccttcctacgaagagctgtcaaactctcaggaactgctggaaaccggtatcaaagttatcgacctgatgtgtccgttcgctaagggcggtaaagttggtctgttcggtggtgcgggtgtaggtaaaaccgtaaacatgatggagctcattcgtaacatcgcgatcgagcactccggttactctgtgtttgcgggcgtaggtgaacgtactcgtgagggtaacgacttctaccacgaaatgaccgactccaacgttatcgacaaagtatccctggtgtatggccagatgaacgagccgccgggaaaccgtctgcgcgttgctctgaccggtctgaccatggctgagaaattccgtgacgaaggtcgtgacgttctgctgttcgttgacaacatctatcgttacaccctggccggtacggaagtatccgcactgctgggccgtatgccttcagcggtaggttatcagccgaccctggcggaagagatgggcgttctgcaggaacgtatcacctccaccaaaactggttctatcacctccgtacaggcagtatacgtacctgcggatgacttgactgacccgtctccggcaaccacctttgcgcaccttgacgcaaccgtggtactgagccgtcagatcgcgtctctgggtatctacccggccgttgacccgctggactccaccagccgtcagctggacccgctggtggttggtcaggaacactacgacaccgcgcgtggcgttcagtccatcctgcaacgttatcaggaactgaaagacatcatcgccatcctgggtatggatgaactgtctgaagaagacaaactggtggtagcgcgtgctcgtaagatccagcgcttcctgtcccagccgttcttcgtggcagaagtattcaccggttctccgggtaaatacgtctccctgaaagacaccatccgtggctttaaaggcatcatggaaggcgaatacgatcacctgccggagcaggcgttctacatggtcggttccatcgaagaagctgtggaaaaagccaaaaaactttaa

SEQ ID NO: 670 - DNA, 1410 bp, Helicobacter pylori
  NCTC  11638
atgaaagcgatggaaggtaaaatcattcaggttttaggcccggtggtagatgtggagtttgaatcctatctgccggcgatttttgaagcactagacattaattttgaagttaatggcgttcaaaaatctttagttttagaggtggcagcccatttgggtggtaatcgggtgcgagcgattgctatggatatgacagaaggcttagtgcgtaaccaagccgtcaaagctcgtggcaaaatgattgaagtgcctgtgggcgaagaagtgttagggcgtatttttaatgttgtgggcgagagcattgataatttagagccgcttaagccgtccttaacttggcccattcacagaaaagcccctagttttgagcagcaaagcactaaaacagaaatgtttgaaaccggtattaaagtcattgacttgctcgcgccttattctaagggcggtaaagtaggcttgtttggtggggctggcgtaggcaaaacggtgatcattatggagcttatccacaatgtggcttataagcataacgggtattcggtgtttgcaggtgtgggggagcgcaccagagaagggaacgatctgtattttgagatgaaagaagggggcgttttagacaaagttgcgttgtgctatgggcaaatgaatgagccaccaggtgcaaggaatcgcatcgcattcaccggcttgacgatggcggagtatttccgtgatgaaaagggcttagatgtgttgatgtttattgataacatctttagatacgctcaaagcggtgcggaaatgagcgcgctattaggccgtatcccttcagcggtggggtatcagcccacgctagccggggaaatggggaaacttcaagagcgtatcgcttccactaaaaatggctctatcacttcggttcaagcggtgtatgtgccagcagacgacttgactgacccagcccctgcttcggtgtttgcgcatttagatgcgactacggtgttgaatagaaagatcgctgaaaaagggatttatccggcggtggatcctttggattccacttcaaggattttaagccctcaaatgattggcgagaagcactatgaaatcgccaccggtatccagcaagttttgcaaaaatacaaggatttgcaagatattattgcgattttgggattggacgaattgagcgaagaggataaaaaaacggttgaaagggccagaaaaattgagaagtttttatcccagccgttttttgtggctgaagtgtttacaggaagtcccggtaagtatgtgactctccaagagactttagagggctttggagggattttagagggcaaatacgatcacattcctgaaaacgcgttttacatggtgggcagcattcaagaggttttagaaaaagctaaaaacatgaaaaattcctaa

SEQ ID NO: 671 - DNA, 1401 bp, Clostridium acetobutylicum
  DSM 792
atgccagaacatgtaggtaaaattgttcaggtaataggacctgttgtggatattaaatttgatgcagagaaccttcctgacatctataattccatagaaatagatatgggagataataaaaaactcattgctgaagttgaacaacatgtaggagatgacatagtaagaacaatagcaatggaaggtactgacggattaaaaagaggaatggaagcagttaacactggtaaaccaatatctgtaccagttggagaaaatgttttaggacgtctttttaatgttttaggtcagacaatagatgaagcaggagacatgaatgctgataagtattatccaattcatagaccagctccaacctttgaagaacaatcagttcaaccagaaatgtttgaaacaggtattaaggttatagatttacttgctccatatcaaaagggtggaaaaatcggtttgttcggtggtgccggtgttggtaaaacagttcttattcaggaacttataaataatatagcaaaagaacacggtggattatcagtattcacaggtgttggagaaagaacaagagaaggtaatgacctttattatgaaatgaaagattcaggagttataaataaaacagctctagtatttggtcagatgaatgaaccacctggcgctagaatgagagttgctttaacaggacttacaatggctgaatattttagagacaaaggtcaagatgtgcttctatttatagataatatattcagatttacacaagctggttcagaggtttcagctttacttggtagaatacctagtgccgttggttatcagccaacacttgcaaatgaaatgggtgctcttcaagagagaataacatcaacaaaacagggttcaatcacatccgttcaggctgtatatgttcctgctgatgaccttacagacccagctccagcaacaacatttacgcatcttgatgcaacaacagttctttcaagagaaatatcaaacttaggaatatatcctgcagttagtcctcttgaatcaacttcaagaatacttgatccaagaattgttggagaagagcattatgaagttgctaacaaggttaaacatatacttgaaagatatcaagaacttcaagatatcatagctatacttggtgttgatgaactttcagatgaggatagattgttagttggaagagcaagaagagtacagagattcttatctcaagcttttagtgttgctgaacaatttacaggaatgaaaggtcagtttgtacctgtaaaagatactataagaagttttaaagaaatattagatggtaagtgtgatgatcttccagaagctgcatttttatttgcaggaacaatagaagatgtaaaagaaaaagctaaaaaaatgatggaaagctaa

SEQ ID NO: 672 - DNA, 1509 bp, Cytophaga lytica
  DSM 2039
atgtctaaagttacaggtaaagtttcccaaattattggcccagttatagatgtggagttccaagcaggggtagatcttccaaaaatttatgattcattagaaattaaaaaagcagatggatcaattttggttttggaagtacaatcacacattggtgagaacacagtaagaactatatctatggattcttctgatggtttaagtcgtggagcagaggttaatgcaacaggaagcgctatacaaatgccagttggagatgacgtttacggacgtttatttaacgtaattggagacgctattgatggtcttgggaatttaccaaaatctggtaaagatggtttgccaatacacagagaggcaccaaaatttgaagacttatctacttctacagaagtattatttacaggtattaaagtaattgaccttattgagccttatgcaaaaggtggtaagattggtttatttggaggtgccggagtaggtaaaacagtattaattcaggaattaattaacaacattgcaaaaggtcacggtggactttctgtatttgctggtgtaggtgagcgtactcgtgagggtaacgatttactacgtgagatgttagagtctggtattattaaatacggagatgactttatgcactctatggaagaaggtggttgggatttatctaaagttgataaatctgtaatgaaagattctaaagcaacctttgtatttggacaaatgaatgagccaccaggagcacgtgcacgtgttgcattatctggtttaactattgcagaatatttccgtgatggagcaggtgaaggtcaaggtaaagatgtacttttctttgtggataacattttccgttttacacaagctggttctgaggtatctgcattacttggtcgtatgccatctgcggtaggttaccaaccaacattagcaacagaaatgggtgctatgcaagagcgtattacatcaacaaaaagaggttctattacatctgtacaggcggtttacgtacctgcggatgatttaacggatccagcaccggcaactacctttgctcacttagatgcaacaacggtattgtctcgtaaaattgcagagttaggtatttacccagcggtagatccattagattctacttctagaatcttagctccagaaattttaggaaaagatcactactcttgtgcacaacgtgtaaaagagttgttacaacgttataaagaattacaagatattattgctatccttggtatggaagaattatctgaggaagataaaatggcagttggtagagcaagacgtgtacaacgtttcttatctcagcctttccacgtagcagagcaatttacaggtcttaaaggtgttttagtagatatcaaggatactattaaaggatttaatatgattatggatggtgaattagatcacttaccagaatctgcatttaaccttaaaggtactattgaagaagctatagaagcaggagaaaaaatgcttgctgaagcataa

SEQ ID NO: 673 - DNA, 819 bp, Ehrlichia risticii
  strain HRC-IL
cctaaaatatatgatgcattatatgtaaaactagataatgaaaatttgtgtttagaagtttcacaaattattggagataatgttgttagatgtattgcaatgggagctacttatggattaaatcgtggtttagaagtagtttgttcaggaaatccaattcaggttcctgtaggtgaacaagttttaggtagaatgtttaatgttgttggtaaaacaattgacaatcttgaatctttagatgataaaaatataaaaatgatgccaattcatcgaaatccaccatcatttgaagagcaatccaatgaaattgaaatttttgaaacaggcattaaagttattgatttattaattccatatgctaaaggtggtaagattggattatttggtggagcaggggttgggaaaacggttcttgttcaagaattaattcacaatatcgcaaaaggtcatggtggtctatctgtttttgctggagttggtgaaagaactcgtgaaggtaatgacttgtattatgaaatgattgaaggtggagttatagataaaacagccttagtgtttgggcaaatgaatgaacctcctggcgcaagaatgcgcgtagcattaactgctttaacaatggctgaatatttccgtgatgttcaaaaccaagatgttttgttatttattgataatatctttagatttacacaagctggtagtgaagtttcagcattattaggaagaatgccatctgctgttggttatcaaccaactttggcatatgaaatgggattgttacaagaaagaatcacttccactaaaagtggttctataacatct

SEQ ID NO: 674 - DNA, 840 bp, Vibrio cholerae
  ref <308>: DATABASE ACCESSION NUMBER: ATCC 25870
agagcgaagtaccaagtgtttacgatgctctgaatgttgtggattccaaagaacgtctggttctggaagttcaacagcagctaggcggtggcgtgattcgcgctatcgttatgggtagctcggatggtttacgtcgtggaatgacagtacaaaacactggcgctccaatttcagtaccagtaggtactaaaaccctaggtcgtatcatgaacgtgcttggtgatgcgattgacgaacgtggcgacattggcgcagaagaggtgtactcgattcaccgtcctgctccaagctacgaagaacagtctagtgcaactgaacttttggaaacgggtgttaaggttatcgacctgatctgtccgtttgcgaaaggcggtaaaatcggtctgttcggtggtgcgggtgtaggtaagaccgttaacatgatggaacttatcaacaacatcgcgctacagcactcaggtttgtcagtatttgctggggtaggtgagcgtactcgtgagggtaacgacttctaccacgaaatgcaggaagcgggcgttgtaaacgttgaacaaccagaactgtcgaaagtagcgatggtttacggtcagatgaacgagccaccaggcaaccgtctgcgtgtagcactgactggtctgactatggcggaaaagttccgtgatgaaggccgtgacgtactgctgtttatcgacaacatctaccgttacaccctagcgggaacggaagtatctgctctgcttggccgtatgccttcagcggtaggttaccaaccaacactggctgaagagatgggtgttctgcaagaacgtatcacgtcaaccaaaaaaggttctatcacct

SEQ ID NO: 675 - DNA, 828 bp, Vibrio cholerae
  ref <308>: DATABASE ACCESSION NUMBER: ATCC 25870
cggcggtatcctagttgtagcggcaactgacggtccaatgccacaaactcgtgagcacatcctgctgggtcgccaagtaggtattccttacatcatcgtattcatgaacaagtgtgacatggttgacgatgaagagcttctagagctggtagagatggaagttcgtgagctgctgtctgagtacgatttcccaggtgatgacctgccagtaatccaaggttcagcactaggcgcgctaaacggcgaagcacagtgggaagcgaagattgttgagctagcagaagcactggatacttayattccagagccagagcgtgcagtagacatggcattcctgatgccaatcgaagacgtattctcaatccaaggtcgtggtacagtagtaactggccgtatcgagcgcggcatcctgaaagtgggtgacgaagtagcgatcgttggtatcaaagagacagtaaaaacgacctgtacaggtgtagagatgttccgtaagctgcttgacgaaggtcgtgcaggtgagaacgtaggtgcactrctacgtggtactaagcgtgaagaagtagagcgtggtcaagtactggcgaagccaggttcaatcacaccacacactaagttcgaatcagaagtatacgtactgtcaaaagatgaaggtggccgtcatactccattcttcaaaggttaccgtccacagttctacttccgtacaactgacgtaacaggcagcattgagctaccagarggcgtagaaatggtaatgccaggcgacaacgtgaagatggttgtagacctgattgcaccaatcgcgatggacgaaggtctacgcttcgc

SEQ ID NO: 676 - DNA, 1298 bp, Leishmania enriettii
  ref <308>: DATABASE ACCESSION NUMBER: ATCC 50120
cttctcggatggcgtgccgccggtgctgacggcgctggacgtgacggaggaactcgggcgcgacgagccgctgacgctagagatcgtgcaacacttggacgcgcacaccggccgctgcattgcgatgcagacgacggacctactgaagctgaagtcgaaggtcgtgtcgaccggcgggaacatctctgtgcctgtgggccgcgagacgcttggccgcatcttcaacgtactgggcgacgcgattgaccagcgcggccccgtgggcgagaagatgcgcatggcgatccacgcggaggcgccgaagctggcggaccaggcggcggaggacacgatcctgacgaccggcatcaaagtgatcgatctgatcctgccgtactgcaagggcggcaagatcggtctgttcggcggtgccggtgtggggaagactgtgatcatcatggagctgatcaacaacgtcgcgaagggccacggtggcttctccgtgttcgccggcgttggggagcgcacccgcgaggggacggatctgtacctggagatgatgcaatcgaaggtgatcgacctgaaaggtgagtcgaagtgtgtgcttgtgtacgggcagatgaacgagcccccgggtgcgcgcgcgcgcgttgcgcagtctgcgctgacgatggccgagtacttccgcgacgtggagggccagaacgtgctgctgttcatcgacaacatcttccgcttcacgcaggcgaactccgaggtgtcagcgctgctgggccgcatccccgccgctgtgggctaccaaccgacgcttgcggaggatctcggcatgttgcaggagcgcatcacgtcgacgacgaaggggtcgatcacgtctgtgcaggcggtgtacgtgcctgcggatgatatcacggatcccgcgccggcgacgacattctcgcacctggacgcgacgacggtgctggaccgcgcggtggcggagtctggcatctaccccgcggtcaacccactggagtgcgcgtcgcgtatcatggaccctgatgtgatcgacgtggatcactacaacgttgcgcaggacattgttcagatgctgaccaagtacaaggagctgcaggatatcattgcggtgcttggtatcgacgagctgagcgaggaggacaaggttgtggtggaccgtgcgcgcaaggtgacccggttcctgtcacagccgttccaggttgcggaggtgtttactggcatgacaggccattacgtacagctgagcgacacggtggagtcgttctccggtttgctgatggggtcgtacgaccagattccggaga

SEQ ID NO: 677 - DNA, 1083 bp, Babesia microtti
  strain Persing-1
caagctcaagtctgagcgtgagagaggtattactattgacattactctctggaaatttgagacccagaaatacgagtacactgtcatagacgcacctggtcatcgtgactttatcaaaaatatgattactgggacttcacaagccgacgttgctatgcttgtcgttcctgctgaatctggcggattcgaggctgctttttccaaagaaggtcagacccgtgaacacgccttactagccttcacacttggcgtcaaacagatgattgttgctattaacaaaatggattcttgtcagtacaaggaggatcgttatatggaaattttcaaggaagtacagcagtacttgaagaaggtgggttacaaagttgaaagcgtgccgtttgttgctatttcaggattccacggtgacaacatggttgaaaaatctactaacatgccttggtataagggtaagaccctcgtagaggcacttgatcaaatggagcctccaaaacgtccggtcgaaaaacctcttagattgcccctgcagtcagtctataaaattggaggtattggtacggtaccagtcggaagggtcgaaacaggacaactgaaagcaggaatgatcattacttttgcccccactggtttgaccactgaatgtaaatctgttgaaatgcatcacgaggttgtggaagtggctagccccggtgataacgttggatttaatgtcaagaatgtgtctgttaaggatattaagagaggaaatgtggcttcggattcgaaaaatgacccagccaaggaagctacctctttctctgcacaagtcattgtactcaatcaccctggtaccatcaaggccggttactcacctgtggttgattgccatactgcccacattgcttgcaaattcgaatctctagacactaggattgacaagcgtactggcaagactttggaagaaaatcctaagactattaagaatggtgacgctgccatggtgactatgaaaccaaataaacccatggttgtggaaactttcaccgactacgccccgttgggccggttcgccgtgcgtgatatgcgccaaaccgttgccgtcgg

SEQ ID NO: 678 - DNA, 551 bp, Cryptococcus neoformans
  strain Lev-12
tgtgctcattcaggagctcattaacaacattgccaaggctcacggtggttactctgtcttcactggtgtcggtgagcgaactcgtgagggtaacgacttgtaccacgaaatgagggagactggtgttatcaaccttgagggtgactccaaggtcgctcttggtgagttcttttttttcttcaggctaattagtcgatgacgtgggccctgactaaaactgtttcttccagtcttcggtcagatgaacgagccccctggagcccgtgcccgagttgcccttactggtttgaccattgccgagtacttccgtgacgaggaaggccaggatgtgttgcttttcattgacaacattttccgattcacccaggccggttccgaggtgtctgccttgctcggtcgtatcccctctgccgtcggttaccagcccactctttccaccgacatgggtggtatgcaggagcgaatgtaggttgcattctctgtgattttacggcaagccttgactttttttttctagtaccaccaccaagaagggttccattacctccgtc

SEQ ID NO: 679 - DNA, 552 bp, Cryptococcus neoformans
  ref <308>: DATABASE ACCESSION NUMBER: ATCC 44104
tgtgctcattcaggagctcattaacaacattgccaaggcccacggtggttactccgtcttcaccggtgtcggtgagcgaactcgtgagggtaacgacttgtaccacgaaatgagggagactggtgttatcaaccttgagggtgactccaaggtcgctcttggtgagttcttttttttgggagctaattagtcgatgacgtgggccctgaccaaaaccgtttctttcagtcttcggtcagatgaacgagccccctggagcccgtgcccgagttgctcttactggtttgaccattgccgagtacttccgtgacgaggaaggccaggatgtgttgcttttcattgacaacattttccgattcacccaggccggttccgaggtgtctgccttgctcggtcgtatcccctctgccgtcggttaccagcccactctttccaccgatatgggtggtatgcaagagcgaatgtaagttgcattttttgtgattttacggcaagtcttgacttacatttttttctagcaccaccaccaagaagggttccattacctccgtc

SEQ ID NO: 680 - DNA, 1018 bp, Cunninghamella bertholletiae
  ref <308>: DATABASE ACCESSION NUMBER: ATCC 42115
tctccctgctattttaaacgctcttgaagttaaggatcatgctggtggtcgtcttgttcttgaagttgctcaacacttgggtgaaaacactgtacgtactattgctatggatggtactgaaggtaagtttatttttagatgatcataaataattgatcataatgataaaaaaaaaagaagaagaagaacaggatgtatataatggttaataaataatattttcatattgkatataactatttaatctgtttttttttcttcatgattatatatatatatgtmctaatatctaatatgaaccttttttataaaattaatcaggtcttgtccgtggtcaaaaggttgttgatactggtgctcctattaccattcctgttggtaaggaagttcttggtcgtatcatcaacgttattggtgaacccattgatgaacgtggtcctattaaggccaagtctcaccgtgctattcacgctgaagctccagaattcgttgatcaatctcctactcccgaaattcttgaaactggtattaaggttgtcgatttattagctccttatgctcgtggtggtaagattggtcttttcggtggtgctggtgtaggtaaaactgtcttgattcaagaacttattaacaacattgctaaagcccatggtggttactctattttctgtggtgttggtgaacgtactcgtgaaggtaacgatttataccacgaaatgatggaaactggtgtcattaaacttgaaggtgactccaagtgtgctcttgtattcggtcaaatgaacgaacctcctggtgctcgtgcccgtgttgctttaactggtttaaccattgctgaatacttccgtgatgaagaaggtcaagatgtgttacttttcattgataacattttccgtttcactcaagctggttctgaagtatctgcccttttaggtcgtattccatctgctgtaggttaccaacccactttatctactgatatgggtggtatgcaagaacgtattactactaccaagaa

SEQ ID NO: 681 - DNA, 23 bp, Artificial Sequence
  Synthetic DNA Sequence
  modified_base (3): i
  modified_base (6): i
  modified_base (12)..(13): i
  modified_base (15): i
  modified_base (18): i
ggnssnttyggnnsnggnaarac

SEQ ID NO: 682 - DNA, 26 bp, Artificial Sequence
  Synthetic DNA Sequence
  modified_base (3): i
  modified_base (6): i
  modified_base (21): i
  modified_base (24): i
gtnacnggytcytcraarttnccncc

SEQ ID NO: 683 - DNA, 26 bp, Artificial Sequence
  Synthetic DNA Sequence
  modified_base (3): i
  modified_base (6): i
  modified_base (9): i
  modified_base (12): i
  modified_base (15): i
  modified_base (21): i
  modified_base (24): i
gtnacnggntcnswnawrtcnccncc

SEQ ID NO: 684 - DNA, 3267 bp, Candida tropicalis
atggctggtgctttagaaaacgcaagaaaagaaattaaacgtctttcattagatgacaccaatgaatcccaatatggtcaaatctattctgtttccggtccggttgttattgccgaaaacatgattggatgtgccatgtacgaattggttaaagttggtcatgataatttagttggggaagttattagaattaatggtgataaagcaaccattcaagtttatgaagaaactgcaggggtcactgttggtgatccagttttaagaactggtaaaccattatctgttgaattaggtcctggtttaatggaaactatttatgatggtattcaaagacctttaaaagccattaaagatgaatcccaatctatttatatcccaagaggtattgatgttcctgctttatcaagaactgttcaatatgatttcactccaggtcaattgaaagttggtgatcatatcactggtggggacatttttggttctatttatgaaaactctttattggatgaccataagattttgttacctccaagagcaagaggtactattacttctattgctgaagccggttcttataatgttgaagaaccagttttggaagttgaatttgatggtaagaaacataaatactctatgatgcatacatggccagttagagttccaagaccagttgctgaaaaattgactgctgatcatccattgttgaccggtcaaagagtcttggattctttattcccatgtgttcaaggtggtactacttgtatcccaggggcttttggttgtggtaaaactgttatttctcaatctttgtccaaattctccaactctgatgttattatctatgttggttgtttcactaaaggtactcaagtcatgatggctgatggtgccgacaaatctattgaatctattgaagttggtgacaaagtcatgggtaaagatggtatgccaagagaagttgttggcttaccaagaggttatgatgatatgtacaaggttcgtcaactttctagtactagacgtaatgctaaatccgaaggcttgatggatttcactgtttctgctgatcataaacttatcttgaaaactaaacaagatgtcaagattgctacacgtaaaattggtggcaacacctatactggtgttactttctatgttttggaaaagactaagactggtattgaattagttaaagccaagactaaagttttcggtcatcatatccatggtcaaaatggcgctgaagaaaaagctgctacttttgctgctggcattgactctaaagaatacattgattggatcattgaagctagagattatgtacaagttgatgaaattgtcaagaccagcaccactcaaatgatcaacccagttcattttgaatctggtaaactcggtaactggttacacgaacacaagcaaaacaaatcacttgctccacaattgggttacttgttgggtacttgggctggtattggaaatgttaaatcttctgctttcaccatgaactccaaagatgatgttaaattagctacaagaattatgaactactcttcaaaattgggcatgacttgttcttctactgaatccggtgaactcaatgtcgctgaaaacgaagaagaatttttcaataaccttggtgctgaaaaggatgaagctggtgatttcacttttgatgaatttaccgatgctatggatgaattgactatcaatgttcatggtgcagctgcaagcaagaagaacaatttgttgtggaatgctttgaaatctcttggtttcagagccaagtctactgatattgtcaagagtattcctcaacatattgctgttgatgatattgttgtcagagaatctttgattgccggtttagttgatgctgctggtaatgttgaaaccaaatccaatggttctattgaagctgttgttagaacttctttcagacatgtcgctagaggtcttgtcaagattgctcattctttgggtattgaatcatctattaatattaaagatactcacattgatgctgctggtgttagacaagaatttgcttgtattgtcaatttgactggtgctccacttgctggtgttctttctaaatgtgcacttgcaagaaaccaaactccagttgtcaaatttaccagagacccagttttgttcaactttgatttgatcaaatctgcaaaagaaaactattatggtattactttggctgaagaaactgatcatcaattccttttatccaacatggccttggtgcacaactgtggtgaacgtggtaatgagatggctgaagttttgatggaattcccagaattgtttactgaaatttctggtagaaaagaaccaattatgaaacgtaccactttggttgccaatacttctaatatgccagtcgctgccagagaagcttctatttatactggtattacattggctgaatatttcagagatcaaggtaagaatgtttctatgattgctgattcttcttcacgttgggctgaagctttgagagaaatttctggtagattgggtgaaatgcctgctgatcaaggtttcccagcttatttgggtgctaaattggcttctttctatgagcgtgccggtaaagccactgctttgggttcaccagatagagttggttcagtttctattgttgctgctgtttctccagctggtggtgatttctctgatccagttactacttctactttgggtattactcaagttttctgggggttggataagaaattggcccaaagaaaacatttcccatctattaacaccagtgtttcttattctaaatacaccaatgttttgaacaaatactatgattccaactatccagaattcccacaattgagagacaaaattagagaaattttatctaatgctgaagaattggaacaagttgttcaattagttggtaaatctgcattgtctgattctgataagattactttagatgttgctaccttgattaaagaagatttcttgcaacaaaatggttattcttcatatgatgcattctgtccaatttggaagacttttgatatgatgagagcatttatttcatattatgatgaagcacaaaaagcaattgccaatggtgctcaatggtctaaattagctgaaagtactagtgatgttaaacatgctgtttcttcagctaaattctttgaaccatcaagaggtcaaaaagaaggtgaaaaagaatttggagatttattaaccactatctccgaaagatttgctgaagcttcagaataa

SEQ ID NO: 685 - DNA, 1782 bp, Enterococcus hirae
  ref <308>: DATABASE ACCESSION NUMBER: ATCC 9790
ttgcaaattggaaaaatcataaaagtctccggtcctctcgttatggcagaaaatatgtcagaagcaagtattcaagacatgtgtttagtgggagatttaggagtcatcggcgaaatcattgagatgcgtcaagatgtggcgtctattcaagtatatgaagaaacttcaggaattggtcccggagaacctgttcgttccactggggaagcactatctgttgagctaggaccaggaatcatttcacaaatgtttgacgggattcaaagaccactggatacatttatggaagtgactcaaagtaacttcttaggacgtggggtccaattaccagctttagatcatgagaaacaatggtggtttgaagcgacaatcgaagaaggaacagaagtaagtgctggagacatcattgggtacgtggatgaaacgaagatcattcagcacaaaatcatggtccctaatggtatcaaaggaactgtacaaaaaattgaatctggatcatttacgatcgatgatccgatttgtgtgatcgaaacggaacaaggcttaaaagagctgacgatgatgcaaaaatggccagtacgtcgtggtcgaccaatcaaacaaaaattaaatccagatgtaccgatgatcaccggtcaaagggtcattgacacgtttttcccagtaactaaaggaggagcggcagccgttccaggtccgtttggtgcagggaagacagttgtgcaacaccagattgctaagtggtcggacgtagatctagtggtttacgttggttgtggggaacgaggaaatgaaatgacggatgtcgtcaatgaatttcctgaactgatcgatccaaatacaggcgagtctttgatggaacgaactgtgttgatcgctaatacatcgaacatgccagtagctgctcgagaagcttctatttatacgggaatcacgattgccgagtacttccgtgacatggggtatgatgtagcaatcatggcagattccacttctcgttgggcagaagcactgcgtgaaatgagcggacgtttagaagaaatgcctggtgatgaaggttatcccgcttatctgggctctcgtctagctgaatactatgaacgttcaggacgtgtcattgctctaggctctgaccaacgtgagggcagtatcactgccatcagtgcggtttctccttctggtggagatatctctgaaccagtgactcaaaataccttacgtgtggtgaaggttttctggggattagattctagtcttgctcaaaaaagacattttccatcgattaactggatccaaagttactcattatattcaacagaagttggcagatatatggatcaaatcttacaacaggattggtctgatatggtaactgaaggcatgcggatcttgcaagaagaagaacaattaaatgaaatcgtgcgcttggtagggatcgattcgctttctgataacgatcgcttgacccttgaagtagcaaaatcgattcgagaagactatttacaacaaaatgcttttgatgatgtagatacgtttacttcaagagaaaaacaattcaacatgttgaaagttattttgacttttgggaaagaagctcgaaaagccttatcgttgggagcgtacttcaatgaaatcatggaaggtacagtagcggtcagagaacgcattagtcggagcaagtatattccagaagaagagttagccaaaattagtagtataaatgaagaaatcaaagaaacgatccaattgattgtttcagaaggagggatgaccgatgattaa

SEQ ID NO: 686 - DNA, 1781 bp, Chlamydia pneumoniae
  strain CWL 029
cagggacatgttatagaagcttatggaaacttgttacgtgtacgctttgacggatatgttagacaaggtgaagttgcatatgtcaacgtagataatacctggttaaaagcagaagtgattgaagttgctgatcaagaagtcaaggttcaggtatttgaagatacacaaggcgcgtgtcgaggagctcttgttacgttttcaggacatcttttagaagccgagttagggcctggcttgcttcagggcattttcgatggacttcaaaatcgtcttgaggtgctagctgaagatagttctttcttgcagagaggcaagcatgttaatgctatttctgatcataatttatggaattatactcccgtagcttctgttggggatactttaagacgaggagatcttctaggaacagtacctgaaggacgatttactcataagattatggttcctttttcttgctttcaagaggttaccctgacttgggtaatttctgaaggaacctataatgctcatactgtggtcgcaaaagctcgagatgctcagggtaaagaatgtgcctttactatggtgcaaagatggccgatcaaacaagcttttattgaaggagagaagatccctgcgcataagattatggatgtgggtttgcgaatcttagatacgcaaattccagtattgaaggggggaactttctgtaccccaggaccttttggtgcagggaaaacagtcttacaacaccatctttctaagtacgctgctgtagatattgtgattttgtgtgcgtgcggagagcgtgctggtgaagttgttgaggtattacaagagttccctcatcttatcgacccccataccggaaagtctttaatgcacagaacatgtattatttgtaacacatcatccatgcctgtggctgcccgagagtcttcgatctatttaggagtgacgattgcagaatactatcgccagatgggactagatattctgcttttagctgattctacatcccgatgggcacaagcccttagagagatttcgggacgtcttgaagaaatccctggagaggaagcatttcctgcatacctgtcttctagaatagctgctttttatgagcgaggaggagctatcaccacgaaagatggttctgaaggatctttaactatatgtggtgcggtgtctcctgcaggaggaaactttgaagaaccagtcactcaatctacattagctgtagtcggagcgttctgtggtctttcaaaagcacgagctgacgcacgtaggtatccttcaatagaccctttgatttcttggtcaaaatatttgaaccaggtaggacaaattttagaagagaaggtttcaggctggggtggtgctgtgaaaaaagcagcacagtttctagagaaaggttcagaaatcggcaagcgtatggaagttgtcagtgaagaaggggtttctatggaagacatggaaatctacttaaaggcagaactttatgatttttgtkatctccagcagaacgcattcgatcctgtggactgttattgtccttttgagagacagatagagttattttcattaatcagtcgtatttttgatgctaaatttgtttttgatagtcctgatgatgcaagaagctttttccttgagctgcagagcaagattaagacattaaatggcctgaaatttctttcagaggaatatcatgagagtaaagaggtcatagttagactgttggaaaaaacaatggtacaaatggcgtaaggatatgcaaacaatctacacaaaaataactg

SEQ ID NO: 687 - DNA, 1758 bp, Halobacterium salinarum
atgagtcaagctgaagcaatcactgacaccggcgaaatcgagagcgtgagcggtccggtcgtgaccgccacgggcctcgacgcgcagatgaacgacgtcgtctacgtgggcgacgagggtctgatgggcgaggtcatcgagatcgaaggcgacgtaaccaccatccaggtctacgaggagacgtccggcatcgggccgggccagcccgtcgacaacacgggcgaaccgctcaccgtggacctgggcccggggatgctggactccatctacgatggtgtgcagcgtccactggacgtcctcgaagacgagatgggggcgttcctcgatcgcggtgttgacgcacccggcatcgacctcgacaccgactgggagttcgagcccaccgtcgaggcgggcgacgaggtcgcggccggcgatgtcgtcggcaccgtcgacgaaacggtcagcatcgaacacaaggttctggtgcccccccgcagtgacggcggcgaagtcgtcgccgtcgaatccggcacgttcaccgtcgacgacacggtcgtcgagttggacaccggcgaggagatccagatgcaccaggagtggccggtccgccgccagcgccccaccgtcgacaagcagacgccgacggagccgctggtgtccggccagcgcatcctcgacggcctgttcccgatcgcgaaaggcgggacggccgcgatcccggggccgttcgggtccgggaagacggtcacccagcagtccctcgcgaagttcgccgacgcggacatcgttgtctacatcggctgtggtgagcgcggcaacgagatgacggaagtcatcgaggacttcccggagctgcccgacccccagaccgggaacccgctgatggcccgcaccacgctcatcgcgaacacgtcgaacatgccggttgccgggcgtgagtcctgcatttacacgggaatcaccatcgcggagtactaccgcgacatgggctacgacgtggcgctgatggccgactccacctcgcggtgggcggaggccatgcgggagatctcctcgcgactcgaggagatgcccggcgaggaggggtatcccgcgtacctggccgcccgcctctcggagttctacgagcgcgccggctacttcgagaacttcaacgggaccgagggctccatctcggtcatcggtgcggtgtcgccgcccggcggggacttctccgagccggtcacccagaacacgctgcgcatcgtgaagacgttctgggcgcttgactcggacctcgccgagcgccggcacttcccggcgatcaactgggacgagtcctacagcctctacaaggaccaactcgacccgtggttcacggacaacgtcgtcgacgactgggccgagcagcgccagtcggcggtcgacatcctcgacgaggaatccgaactcgaagagatcgtgcagctcgtcgggaaggacgcgctgcccgaggaccagcagctcacgctggaagtcgcgcggtacatccgcgaggcgtggctccagcagaacgcgctccacgacgtggatcgctactgcccgcccgagaagacgtacgccatcctctccggcatcaagacgcttcacgaggagtcctttgaggcgttggacgccggtgtgccagtcgaggagatcacgtcgatcgacgccgcgccgcgcctgaatcgtctcggcacgacgcccgacgacgagcacgaggcggaggtcgcggagatcaaacagcagattaccgagcagcttcgggagctctactga

SEQ ID NO: 688 - DNA, 3118 bp, Homo sapiens
gaattccggcagctgactagtcttgtgattggggtcctgggctgataaaatcattccaaatgacgagcacattgataaagacgtccgatgaggaccgggagtccaaattcggctttgtttttgccgtatctggacctgtggtgacagctgaacgaatggccggttctgctatgtacgaactggtgcgtgtcggttattatgaactggtcggagagatcatccggttggagggtgacatggcaacaatccaagtatacgaagacacctcaggtgtgacagtaggcgatcccgtgctgcgcacaggcaagccgctgtccgtggaactgggacccggaatcatgggcagcatcttcgacggtatccagcgaccgctgaaggatatcaatgaactgtcaaatagtatctacatcccgaaaggtgtcaatgtgcctgccctgagtcgcactgcacagtgggacttcagtcccgtcagtgtcaaggttggaagccacattactggtggtgacctgtacggtttggtccacgaaaatactctggtgaaacacaagttgctgctgccgccccgtgccaagggaactgtcacgtacattgcagaacctggaaactacacagttgatgatgttgtcctggagacagaatttgacggcgagcgatcaaagttcaccatgctgcaagtgtggcctgtacgtcagcccaggcctgttacagaaaagttgccagctaactaccccctccttactggccagcgtgtgctcgactccctattcccgtgtgtccagggtggaacaacagctattcctggggccttcggatgtggcaagactgtaatatcacagtctttgtcaaaatactcaaactccgatgtaattatctatgtaggttgtggtgagcgaggtaatgaaatgtcagaagtactcagggatttcccgcagttgtcgttggagattgatggtgtgactgaatcaatcatgaagagaacagccctggtcgcaaacacatcaaacatgcctgtggctgctcgagaagcatctatctacacaggtattacactgtcagaatacttcagggacatgggttacaatgtatccatgatggctgactcaacttcacgatgggccgaagctcttcgagaaatctcaggtcgattggctgaaatgcctgccgacagcggttatcccgcctacctaggtgcacgacttgccagtttctacgagcgtgccggccgtgtgaagtgcttgggtaacccagacagggagggctccgtgagtatagtgggcgccgtgtcgccgcccggtggagacttctcagatcccgtgacgacggccacactaggtatcgtccaggtgttctggggtctcgacaagaaacttgcccagcgaaagcacttcccatccatcaactggctcatctcgtacagtaaatacatgcgtgctctggatgacttctacgacaagaatttcccagagtttgtcccactgcgtacaaaggtgaaggagattttgcaggaggaagaagacctgtctgaaattgtgcagttggtcggtaaagcttcattggcagaaactgacaagatcacacttgaggttgccaaactattaaaggatgatttcctgcaacagaacagctattcaccatatgaccgtttctgcccattctacaagacagtaggaatgctgaaaaatatgattgctttctacgatatgtctcggcatgcagttgaatctactgctcagagcgagaacaagatcacttggaatgttattagagattctatgggcaatattctgtatcagctttcctccatgaaattcaaggatccagtcaaggatggagaagcgaagatcaaggcagactttgagcagcttcatgaagacattcagcaagccttcaggaacctggaggattaaagtggtagctgccagtggttctctcggtgcagttgtcacatttggcaagctctgtagggttgccgagtggcatcggtgctagacacctgagcattcctttgccacataaagactaaagcaggtggaatttcagttgtaaaaagctggttccattggtgctaagattatgttgtgcccttttctgcttctcacattccaacagaggaatttacttccagttttcttccattttcctcctcattttaagtgtcggtacagaggcaataatctgataactctgtaccgtcacttacaagcagggagaatttgtaattattacaaatcccattatctctgtgcaccacagccttgtaaattcatttgtcccaggactccctcttgtgtgtacgtgagattgccgtctgtatgtatgtacacaccgtactgcagtatttgaagtcagtcagaaggtgaattacaccacttactcattgtgtcacgtagcaagtgtgcaaactgccatccattgtcctatttattcacataactagttttctttgcatttccagtgttgcaaattgtgtttagaaaattatgccatcgagactggtcgaacctcacattgtaactcagtatttacacacacgtttacttgctacagaaatgtagaaaaaataattgttgtatattgaaagtacaagtgacaaagttgcatttaaaatggtgaatgtattttatatttcttttgtagacacaagagttaatgcattttgcttaatggagatgtatgtaaacctaaaatagcagtttgtgcacaaattatgtatatgtgaaatggagatggtttctaatttgctgattgattgccagtattaatttaaacaactgtagttgtgggatgtagtgggaagattttttttttcctataaaattggtggatgtatgtgtcggagattttgattgtatgtgtaaaatagtgatcccagtaactgtaaagctttagaatacagttactgactgtatagttgtacaggtgttgttacttttaagaatttattgacacaaaggtgaaagtctattattgtattgtaatgtttaaagcatttaaggtttaaaaatcctacttctgtgtataaatgttaccattcctcatataacataactgtgtagaaatacagtcaacttcatgttcattagcatttcactgttgtcacataaattatgcccggaat

SEQ ID NO: 689 - DNA, 1836 bp, Plasmodium falciparum
  strain 3D7
atgacaaaagttgctgttgaaaaagaggaaccaggagttgtttataaggtggctggttcattagttattgctgagaatatgagtggaactcgtatgtacgagttagctaaagtaggatggaataaattggttggagaaattattagattagaagggaattatgcatatatacaagtttatgaagatacttcaggtttatctgtaggagaccctgttataaaaacaggaaatgctttatcagtcgaattgggtcctggtattttagataatatttatgatggtattcaaagaccattagaaagaatagcaaatgtgtgtggtgatgtatatatatataaaggtattgatatgacatctttagatcatgataaacaatggcaattttatgctgataagaaattaaaattaaatgatattgttactggtggagatatctttggatttgttgatgaaaataaattatttaaagaacacaaaattatggctccacctaatgctaaagggaggcttacatatattgctccagatggatcatatactttaaaagataaaatatttgaattagaatatcaaggaaaaaaatatacatatggtttatctcatttatggcctgttcgtgatcctagacctgttttagaaaaggtaacaggggatactttattattaacagggcaaagagttttagattcgttatttccaacagttcaaggaggtacttgtgctattcctggtgcatttggttgtggaaaaacttgtgtttctcaggccttatcaaaatattctaatagtgaagttattatatatgtaggatgtggtgaaagaggtaatgaaatggctgaaattttatccgactttcctgaattaactactaaagtagataatgaagatgtaggtattatgcaaagaacgtgtttagttgctaatacttctaacatgcctgtcgctgcaagagaagctagtatttatacaggtattactttatgtgaatatttccgtgatatgggttataatgctaccatgatggctgatagtacaagtagatgggcagaagccttaagagaaatttcaggacgtttagctgaaatgcctgcagatagtggttatccagcttatttaggtgctagattagcttccttttatgaacgtgcaggaaaagtcaaatgtattggttctccatctcgtataggatccattacaattgtgggtgctgtgtctccaccaggtggtgatttctctgaccctgtaactacagcaaccatgtctattgttcaagcattttgggggttagataaaaaactagctcaaagaaaacatttcccttctgttaattggtctacatccttttcaaagtatgtcagacaattagaacaatactttgataattttgatcaagatttcttatctttaagacaaaaaattagtgatattttacaacaagaaagtgacttgaatgatattgttcaactagtaggaaaggattcattatcagaagaccaaaaagttgttatggaagtagccaaaattattagagaagattttcttcaacaaaatgcatttagcgattatgattatatgtgcccattacaaaaaacagttggtatgatgagaattatttgccacttttatgctcaatgcttaagaacattacaagaatatgactcaagagaaagaaaaattggttggggatctatatataatacattaagaccaactataaataaaattacacatatgaaatttgaaaacccaaaaaattcagatgaatatttcaaaaagtattttaaggcacttgaagaagaaataacagtaggtttaagaaacttgatggaaaaatga

SEQ ID NO: 690 - DNA, 3216 bp, Saccharomyces cerevisiae
  strain X2180-1A
atggctggtgcaattgaaaacgctcgtaaggaaataaaaagaatctcattagaagaccatgctgaatctgaatatggtgccatctattctgtctctggtccggtcgtcattgctgaaaatatgattggttgtgccatgtacgaattggtcaaggtcggtcacgataacctggtgggtgaagtcattagaattgacggtgacaaggccaccatccaagtttacgaagaaactgcaggccttacggtcggtgaccctgttttgagaacaggtaagcctctgtcggtagaattgggtcctggtctgatggaaaccatttacgatggtattcaaagacctttgaaagccattaaggaagaatcgcaatcgatttatatcccaagaggtattgacactccagctttggataggactatcaagtggcaatttactccgggaaagtttcaagtcggcgatcatatttccggtggtgatatttacggttccgtttttgagaattcgctaatttcaagccataagattcttttgccaccaagatcaagaggtacaatcacttggattgctccagctggtgagtacactttggatgagaagattttggaagttgaatttgatggcaagaagtctgatttcactctttaccatacttggcctgttcgtgttccaagaccagttactgaaaagttatctgctgactatcctttgttaacaggtcaaagagttttggatgctttgtttccttgtgttcaaggtggtacgacatgtattccaggtgcttttggttgtggtaagaccgttatctctcaatctttgtccaagtactccaattctgacgccattatctatgtcgggtgctttgccaagggtaccaatgttttaatggcggatgggtctattgaatgtattgaaaacattgaggttggtaataaggtcatgggtaaagatggcagacctcgtgaggtaattaaattgcccagaggaagagaaactatgtacagcgtcgtgcagaaaagtcagcacagagcccacaaaagtgactcaagtcgtgaagtgccagaattactcaagtttacgtgtaatgcgacccatgagttggttgttagaacacctcgtagtgtccgccgtttgtctcgtaccattaagggtgtcgaatattttgaagttattacttttgagatgggccaaaagaaagcccccgacggtagaattgttgagcttgtcaaggaagtttcaaagagctacccaatatctgaggggcctgagagagccaacgaattagtagaatcctatagaaaggcttcaaataaagcttattttgagtggactattgaggccagagatctttctctgttgggttcccatgttcgtaaagctacctaccagacttacgctccaattctttatgagaatgaccactttttcgactacatgcaaaaaagtaagtttcatctcaccattgaaggtccaaaagtacttgcttatttacttggtttatggattggtgatggattgtctgacagggcaactttttcggttgattccagagatacttctttgatggaacgtgttactgaatatgctgaaaagttgaatttgtgcgccgagtataaggacagaaaagaaccacaagttgccaaaactgttaatttgtactctaaagttgtcagaggtaatggtattcgcaataatcttaatactgagaatccattatgggacgctattgttggcttaggattcttgaaggacggtgtcaaaaatattccttctttcttgtctacggacaatatcggtactcgtgaaacatttcttgctggtctaattgattctgatggctatgttactgatgagcatggtattaaagcaacaataaagacaattcatacttctgtcagagatggtttggtttcccttgctcgttctttaggcttagtagtctcggttaacgcagaacctgctaaggttgacatgaatggcaccaaacataaaattagttatgctatttatatgtctggtggagatgttttgcttaacgttctttcgaagtgtgccggctctaaaaaattcaggcctgctcccgccgctgcttttgcacgtgagtgccgcggattttatttcgagttacaagaattgaaggaagacgattattatgggattactttatctgatgattctgatcatcagtttttgcttgccaaccaggttgtcgtccataattgcggagaaagaggtaatgaaatggcagaagtcttgatggaattcccagagttatatactgaaatgagcggtactaaagaaccaattatgaagcgtactactttggtcgctaatacatctaacatgccggttgcagccagagaagcttctatttacactggtatcactcttgcagaatacttcagagatcaaggtaaaaatgtttctatgattgcagactcttcttcaagatgggctgaagctttgagagaaatttctggtcgtttgggtgagatgcctgctgatcaaggtttcccagcttatttgggtgctaagttggcctccttttacgaaagagccggtaaagctgttgctttaggttccccagatcgtactggttccgtttccatcgttgctgccgtttcgccagccggtggtgatttctcagatcctgttactactgctacattgggtatcactcaagtcttttggggtttagacaagaaattggctcaaagaaagcatttcccatctatcaacacatctgtttcttactccaaatacactaatgtcttgaacaagttttatgattccaattaccctgaatttcctgttttaagagatcgtatgaaggaaattctatcaaacgctgaagaattagaacaagttgttcaattagttggtaaatcggccttgtctgatagtgataagattactttggatgttgccactttaatcaaggaagatttcttgcaacaaaatggttactccacttatgatgctttctgtccaatttggaagacatttgatatgatgagagccttcatctcgtatcatgacgaagctcaaaaagctgttgctaatggtgccaactggtcaaaactagctgactctactggtgacgttaagcatgccgtttcttcatctaaattttttgaaccaagcaggggtgaaaaggaagtccatggcgaattcgaaaaattgttgagcactatgcaagaaagatttgctgaatctaccgattaa

SEQ ID NO: 691 - DNA, 1860 bp, Schizosaccharomyces pombe
  strain 972 h-
atggcgggaggaattgaactggccaagaaggctatcaggagcctcaaaaattacgacgagcatgaaaaccgatatggatctattttcagcgtttctggtcctgtcgttgttgcagccaatatgcttggatgttcgatgtacgaactcgttcgcgttggtcatgaagaactagttggtgaagtaattcgtatccatcaagataaatgtactattcaagtatacgaagagacgtccggtctcactgttggtgatcctgtccaacgcactggaaagccattatctgttgaattaggtcctggtttagctgagactatttatgatggtatccaacgtccgttaaagcaaattttcgacaaatctcaaagtatttatattcctagaggtattaatacagaatcacttaatcgtgagcataagtgggatttcacaccaaataaggatttacgcattggcgatcatgtatccggtggtgatgttttcggttctgtatttgaaaactctcttttcaatgatcataaaattatgttaccccctagagcccgtggtaccgtcacatatattgctgaagctggatcataccatgttgatgaaaaacttcttgaagtcgagtttaatggcaagaaacattcttttagtatgttgcatacttggcctgtccgtgctgctcgtccagttgcggacaacttaactgctaatcaacctttattgactggtcaacgtgttttggatgcgttatacccctgtgttcaaggtggcactactgctatccccggtgcctttggttgtggtaaaacagttatttcacaatctctttctaagtactctaattctgatttgattgtttacgtcggttgtggtgaacgtggaaacgaaatggcagaagtgttaatggatttcccagaactaacaattgatattaatggtaaaccagagcccattatgaagcgtactacattggtagccaacacttctaacatgcctgtcgctgctcgtgaagcttccatttataccggtattacacttgctgaatattatcgtgatcaaggtaagaacgtttcaatgatggctgattctacatctcgttgggctgaagctttgcgtgaaatttctggtcgtttggctgagatgcctgccgattctggttatcccgcttatttgggtgccaaattggcttctttttacgaacgtgctggtcgtgctcgttgcttgggaagtcctgaccgtgaaggaacagtttcaattgttggagctgtttctcctccgggtggtgatttttctgatcctgttactagtgcaaccttgggaattgttcaagtcttctggggtttggacaagaaattggcccaacgtaaacactttccctcaatcaacacctctctttcctattctaaatacatcaatgctttgcaaccttggtatgaggaaagagttccaggctttaatactcttcgtgatcaaatcaaacagatcattcaacaagaagattccatgttggaaattattcagttggttggtaagtcggctctttctgaaacggataaagttactttggacatagccggtattattaagaatgacttcttacaacaaaacggttattctgattacgatcgctgttgccctctttacaagacttatcatatgatgcgaaacatgattgcttactacacaaaggctaaaagtgccgttgaaactggtagcgttccttggtcaaagattaaagaaagtacttcagatatcttttatgagttaacctcgatgaaattcgaaaaccctaatgaaggcgagaaggaaatagtcgaacactatgaaactctgcacaagaagattgaggacaagtttcacactctgactgagtaa

SEQ ID NO: 692 - DNA, 1833 bp, Trypanosoma congolense
  strain IL3000
atgacgagcgataaaaacccttacaaaacagagcagcgcatgggggccgtgaaggccgtctccgggccagttgtcattgctgaaaacatgggcggtagcgctatgtatgagcttgtgcaggtaggttccttccggttagtgggcgagatcattcgtctagagggcgataccgccactattcaggtctatgaggaaacaggtggcctcactgtcggagacccggtgtactgtacgggtaagcctctttcgcttgagcttggacctggaatcatgtctgaaatatttgacggtatccagcggcctcttgacaccatctaccgcatggtggaaaacgtgtttatccccaggggcgttcaggtgaagtcactcaatgaccagaaacagtgggactttaagccatgcctgaaggttggagatcttgtgtctggtggtgatatcattggctcagtggtggagaactctctcatgtacaatcacagcattatgattccgcccaatgtgcggggccgtgttacttccattgttccttcaggaaattacaccctccaagatgacattattgaattggaatataatgggacagtgaaatcactaaaacttatgcatcgctggccagtacggaccccgcgtcctgtggcgtcaaaagaatccggcaatcatccgcttctcaccggacagcgtgtgctcgatgctctctttccatccgtccagggtggaacatgcgccatccctggcgcgtttggatgcggaaagacggttatcagtcaggctctttcgaagttctccaacagcgacgctgttatctatgtcggctgcggcgagcgtgggaatgagatggcagaggtgctcatggacttccccacactcaccaccgttattgatggtcgtgaggagtccatcatgaagcgtacctgcctggtggcaaacacctcaaatatgcctgtcgctgctcgtgaggcgtctatttacactggcatcactttagctgagtattatcgtgatatgggcaagcacattgctatgatggccgactctacctctcgatgggctgaggctctccgtgagatctctgggcgtctcgctgaaatgcccgctgatggtggttaccctgcgtacctcagtgcgcgtcttgcttccttctacgagcgtgcggggcgcgtgacatgcatcggtgggccaaaacgcgagggctcagtaaccatcgttggtgccgtttctcctcctggaggtgacttttctgacccagtgacgtccgctacgcttggtattgtgcaagtcttttggggtcttgagaagcgtcttgcgcaacgtaaacactttccttctgttaattggctcatttcctattcaaaataccttaatgctttggagcccttcttcaacacgcttgaccctgactacatgcgcctgcggtcagttgctgcggagatccttcagcgtgaggaagagttgcaagaaattgttcaacttgtcggtaaggactcactttcggagtctgacaaaattattctagaaacggctaaggttattcgtgaagagtttctccagcagaatgcctttacgccgtacgacaagtattgcccgccgtacaagacctgctggatgctacgtaacattgtcgcgttctacgaggagagccagcgcgttgtagctgagtccgctggggaacttaagattacgtggaactacattcgtgaaatgattcctcatatttacacgggtttaactgagatgaagttccgtgatcctcaggagggtgaggaggccaacgtagaattctacagaaaacaaaatgaggaaattgtcagcgcattcgcctcgctgctgcaataa

SEQ ID NO: 693 - DNA, 1758 bp, Thermus thermophilus
  strain HB8
atgatccaaggggtgatccagaagatcgcgggcccggcggtgatcgccaagggcatgctcggggcccgcatgtacgacatctgcaaggtgggcgaagagggcctcgtgggcgagatcatccgcctggacggggacacggccttcgtccaggtctacgaggacacctcgggcctaaaggtgggggagcccgtggtctccacgggccttcccttggcggtggagctcggccccgggatgctgaacggcatctacgacggcatccagcgccccctggagcgcatccgggagaagacggggatctacatcacccggggcgtggtggtccacgccctggaccgggagaagaagtgggcctggacgcccatggtcaagcccggggacgaggtgcgggggggtatggtcctgggcacggtgcccgagttcggcttcacccacaagatcctggtacccccggacgtgcggggccgggtcaaggaggtgaagcccgccggggagtacaccgtggaggagccggtggtggtcctcgaggacggcaccgagctcaagatgtaccacacctggcccgttcgccgggcgaggcccgtgcaaaggaagcttgaccccaacacccccttcctcacggggatgcgcatcctggacgtcctcttccccgtggccatggggggcaccgccgccatccctgggcccttcggcagcggcaagaccgtgacccagcagtccctggccaagtggtccaacgccgacgtggtggtctacgtgggctgcggggagcgggggaacgagatgaccgacgtgctcgtggagttccccgagctcaccgaccccaagacgggtgggcccttgatgcaccgcaccgtcctcatcgccaacacctccaacatgcccgtggccgcccgcgaggccagcatctacgtgggcgtgaccatcgccgagtacttccgcgaccagggcttctccgtggccctcatggccgactccacgagccgctgggccgaggctttgcgcgagatctctagccgcctcgaggagatgcccgccgaggagggctacccgccctacctcgccgccaggctcgccgccttctacgagcgggcgggcaaggtcatcaccctgggcggcgaggagggggcggtgaccatcgtgggggccgtctccccgccgggcggcgacatgtccgagcccgtgacccagtccaccttgaggatcgtgggggccttctggcggcttgacgcctccctggccttccgccgccacttccccgccatcaactggaacggctcctacagcctcttcacctccgcccttgacccctggtaccgggagaacgtggccgaggactaccccgagctccgcgacgccatctccgagcttttgcagcgggaggcgggcctccaggagatcgtccagctcgtggggccggacgccctccaggacgccgagcgcctcgtcattgaggtgggccggatcatccgcgaggacttcctgcagcagaacgcctaccacgaggtggacgcctactgctccatgaagaaggcctacgggatcatgaagatgatcctcgccttctacaaggaggcggaggcggccatcaagcggggggtttccatagacgagatcctgcagctccccgttctggagcgcatcggccgcgcccgctacgtgagcgaggaggagttccccgcctactttgaggaggccatgaaggagatccagggggccttcaaggctggcctaaagggggagagatggaccttctga

SEQ ID NO: 694 - DNA, 21 bp, Artificial Sequence
  Synthetic DNA Sequence
  modified_base (7): i
cggcgcnatcytsgttgttgc

SEQ ID NO: 695 - DNA, 20 bp, Artificial Sequence
  Synthetic DNA Sequence
gtttcacgtgatgacgtaca

SEQ ID NO: 696 - DNA, 26 bp, Artificial Sequence
  Synthetic DNA Sequence
  modified_base (3): i
  modified_base (6): i
  modified_base (12): i
  modified_base (21): i
atnggncayrtngaycayggnaarac

SEQ ID NO: 697 - DNA, 23 bp, Artificial Sequence
  Synthetic DNA Sequence
  modified_base (3): i
  modified_base (6): i
  modified_base (9): i
  modified_base (12): i
ccnacngtncknccrccytcrcg

SEQ ID NO: 698 - DNA, 1185 bp, Escherichia coli
gtgtctaaagaaaaatttgaacgtacaaaaccgcacgttaacgttggtactatcggccacgttgaccacggtaaaactactctgaccgctgcaatcaccaccgtactggctaaaacctacggcggtgctgctcgtgcattcgaccagatcgataacgcgccggaagaaaaagctcgtggtatcaccatcaacacttctcacgttgaatacgacaccccgacccgtcactacgcacacgtagactgcccggggcacgccgactatgttaaaaacatgatcaccggtgctgctcagatggacggcgcgatcctggtagttgctgcgactgacggcccgatgccgcagactcgtgagcacatcctgctgggtcgtcaggtaggcgttccgtacatcatcgtgttcctgaacaaatgcgacatggttgatgacgaagagctgctggaactggttgaaatggaagttcgtgaacttctgtctcagtacgacttcccgggcgacgacactccgatcgttcgtggttctgctctgaaagcgctggaaggcgacgcagagtgggaagcgaaaatcctggaactggctggcttcctggattcttatattccggaaccagagcgtgcgattgacaagccgttcctgctgccgatcgaagacgtattctccatctccggtcgtggtaccgttgttaccggtcgtgtagaacgcggtatcatcaaagttggtgaagaagttgaaatcgttggtatcaaagagactcagaagtctacctgtactggcgttgaaatgttccgcaaactgctggacgaaggccgtgctggtgagaacgtaggtgttctgctgcgtggtatcaaacgtgaagaaatcgaacgtggtcaggtactggctaagccgggcaccatcaagccgcacaccaagttcgaatctgaagtgtacattctgtccaaagatgaaggcggccgtcatactccgttcttcaaaggctaccgtccgcagttctacttccgtactactgacgtgactggtaccatcgaactgccggaaggcgtagagatggtaatgccgggcgacaacatcaaaatggttgttaccctgatccacccgatcgcgatggacgacggtctgcgtttcgcaatccgtgaaggcggccgtaccgttggcgcgggcgttgttgctaaagttctgggctaa

SEQ ID NO: 699 - DNA, 26 bp, Artificial Sequence
  modified_base (3): i
  modified_base (6): i
  modified_base (21): i
  modified_base (24): i
  Synthetic DNA Sequence
gtnacnggytcytyrarrttnccncc

SEQ ID NO: 700 - DNA, 24 bp, Artificial Sequence
  Synthetic DNA Sequence
  modified_base (2): i
  modified_base (5): i
tnrtngaygtcgarttccctcarg

SEQ ID NO: 701 - DNA, 21 bp, Artificial Sequence
  Synthetic DNA Sequence
gtgttcacgatcatcgatgcg

SEQ ID NO: 702 - DNA, 20 bp, Artificial Sequence
  Synthetic DNA Sequence
ctctcgatatccgcgaagcg

SEQ ID NO: 703 - DNA, 20 bp, Artificial Sequence
  Synthetic DNA Sequence
tatggaaattcgaaacatct

SEQ ID NO: 704 - DNA, 20 bp, Artificial Sequence
  Synthetic DNA Sequence
agtgctccaattaatgttgg

SEQ ID NO: 705 - DNA, 20 bp, Artificial Sequence
  Synthetic DNA Sequence
gtacagttccaatacctgaa

SEQ ID NO: 706 - DNA, 20 bp, Artificial Sequence
  Synthetic DNA Sequence
tgaaatcttcacatccaaca

SEQ ID NO: 707 - DNA, 25 bp, Artificial Sequence
  Synthetic DNA Sequence
twaccatttcagtaccttctggtaa

SEQ ID NO: 708 - DNA, 26 bp, Artificial Sequence
  Synthetic DNA Sequence
  modified_base (9): i
  modified_base (12): i
  modified_base (15): i
  modified_base (18): i
  modified_base (21): i
  modified_base (24): i
tcrtccatnccnarnatngcnatnat

SEQ ID NO: 709 - DNA, 1656 bp, Borrelia burgdorferi
atgaatgaagttttatttgtaaagactgctggtaggaatttaaaagcagaagtaattcgtattaggggcaatgaagttgatgcacaggtttttgaattgacaaaagggatatctgttggagacctagttgaatttacagacaaacttttaacagttgaactcggaccagggcttttaactcaagtatatgatgggcttcaaaatcctttgcctgaattggctattcaatgtggattttttttagaaaggggagtatatttaaggcccttgaataaagataaaaagtggaattttaaaaaaacctccaaagttggagatatcgttattgcaggagattttttaggttttgtaattgagggaactgttcaccatcaaataatgattccattttataaaagggattcttataaaattgtggagattgtaagtgatggcgactattcgattgatgagcaaattgctgtaattgaagatgattctggtatgaggcataatattacaatgtcttttcattggcctgttaaagttcctattactaattataaggaacgccttattcctagtgaacctatgttgactcaaactagaattatagatacatttttcccagttgccaaaggtggaactttttgcattccgggtccttttggagcaggaaaaacggttcttcagcaggttacaagtcgaaatgctgatgttgatgtagtgattattgcagcttgtggtgagcgagcaggagaagtggtagaaactcttaaagaatttcccgaattaatggatccaaaaaccggcaaatctttaatggacaggacttgtattatttgtaatacatcttcaatgccagttgcagctagagaagcttctgtttatactgctattactattggtgagtattacaggcaaatgggccttgatattcttcttttggcagattcaacttcaagatgggctcaagcaatgagagaaatgtctggacgccttgaggaaattcctggcgaggaggcttttccggcatatcttgagtctgttattgcttccttttatgaaagggcaggtattgtagttcttaataatggggatattggatctgtaacagttggtggctctgtaagtcctgctggtggtaattttgaagagccagttactcaagcaactttaaaagttgtaggagcatttcacgggcttacaagagaaaggtctgatgctaggaaatttccagctattagtcctcttgaatcttggagtaaatataaaggcgttattgatcaaaaaaagactgaatatgcaagatcttttttggtgaaaggtaatgaaattaatcaaatgatgaaagttgttggagaagaaggcataagtaacgatgattttttaatttatttaaaatccgagctacttgattcgtgctatttgcagcaaaattcatttgattctattgatgctgctgttagttcagagcgtcaaaattatatgtttgatatagtttataacattcttaaaactaactttgagttttctgataaacttcaagcaagagattttataaatgagttaaggcaaaatcttttagacatgaatctttcttcttttaaggatcataagtttaataaattggagcatgctttgggtgaattgataaattttaaaaaggtaatttag

SEQ ID NO: 710 - DNA, 1818 bp, Treponema pallidum
  strain Nichols
gtgatcaaagacgatgtggttacaggccgtgtagtgagggtgtctggtcccattgtgtatgccgagggcctctctgcgtgcagcgtatacgatgttgtcgacgtaggggaagcatcgctcatcggagaaattatccggttggatgagagcaaggcggtcgtgcaagtatacgaggatgacacaggtatgcgagtcggggagaaggtgacaagcttgcgtcgaccactctcagtccgcttagggcctggattaatcggcaccatttatgacggtattcagcgcccacttgagcgcctcttccaagaagacggcgccttcttgcgtcctggtgcgcgttcacaaccgcttgatggctccgtacgctgggattttcgtcctcattgtaacgagcgcggtgaggccctgtgcgcggggattccgattgcacctgggtcagtgttagggaccgtgcaggagactccttctgttgtgcacactatcatggttcctcctgacatccgggggagcgtgctatcttcgttcaagggcgcaggtgcttacacaatagatgaagaaattggacgcactgatcttggtgagccgctttttctatcccagtactggccagtgcgtcgtgcgcgtcctttcagcaaaaaacttgcagtgtgtgagccactagttactggacagcgggcgattgatgttttcttccccctatcaaagggaggaacggcggctattccagggggatttggaactgggaagacaatgacgcagcatgccgttgccaagtggtgtgatgcagatattatcgtgtacatcggctgcggagagcggggcaacgagatgacagacgtgctctctgaatttcccaaactcatcgatccgcgcacaggacgctctcttatggagcggacgattttgatcgcaaatacgtccaatatgcctgtgtccgcacgcgaggtgtcgctgtattcagggattacccttgcggaatactaccgtgatatgggtatgcatgtggccatcatggctgattctaccagccgctgggcggaggcgctgcgtgaattgtctgggcgcatggaagaaatgcctgcggaggagggattccctgcgtaccttccgacgcgtcttgcagaattttatgagcgcgcaggacgcgtggaaacctgtgtggcgcgcgagggctctgtgagcatcattggtgctgtttctcccctgggtggagatttctctgagccggtgacgcagcacacaaagcgcttcatccgttgcttttgggccttggatcgtgaacttgcacacgcgcgtcattaccctgccattgggtggatagattcatactctgaatatgcgcaggaagtaagtgcatggtggagtaagtatgacccgcgcgcaggcgcgttgcgcgccgcagccttggatttgctgagaaaggaacagcggttacagcaaattgtcaggcttgtcggtcctgatgcgctgcctggagaagatcgtctggtgctaatggtgtgtgaaatgatcaaaggtggctttctgcagcagaacgcttttgatccgacggatgtgttctcctgtcccgaaaagcaggtgcagatcttgcgtaccatagtggattttcacgaacgtgccgtggtgctgctgcgtgcaggtatttcgctttctgcgctgtcccagctttcgtgccgggagctcatcgtacgtatgaaaactacgtacgggaatgaggatgtacacaagatgcagaaagtgtacgacacgatgtgcactgagtttgaccaactgagtgtgtgtgctgccgcgcgcacacaagggggggagaaagtcgaatga

SEQ ID NO: 711 - DNA, 1779 bp, Chlamydia trachomatis
  strain MoPn
cagggctatgtcgtagaagcttacggaaatttattgcgggtgcattttgatgggcatgtgcgtcaaggagaagtggcctatgtcagcgtggatgatacttggttgaaagcggaaattatagaagttgtgggagatgaggttaaagtccaagtttttgaggaaactcaaggaatttctcgaggcgctttggtaactttttccgggcatttattagaagcggaacttgggcccggtctattgcaaggtatttttgacggacttcagaatcgcttagaggtattggcagatacaagcttgttcttgaaaagaggggagtatgttaatgccatttgtcgggaaactgtatgggcttatacgcaaaaggcttctgtcggggatgttctatctcggggagatgtgcttggtacagtaaaggaagggcggtttgatcataaaatcatggttcctttctcttgttttgaggaagtgactatcacttgggtcatttcttcaggagattacactgttgataccgttattgctaaaggacgtactgcttcaggagccgagcttgaatttacaatggttcagaaatggcccattaaacaggcttttttagaaggggaaaaggtaccgtctcatgaaattatggatgttgggttacgagtattagatactcagatccccgtcttaaagggaggaactttttgtactccagggccttttggtgcaggaaagaccgttttacagcaccatttatctaagtatgcagctgtagatatcgtagttttgtgtgcttgtggagagcgagctggagaggttgtagaaattcttcaggagttcccgcatttgacagatcctcatacggggcagtctttgatgcataggacctgtattatttgtaatacatcttccatgcctgtagcagctagagagtcctccatttatttgggtattactatagcagaatattaccgtcaaatggggttgcatgttttgttattggctgactcgacatctagatgggctcaagctttaagggaaatttcagggcgattagaagaaatccctggagaagaagctttcccagcctatttggcgtctcgaatagcagctttttatgagcgaggcggggctgtgaaaatgaaagatggatcggaaggctccttgactatctgtggagcggtttctcccgcaggaggaaattttgaagagcctgttacacaagcaactttatctgttgttggggctttctgtgggctttctaaggctagagcagatgctagacggtatccttctattgatccgatgatttcatggtctaagtacttggattctgtggcggagattttagagaaaaaagttccaggatggggagattccgttaaaaaagcttctcgtttcttagaagaaggagcagaaattggtaagcgaatagaagttgttggggaagaagggatttctatggaagatatagaaatctttttgaaatcagagttgtatgatttctgttacttacagcaaaacgctttcgatgcagaggactgttattgtccttttgatcgtcaaatagagcttttttctttaatgagtcatatttttagctctagattctgttttgattgtccagataatgctcggagtttctttttagagcttcaaagtaaaattaaaacgctgaatggtcaaaaattcctttctgaagactatcagaaggggctagaagtgatctataaactattagaaagcaaaatggtgcagacggcgtaggtatgcaaacaatatatacaagaattacgg

SEQ ID NO: 712 - DNA, 965 bp, Enterococcus faecalis
  strain V583
gtgcaaattggaaaaattgtcaaagtttcaggtcctttgattttagctgaaaacatgtcagatgctagtatccaagacatttgtcatgtaggagatttaggcgttatcggagagattattgaaatgcgaggcgacgtcgcttcgattcaagtatatgaagaaacaacaggcattggaccaggagaaccagttatttcaacaggagaaccattatctgttgaattagccccaggtttaattgccgaaatgtttgatggtattcaacgaccattggatacatttcaagaagtaacccacagtaactttttaggccgtggcgttaaaattgatgcgttagatcgtgagaaaaaatggacgtttgaaccaactgtggcagttggtgaagaagtgtcggcaggtgacatcgtcggtgtggttcaagaaacaccgattattcaacataaaattatggtgcctttcggcgtttcaggaacgattgccgaaattaaagcaggtgactttgccattgatgaaacagtttactcagtggaaacggctaaaggaacggaaagttttagcatgatgcaaaaatggcccgttcggcggggacgtcccattttagaaaaactaagtcccaaagtaccgatggtgaccggacaacgcgtaattgatacctttttcccaattacgaaaggcggagcggcagcagttccaggaccatttggcgctggaaaaacagtcgttcagcaccaaattgctaagtgggccgatgtcgacttagtcgtttacgttggttgtggggaacgcgggaatgaaatgacagatgttttaaatgaatttccagaattaattgacccaacaactggtgagtctttgatgaatcggacgattttaattgcgaatacgtcaaatatgccggtagcggcacgggaagcctcgatttatacagggattaccattgcagaatatttccgtgatatgggtta

SEQ ID NO: 713 - DNA, 1737 bp, Methanosarcina barkeri
gtggaagtaaaaggtgaaatttatcgtgtgtctgggcctgtcgtcaccgccatcggcttgcaggcaaaaatgtatgacctggtcaaagtcggtaatgaaggtttaatgggtgaagtcattcagatattagggcccaagaccatcatccaggtatatgaagagaccgcaggtatcaagccaggggaaccctgtgtatctacagggtcgtctctgtccgtagaacttggtccgggtcttctttccagtatttatgacggggttcaaaggcctctgcacgtcctgcttgaaaaaatgggtagcttcatccagagaggtgtcagcgcagatgggcttgatcataagaaactctgggatttcaaacccattgtcaagaagggcgattccgtaaaaggtggagacgtaattggtgttgtacaggaaaccgtgaatattgaacataagatcatggtgcctcctgatatctcaggtacaatttccgacataaagagcggaaactttacggtagtagacacaatctgtactctgactgatgggaccgaattgcagatgatgcagaggtggcctgttcgaagacccagacctgtgaaggcaaaacttactccaaccaggcctctggttacaggaatgagaatccttgatgggcttttccctgtggcaaaaggcggaacagctgcaatccccggacctttcggatcgggaaagaccgtaactcagcagtcgcttgcaaaatggagtgataccgaaattgtggtctacatcggttgtggtgagcgtggaaacgaaatggcagatgttctgagcgaattccctgaactcgaagatccgcagaccgggcgcccacttatggagcgtactgttcttatcgctaacacttcaaacatgcctgtggccgcaagagaagcatctgtgtataccggaatcaccattgcagaatactaccgtgacatgggattagatgtatcccttatggcagactccacctcaaggtgggcagaagccatgagagaaatctcttcccgtctggaagaaatgcctggtgaagaaggttacccagcatacctgtctgcaagactggccgaattctacgagcgtgccggggttgcggagagtctttgcggcgaaacaggttccattactgttattggagcagtatctccacctggcggtgacttctcagagcctgttacacagaataccctgcgtatcgtaaaagtgttctgggctctcgatgccaaactatctcagaggcgtcacttcccggccatcaactggctgaacagttacagtctgtataaggacagtcttaatgactggtttgcagataatgtggctcctgattatgtgcctttgagggaaagagcaatggaaatgctccagacagaatctgaactgcaggaaatcgtgcagcttgtaggttccgatgctctgccagacgaccagcagcttctgcttgaaatcacccgtatgcttagggaaattttcctgcagcagaatgcattccacccagtagatgcatacagcccgttcgatcagcagtacaagatccttaaggcaatcatgaaatggggagacgctgcgatggatgccttgaaatcaggtgttcccgtaactgaaattatcaagcttgaatccaaaaatgtgcttgctaaggtcaagtacgaagagaagtttgatgagtctatgaatgctgtcctggcacagatggataaagagtttgcatccctgagaggtaggtaa

SEQ ID NO: 714 - DNA, 1785 bp, Methanosarcina jannaschii
atgaaaagagaggttgagaatatgccagttgttggtaagattattaaaatcgcagggcctgttgtagttgcagagggaatgaaaggagctcagatgtatgaggtcgttaaagtaggagaagagaaattgactggagaaatcattcagttgcacgatgataaagcagttattcaggtttatgaagaaacatctggaattaaaccaggagagccagttgttggtactggagctccattgtctgttgaattagggccagggatgttaagagctatgtatgatggtattcagaggcctttaacagcaattgaagagaaaacaggttcaatctttatcccaagaggagttgatgtccctgcattaccaagagatataaaatgggaatttaaaccagtggtaaatgaaggagattatgttgaagaaggagacataattggaactgttgatgaaactccttcaatagttcataaaatcttagttccaattggtgttaaaggaaaaattgttgaaataaaagagggtaaatttacagttgaagagacagttgcagttgtagaaacagaaaatggagaaaggaaagaaattacaatgatgcaaaaatggccagtaagaaaaccaagaccatataaagagaaactacctccagaaattccattaattacagggcaaagagttgaagacactttctttacattagcaaaaggaggaacagcagcaattccaggtccattcggttcaggaaaaacggttactcagcatcagttggcaaagtggtctgacgctgatgtcgttgtttatatcggatgtggagaaagaggaaacgagatgacagaggttattgaagagttcccacacttagaagatattagaactggaaacaaattaatggatagaactgtattaatagccaacacatcaaacatgcctgtcgctgcaagggaagcatctgtctatacaggaattacaattgcagagtacttcagagatatgggttatggagttttattaacagcagattcaacatcaagatgggcagaggcaatgagagaaatttcaggtagattggaagaaatgccaggggaagaagggtatccagcatacttagcttcaagattggctcagttctatgaaagagctggaagagttataaccttagggaaagataacagacaaggattcgtttgtatcgttggagctgtttcaccaccaggaggggacttctcagaaccagttacatcaaacacactaaggatagttaaggtattctgggcgttagatgcaaacttggcaagaagaagacacttcccagctatcaactggttgcagagttattcattatacattgatgatgttacagagtggtggaacacaaatactggtccagattggagacaattaagagatgaagcaatgagcttattacaaaaagaggcagagttgcaagagattgttcagttagttgggcctgatgcattgccagatagggagagagttattttagaagttgcaagaatgttgagggaggatttcttacagcaagatgcgtttgatgaggtagatacctactgtcctccaatgaaacagtacttaatgttaaagataattatgacattctaccaagaagcattgaaggcagttgaaagaggagttgaaccagctaagattttaggagtttcagttaagcaagatattgcaagaatgaaatacatcccacacgatgagtttataaatgttaaatcaaaagaaataatggagaaaattaagaatgaattaggttcattaaactaa

SEQ ID NO: 715 - DNA, 1354 bp, Porphyromonas gingivalis
  strain W83
tgagcgaggtgatcaaggtgatcggcaaaaatgcttatgtgcaggttttcgaaagtactcgcggtatgcacgtaggagatgaggcagagtttaccggcagtatgcttgaggtaacgctcggccccggtatgctttcgaagaactacgacggtctgcaacacgacttggacaagatggacgggatcttcctcaaacgaggcgattatactcccgctctcgatgacgacaagctgtgggacttcaagcctttggccaatgtgaacgacaatgtgatcgcaggctcatggctcggagaggtgacggaaaatttccaaccgcacaagatcatggtacctttcgttttcgaaggcaattacaaggtgaagagtctggccaaagccggttcgtacaaagtgaacgatgtgatcgctgtggtaacggatcaggacgggaaagaccacaatgtaaccatggtgcagaaatggccggtgaaacgtgctatcacttgctatcgcgagaagccgcgtcctttcaaactgctcgaaacgggtatccgtatcatcgacactttcaaccccatcgtagagggtggtacgggatttatccccggtcctttcggtacgggaaagacggtgctccagcatgctatctcgaagcaggcggaagccgatatcgtgatcattgcagcctgtggcgagcgtgcaaacgaggttgtggagatctttgcggaattcccccacctgaatgacccccacacgggacgtaaattgatggaacgtaccattattattgctaatacgtcgaatatgcctgtggcttcgcgtgaggcatccgtatatacggccatgacgatagccgagtactatcgctccatgggccttcgcgtgctgatgatggcagactccacttcgcgttgggcacaggctctgcgtgagatgtctaaccgtctggaagagcttcccggaccggatgctttcccgatggacttgtcagctatcgtagccaacttctacgctcgtgcaggatacgtttacctgaacaacggttcggccggttcggtaacgttcatcggtacggtatctcccgccggtggtaacctcaaagagcctgtgacggaaaacaccaagaaagtggctcgctgcttctatgctttggagcagaatcgtgccgaccgcaaacgttatccggctgtaaaccccatcgatagttactcgaagtacatcgaatatcccgaattcgagagctatatatcgaaccacatcagtttactcattatattcaacagaagttggcagatatatggatcaaatcttacagcagactggactactaaggtgaatgagctgaagatgcgcttgcatcagggtaaagaaat

SEQ ID NO: 716 - DNA, 1788 bp, Streptococcus pneumoniae
  strain Type 4
tttgactcaagggaagattataaaagtatcgggacctctagttattgcatcaggtatgcaggaggctaatattcaagatatttgccgtgtaggtaagctagggttaatcggtgaaattattgaaatgagaagagatcaggcatctatccaagtctatgaagaaacatctggtcttggtccgggagaacctgttgttacaactggagaacctctctcggttgaattagggccaggattgatttctcaaatgtttgatggcatacaacgcccattagatcgatttaaattggctactcataatgattttctagttcgtggggtagaagttccaagtttggatagagatattaagtggcattttgattccactatagcaattggtcaaaaagtgagtacgggtgatattcttggaactgtcaaggaaaccgaggtagttaatcataaaattatggttccttatggagtatctggagaagtcgtttctattgcatctggcgattttacaattgatgaagttgtatatgaaataaaaaaattggacggtagtttctataaaggaacgcttatgcaaaaatggcctgtccgcaaggcgcgtcctgtttctaaacgtttaattccagaagaaccattaatcacaggtcaacgagttattgatgcattctttccagtaaccaaagggggagctgcagcagttcctggaccgtttggagcaggaaagacagttgtacaacaccaagtagctaaatttgccaatgttgatattgttatttatgtcggttgtggagaacgtggaaatgaaatgacggatgtactgaatgagtttcctgagttgattgaccctaataccggacaatcaattatgcaacggacagttctgattgctaatacttcaaatatgcctgttgctgctcgtgaggcttcaatttatacaggaattaccatggctgagtattttcgtgatatgggctactctgtcgccattatggctgattcaacttcacgttgggcagaagcgctacgtgaaatgtcaggacgtctagaagaaatgcctggtgatgagggttatcctgcttatctgggaagtcgtatcgctgaatattatgaaagagcaggacgttctcaggttctagggcttccagaacgtgaaggaacgattactgctattggagctgtatcgccacctggtggagatatttcagaaccagttactcaaaacactttacggattgtgaaagttttttgggggcttgatgctccgttggcacagcgacgtcattttcctgcaattaactggcttacatcttattcactatataaagacagtgtgggcacttatatagatggtaaagagaagacagattggaatagtaaaataactcgtgcgatgaactacttacaacgggaatctagtttagaggaaattgttcgtcttgttggaattgattctctgtctgataatgaacgactaacgatggaaattgctaaacaaattcgagaagattatttgcaacagaacgcttttgattcggtagatacattcacttcgtttgcaaaacaagaagcaatgctaagtaatattctcacttttgctgatcaggcaaatcatgctttagagttgggttcttactttacagagattatggaaggtaccgtggcagttcgagaccgtatggcgagaagtaaatatgtttcagaagatagattagatgaaatcaaaattatatcaaatgagattacacatcaaattcatttgatattagaaacaggaggtctataaatgagtgttat

SEQ ID NO: 717 - DNA, 823 bp, Burkholderia mallei
  strain GB8
cgatcctggtgtgctcggccgctgacggcccgatgccgcaaacgcgtgagcacatcctgctggcgcgtcaggtcggtgtgccgtacatcatcgtgttcctgaacaagtgcgacatggtggacgacgcggagctgctcgagctggtcgaaatggaagtgcgcgaactgctgtcgaagtacgacttcccgggcgacgacacgccgatcatcaagggttcggcgaagctggcgctggaaggcgacaagggcgagctgggcgaagtggcgatcatgaacctggccgacgcgctggacacgtacatcccgacgccggagcgtgcggtcgacggcgcgttcctgatgccggtggaagacgtgttctcgatctcgggccgtggtacggtggtgacgggtcgtgtcgagcgcggcgtgatcaaggttggcgaggaaatcgaaatcgtcggtatcaaggcgacggcgaagacgacctgcacgggcgtggaaatgttccgcaagctgctggaccagggtcaggcgggcgacaacgtcggtatcctgctgcgcggcacaaagcgtgaagacgtggagcgcggccaggttctggcgaagccgggttcgatcacgccgcacacgcacttcacggcagaagtgtacgtgctgagcaaggacgaaggcggccgccacacgccgttcttcaacaactaccgtccgcagttctacttccgtacgacggacgtgacgggctcgatcgagctgccgaaggacaaggaaatggtgatgccgggcgacaacgtgtcgatcacggtgaagctgatcgcgccgatcgcgatggaagaaggtctgcg

SEQ ID NO: 718 - DNA, 824 bp, Burkholderia pseudomallei
  strain 1026B
gcgatcctggtgtgctcggccgctgacggcccgatgccgcaaacgcgtgagcacatcctgctggcgcgtcaggtcggtgtgccgtacatcatcgtgttcctgaacaagtgcgacatggtggacgacgcggagctgctcgagctggtcgaaatggaagtgcgcgaactgctgtcgaagtacgacttcccgggcgacgacacgccgatcatcaagggttcggcgaagctggcgctggaaggcgacaagggcgagctgggcgaagtggcgatcatgaacctggccgacgcgctggacacgtacatcccgacgccggagcgtgcggtcgatggcgcgttcctgatgccggtggaagacgtgttctcgatctcgggccgtggtacggtggtgacgggtcgtgtcgagcgcggcgtgatcaaggttggcgaggaaatcgaaatcgtcggtatcaaggcgacggcgaagacgacctgcacgggcgtggaaatgttccgcaagctgctggatcagggtcaggcgggcgacaacgtcggtatcctgctgcgcggcacgaagcgtgaagacgtggagcgcggccaggttctggcgaagccgggttcgatcacgccgcacacgcacttcacggctgaagtgtacgtgctgagcaaggacgaaggcggccgccacacgccgttcttcaacaactaccgtccgcagttctacttccgtacgacggacgtgacgggctcgatcgagctgccgaaggacaaggaaatggtgatgccgggcgacaacgtgtcgatcacggtgaagctgatcgcgccgatcgcgatggaagaaggtctgcg

SEQ ID NO: 719 - DNA, 800 bp, Clostridium beijerincki
  ref <308>: DATABASE ACCESSION NUMBER: ATCC 8260
tgtatcagcagcagatggtccaatgccacaaacaagagaacatatactactaggatcaagagttggtatccaatatatcgtagtattcttaaataaagcagatatggtagacgatccagaattattagaattagtagaaatggaagtaagagaattattaagcgaatatgacttcccaggagacgatattccagtaataacaggatcagcattaaaagcattagaaaatccaacagatgaagaagcaattaagccaatcatggatttaatggaagcagtagatagctatatcccaactccagaaagagcaacagataagccattcttaatgccaatcgaagatgtattcacaattacaggaagaggaacagttgcaacaggaagagttgaagctggagtacttcatgtaggagatgaagtagaaatcgttggattaacagaagaaaagaagaaagttgtagtaactggaatcgaaatgttcagaaagttattggatgaagcacaagctggagataacatcggagcattattaagaggagttcaaagaactgatattgaaagaggtcaagttttatcaaaaccaaattcagtacaccctcacactaaatttgtaggtcaagtatacgtacttaaaaaagaagaaggtggaagacatactccattctttgatggatacagaccacaattctatttcagaacaacagacgttacaggrtcaatcaagttaccagatggaatggaaatggtaatgcctggagatcacattgatatgaatgttgaattaatcactccaatcgcaa

SEQ ID NO: 720 - DNA, 799 bp, Clostridium innocuum
  ref <308>: DATABASE ACCESSION NUMBER: ATCC 14501
ggtgctatcctggttgttgctgcatctgatggtcctatgcctcagactcgtgagcacatcctgcttgctcgtcaggtaggtgttccttacatcgttgtattcctgaacaaatgcgacatggttgatgacgaagaactgatcgaccttgttgaaatggaagtacgtgagctgttaagcgagtacggattcgacggagataacgctccggttatccgtggttctgcactgaaggctctggaaggtgacgacaaatacgttggcgctatcaaagaactgatggatgcagttgatgaattcatcccagatccaactcgtgaaactgacaaaccattcctgatgtctgtagaagacgttatgacaatcacaggacgtggtacagttgctacaggacgtgttgagcgtggggtagtaaaactgggagaagaagttgaaatcgttggtatcaaggatactcagaaaactgttgttaccggactggaaatgttccgtaagcagctggacttcgcagaatccggagacaacatcggtgctctgctgcgtggtatcaaccgtgaccagattcagcgtggacaggttcttgctaaaccaggatccgtacatccacacacaaagttcaaggctcaggtttatgtattaacaaaagaagaaggtggacgtcacactccattcgtttctaactaccgtcctcagttctacttccgtacaactgacgtaactggtgttattacattaccggaaggaactgaaatggttatgcctggtgacaacgttgaaatgaacgttgagctgattgctccaa

SEQ ID NO: 721 - DNA, 789 bp, Clostridium novyi
  ref <308>: DATABASE ACCESSION NUMBER: ATCC 19402
ttgtatcagcagcagatggtccaatgccacaaacaagagaacacatcctattagcatcaagagtaggagttaaccacatagtagtattcttaaacaaagcagaccaagtagatgatccagaattactagaattagtagaaatggaagtaagagaattattaagcgaatacggatttgacggagacgaatgtccagtagtagtaggatcagcattaaaagcaatcgaagaaggggatgaccaatgcatcctagacttaatgaaagctgtagatgaatatatcccaactccagaaagagcaacagatcaaccattcttaatgcctgtagaagatgtatttacaattacaggaagaggaacagttgcaacaggaagagttgaaagaggagtactacacgtaggagatgaagtacaaatcgtaggaatgaaagaagaaatcggaaagacaacaatcacaggagtagaaatgttcagaaagatgttagatgaagcaatggctggagataacatcggagcattattaagaggagtacaaagagacgaaatcgaaagaggtcaagtactagcaaaaccaggttcagtaacacctcacaaaaaattcgtaggtcaagtttacgtattaaagaaagaagaaggtggaagacacactccattctttaacggatacagaccacaattctacttcagaacaacagacgtaacaggatcaatcgctttaccagaaggagtagaaatggtaatgccaggagaccatatagacatgaacgtagaattaatcacaccagtagcaa

SEQ ID NO: 722 - DNA, 798 bp, Clostridium septicum
  ref <308>: DATABASE ACCESSION NUMBER: ATCC 12464
gttcagcagcagacggtccaatgccacaaacaagagaacatatactactagcatcaagagttggtgttgactatatcgtagtattcttaaacaaggcagatatggtagatgacgaagaattattagaattagtagaaatggaagttagagaattattatcagaatacaacttcccaggagatgatattccagtaatcaagggatcagctttagtagcattagaaaacccaacagatgaaaaatcaatcgctccaatcttagaattaatggaagcagtagatagctacattccaacaccagaaagagcaacagataagccattcttaatgccagtagaagatgtattcacaataactggtagaggaacagttgcaacaggaagagttgaaagaggagttcttcatgtaggagacgaagtagaaatcgttggattatcagaagaaagcagaaaagtagtagtaacaggaatagaaatgttcagaaagttactagacgaagcacaagctggagataatgttggagtacttttaagaggtgttcaaagaacagatatcgaaagaggtcaagtattagcaaagactggatcagttaagccacacagcaagttcgtaggtcaagtatacgtacttaagaaagaagaaggtggaagacatactccattcttcgatggatacagaccacaattctacttcagaacaacagacgttactggatcaatcaaattaccagacggaatggaaatggttatgccaggagaccacattgatatgaacgttgaattaatcactcaagtagcaa

SEQ ID NO: 723 - DNA, 799 bp, Clostridium tertium
  ref <308>: DATABASE ACCESSION NUMBER: ATCC 14573
gttcagcagcagatggtccaatgcctcaaacaagagaacacatactactagcttcaagagttggtgttgactacatagttgttttcttaaacaaggcagatatggtagatgacgaagaattattagaattagttgaaatggaagtaagagaattattatcagaatacaacttcccaggagatgatattccagtaataaagggttcagctttacaagcattagaaaacccaacagatgaaaaagcaatcgctccaatccttgagttaatggaagctgtagatagctacattccaactccagaaagagcaacagataagccattcttaatgccagtagaagatgtattcacaatcactggtagaggaacagttgctacaggaagagttgaaagaggagttcttcacgtaggagacgaagtagaaatcgttggattatcagaagacagcagaaaagtagtagtaacaggaatagaaatgttcagaaagttactagacgaagcgcaagctggagacaacgtaggagttcttttaagaggagttcaaagaactgacatcgaaagaggtcaagttttagcaaaagttggatcagttaagccacacaagaaatttgtaggtcaagtatacgtacttaaaaaagaagaaggtggaagacatactccattcttcgatggatacagaccacaattctacttcagaacaacagaygttactggttcaatcaagttaccagatggaatggaaatggttatgccaggagaccacattgatatgaacgttgaattaatcactcaagtagctat

SEQ ID NO: 724 - DNA, 801 bp, Clostridium tetani
  ref <308>: DATABASE ACCESSION NUMBER: ATCC 19406
tagtaagtgcagcagatggtccaatgccacaaacaagagaacacatactattagcatccagagttggagttgagcacatagtagtattcttaaataaagcagaccaagtagatgacgcagagttaatcgaattagtagaaatggaagtaagggaattaatgaacgaatacggattcccaggagatgacgcaccagtagtagtaggatccgcattaaaagcattagaaaatccagaagatgatgcagcaacacaatgcataatggacttaatggcagcagtagatgaatatataccaacaccagaaagagcaacagataagccattcttaatgccagtagaagatatcttcacaatcacaggaagaggaacagttgcaacaggaagagtagaaagaggaattctaaaagtaggagacgaaatagaaatcgtaggattaagtgatgaaagcaagaaatcagtaatcacaggaatagaaatgttcagaaaactattagatgaagcacaagcaggagataacatcggagcattattaagaggtgttcaaagagatgaaatccaaagaggtcaagtattagcagcaacaggatcagtaaaaccacataagagttttacaggtcaagtatatgtattaaagaaagaagaaggaggaagacacactccattctttaacggatacagaccacaattctactttagaacaacagacgtaacaggttcaatcgcactaccagaaggagtagaaatggtaatgccaggagaccacatagacatgaaggtagaattaataacaagagtagcaa

SEQ ID NO: 725 - DNA, 633 bp, Enterococcus malodoratus
  ref <308>: DATABASE ACCESSION NUMBER: ATCC 43197
tatgcctcaaactcgtgaacacatcttgttatctcgtaacgttggtgttccttacatcgttgtattcttaaacaaaatggatatggttgatgatgaagaattactagaattagttgaaatggaagttcgtgacttattgtcagaatacgacttcccaggcgacgacactccagttatcgctggttcagctttgaaagctttagaaggcgatgcttcatacgaagaaaaaatcttagaattaatggctgctgttgatgaatatatcccaacaccagttcgtgatactgacaaaccattcatgatgccagtcgaagatgtattctcaatcactggtcgtggaactgttgcaactggtcgtgttgaacgtggacaagttcgcgttggtgacgaagttgaaatcgttggtattgctgaagcaactgctaaaacaactgttacaggtgttgaaatgttccgtaaattgttagattacgctgaagcaggcgataacattggtgcattgttacgtggtgttgcacgtgaagacatccaacgtggacaagtattggctaaaccagcttcaatcactccacatacaaaattctctgcagaagtttacgttttaactaaagaagaaggcggacgtcatactcc

SEQ ID NO: 726 - DNA, 623 bp, Enterococcus sulfureus
  ref <308>: DATABASE ACCESSION NUMBER: ATCC 49903
cacgtgaacacatcttgttatctcgtaacgtaggtgttccttacatcgttgtattcttaaacaaaatggatatggttgatgacgaagaattattagaattagtagaaatggaagttcgtgacttattatcagaatacgatttcccaggcgatgacactccagttgttgcaggttctgctttgaaagctttagaaggcgacgcttcttacgaagaaaaaatcatggaattaatggctgcagttgacgagtacatcccaactccaactcgtgacactgacaaaccattcatgatgccagttgaggatgtattctcaatcactggacgtggtactgttgctacaggtcgtgttgaacgtggacaagttcgcgttggtgacgttgtagatatcgttggtatcgctgacgaaactgctcaaacaactgtaacaggtgttgaaatgttccgtaaattattagactacgctgaagcaggcgataacatcggtgctttattacgtggtgttgctcgtgaagacatccaacgtggacaagttttagctaaaccagcttcaatcactccacatacaaaattctctgctgaagtatacgtattaagcaaagaagaaggtggacgtcatactcca

SEQ ID NO: 727 - DNA, 646 bp, Lactococcus garvieae
  ref <308>: DATABASE ACCESSION NUMBER: ATCC 49156
cggtcctatgcctcaaactcgtgaacacatcttgttatcacgtaacgttggcgtaccatacatcgttgttttcttgaacaaaatggatatggttgatgacgaagaattgctagaattagttgaaatggaagttcgtgacctattgtctgaatatgacttcccaggcgacgatgttcctgtaatcgctggttctgctttgaaagctcttgaaggagatccttcatacgaagaaaaaatcatggaattgatggctgcagttgacgaatacgttccaactccagaacgtgatactgacaaaccattcatgatgccagtcgaagacgtattctcaatcactggacgtggtactgttgctacaggccgtgttgaacgtggacaagttcgcgttggtgatgaagtagaaatcgttggtattgctgacgaaactgctaaaacaactgtaacaggtgttgaaatgttccgtaaattgttagactatgctgaagcaggggataacattggtgcattgctacgtggggttgctcgtgaagacatccaacgtggacaagtattggctaaagctggtacaatcacacctcatacaaaattcaaagctgaagtttatgttttgacaaaagaagaaggtggacgtcacactccattcttc

SEQ ID NO: 728 - DNA, 823 bp, Mycoplasma pirum
  ref <308>: DATABASE ACCESSION NUMBER: ATCC 25960D
gagcaattttagttgtttctgcaactgatggtccaatgcctcaaactcgtgaacatatcttattagcacgccaagttggtgttcctaaaatggttgttttcttaaacaaatgtgatgttgcttctgatccagaaatgcaagaattagttgctgaagaagtaaaagacttattaaaatcttatggttttgatggtgacaatactccaattattcgtggttcagcattagaagcattaaatggtaaacctgaatgagaagaaaaaattaaagaattaatgaaggcagtggatgacactattcctgatccagttcgtgatactgaaaagccattcttgttaccaattgaagacgtaatgacaattacaggtcgtggtactgttgttacaggtcgtgtagaacgtggtactctaaaattaaatgatgaagttgaaattgttggtttaggtgaaacatttaaatctgttgtaacaggtattgaaatgttccgtaaagaattagatgaagctcgtgctggtgacaatgctggtattttacttcgtggtgttgaccgtggtcaagtacaacgtggtcaagttcttgctaaaccaggttctattactcctcatactaaatttaaagctgaaatttatgctttgaaaaaagaagaaggtggtcgtcatactgctttcttaaacggttatcgtcctcaattctatttcagaacaactgatgttacaggttctattaaattaaaagatggaactgaaatggttatgcctggtgacaatactgaaatcactgtagaattaatttcaccaattgcttgtaaaaaggaagtaagttt

SEQ ID NO: 729 - DNA, 826 bp, Mycoplasma salivarium
  ref <308>: DATABASE ACCESSION NUMBER: ATCC 23064
ggagcaatcttagttgttgctgcaactgatggtgcgatgcctcaaactcgtgaacacgttttacttgcaaaacaagttggtgttcctaaaatcgttgttttcttaaacaaaatcgatatgttcaagccagaagaaagagccgaaatggttgaaatggttgaaatggacattcgtgacttattaaacaaatacgactttgatggtgacaatactcctattattgctggttcagcattaaaagcattacaaggtgatccagaatatgaaaagaatattctagaacttatggatgcagtagacacatacattgatgaacctactcgtgataaagataaaccattcttaatggctgtagaagacgtatttacaattactggtcgtggaactgttgctactggtagagtagaacgtggtacattacatctaaatgatgaagttgaaatcgttggtctacgtccaacaattaaaactgttgttactggaattgaaatgttccgtaaaaatttaaaagaagctcaagctggagataatgcaggacttttactacgtggaattgatagagatcaagtagaacgtggacaagttttggccaaaccaaaaagtattattcctcacacagaatttgaagctgctgtgtatgttctaaaagctgaagaaggtggacgtcacactccattctttgaacactataaaccacaattttactttcgtacaaccgacgttactggtggaattaaattcaaacctggacgtgaaatggttatgcctggcgaaaatgttgaatttacagttactttaattgctcctattgcagttgaagaaggaa

SEQ ID NO: 730 - DNA, 810 bp, Neisseria polysaccharea
  ref <308>: DATABASE ACCESSION NUMBER: ATCC 43768
tggtatgttccgcagcygayggycctatgcctcaaactcgcgaacacatcctgytggctcgccaagtaggygtaccttacatcatcgtrttcatgaacaaatgcgacatggttgacgatgccgagctgttggaactggttgaaatggaaatccgygacctgytgtcmagctacgacttcccmggcgacgactgcccaatcgtacaaggttctgcactgaaagctttggaaggygaygctggttacgaagagaaaatcttcgaaytggctgctgctttggacagctacatcccaactcctgagcgtgctgtggacaaacckttcytgytgcctatcgaagacgtrttctctatctctggycgyggtacmgtagtaacyggycgtgtagagcgcggtrtcatccacgttggtgacgagatygaaatcgtaggtctgaaagaaacccaaaaaaccacttgtaccggcgttgaaatgttccgcaaactgctggacgaaggtcaagcwggtgacaacgtaggcgtattgytgcgtggtaccaarcgtgaagacgtagagcgtggtcaagtattggcyaaaccaggyaccatyactccscacaccaaattcaaagcagaagtatacgtactgagcaaagaagagggtggtcgycacactccattcttcgcyaactaccgyccmcaattctacttccgtacyactgacgtaacyggtgcagttactttggaagaaggtgtagaaatggtaatgccaggtgagaacgtaaccattacygtagaactgattgcgcctatcgctaggaagaaggtctgcg

SEQ ID NO: 731 - DNA, 813 bp, Salmonella choleraesuis subsp. choleraesuis
  ref <308>: DATABASE ACCESSION NUMBER: ATCC 13076
ctggttgttgctgcgactgacggcccgatgccgcagacccgtgagcacatcctgctgggtcgtcaggtaggcgttccgtacatcatcgtgttcctgaacaaatgcgacatggttgatgacgaagagctgctggaactggttgaaatggaagttcgygaactgctgtctcagtacgacttcccgggcgacgacactccgatcgttcgtggttctgctctgaaagcgctggaaggcgacgcagagtgggaagcgaaaatcatcgaactggctggcttcctggattcttacatcccggaaccagagcgtgcgattgacaagccgttcctgctgccgatcgaagacgtattctccatctccggtcgtggtaccgttgttaccggtcgtgtagaacgcggtatcatcaaagtgggcgaagaagttgaaatcgttggtatcaaagagactcagaagtctacctgtactggcgttgaaatgttccgcaaactgctggacgaaggccgtgccggtgagaacgtaggtgttctgctgcgtggtatcaaacgtgaagaaatcgaacgtggtcaggtactggctaagccgggcaccatcaagccgcacaccaagttcgaatctgaagtgtacattctgtccaaagatgaaggcggccgtcacactccgttcttcaaaggctaccgtccgcagttctacttccgtactactgacgtgactggcaccatcgaactgccggaaggcgtagagatggtaatgccgggcgacaacatcaaaatggttgttaccctgatccacccgatcgcaatggacgacggtctgcgt

SEQ ID NO: 732 - DNA, 812 bp, Salmonella choleraesuis subsp. choleraesuis
  ref <308>: DATABASE ACCESSION NUMBER: ATCC 9184
ctggttgttgctgcgactgacggcccgatgccgcagacccgtgagcacatcctgctgggtcgtcaggtaggcgttccgtacatcatcgtgttcctgaacaaatgcgacatggttgatgacgaagagctgctggaactggttgaaatggaagttcgygaactgctgtctcagtacgacttcccgggcgacgacactccgatcgttcgtggttctgctctgaaagcgctggaaggcgacgcagagtgggaagcgaaaatcatcgaactggctggcttcctggattcttacatcccggaaccagagcgtgcgattgacaagccgttcctgctgccgatcgaagacgtattctccatctccggtcgtggtaccgttgttaccggtcgtgtagaacgcggtatcatcaaagtgggcgaagaagttgaaatcgttggtatcaaagagactcagaagtctacctgtactggcgttgaaatgttccgcaaactgctggacgaaggccgtgccggtgagaacgtaggtgttctgctgcgtggtatcaaacgtgaagaaatcgaacgtggtcaggtactggctaagccgggcaccatcaagccgcacaccaagttcgaatctgaagtgtacattctgtccaaagatgaaggcggccgtcacactccgttcttcaaaggctaccgtccgcagttctacttccgtactactgacgtgactggcaccatcgaactgccggaaggcgtagagatggtaatgccgggcgacaacatcaaaatggttgttaccctgatccacccgatcgcaatggacgacggtctgcg

SEQ ID NO: 733 - DNA, 814 bp, Salmonella choleraesuis subsp. choleraesuis
  ref <308>: DATABASE ACCESSION NUMBER: ATCC 8759
tggttgttgctgcgactgacggyccgatgccgcagacccgtgagcacatcctgctgggtcgtcaggtaggcgttccgtacatcatcgtgttcctgaacaaatgcgacatggttgatgacgaagagctgctggaactggttgaaatggaagttcgygaactgctgtctcagtacgacttcccgggcgacgacactccgatcgttcgtggttctgctctgaaagcgctggaaggcgacgcagagtgggaagcgaaaatcatcgaactggctggcttcctggattcttacattccggaaccagagcgtgcgattgacaagccgttcctgctgccgatcgaagacgtattctccatctctggtcgtggtaccgttgttaccggtcgtgtagaacgcggtatcatcaaagtgggcgaagaagttgaaatcgttggtatcaaagagactcagaagtctacctgtactggcgttgaaatgttccgcaaactgctggacgaaggccgtgcyggtgagaacgtaggtgttctgctgcgtggtatcaaacgtgaagaaatcgaacgtggtcaggtactggctaagccgggcaccatcaagccgcacaccaagttcgaatctgaagtgtacattctgtccaaagatgaaggcggccgtcatactccgttcttcaaaggctaccgtccgcagttctacttccgtactactgacgtgactggcaccatcgaactgccggaaggcgtagagatggtaatgccgggcgacaacatcaaaatggttgttaccctgatccacccgatcgcaatggacgacggtctgcgttt

SEQ ID NO: 734 - DNA, 828 bp, Salmonella choleraesuis subsp. choleraesuis
  ref <308>: DATABASE ACCESSION NUMBER: ATCC 51955
ggcgcgatcctggttgttgctgcgactgacggcccgatgccgcagacccgtgagcacatcctgctgggtcgtcaggtaggcgttccgtacatcatcgtgttcctgaacaaatgcgacatggttgatgacgaagagctgctggaactggttgaaatggaagttcgtgaacttctgtctcagtacgacttcccgggcgacgacactccgatcgttcgtggttctgctctgaaagcgctggaaggcgacgcagagtgggaagcgaaaatcatcgaactggctggcttcctggattcttacattccggaaccagagcgtgcgattgacaagccgttcctgctgccgatcgaagacgtattctccatctccggtcgtggtaccgttgttaccggtcgtgtagaacgcggtatcatcaaagtgggcgaagaagttgaaatcgttggtatcaaagagactcagaagtctacctgtactggcgttgaaatgttccgcaaactgctggacgaaggccgtgccggtgagaacgtaggtgttctgctgcgtggtatcaaacgtgaagaaatcgaacgtggtcaggtactggctaagccgggcaccatcaagccgcacaccaagttcgaatctgaagtgtacattctgtccaaagatgaaggcggccgtcatactccgttcttcaaaggctaccgtccgcagttctacttccgtactactgacgtgactggcaccatcgaactgccggaaggcgtagagatggtaatgccgggcgacaacatcaaaatggttgttaccctgatccacccgatcgcaatggacgacggtctgcgtttcgca

SEQ ID NO: 735 - DNA, 825 bp, Serratia grimesii
  ref <308>: DATABASE ACCESSION NUMBER: ATCC 14460
ggcgctatcctggttgttgctgcgactgatggcccaatgccacagacccgtgagcacatcctgctgggtcgtcaggttggcgttcctttcatcatcgtattcatgaacaaatgcgacatggttgatgatgaagagctgctggaactggtagaaatggaagttcgtgaacttctgtctgcttatgacttccctggtgatgacctgccagttgttcgtggttcagcgctgaaagcactggaaggcgaagctgagtgggaagctaaaatcatcgaactggctggctacctggattcttacatcccagaaccagagcgtgctatcgacaagccgttcctgctgccaatcgaagacgtattctccatctccggycgtggtacygtagttaccggtcgtgtagagcgcggtatcgttaaagttggcgaagaagttgaaatcgttggtatcaaagacaccgttaagtctacctgtactggcgttgaaatgttccgcaaactgctggacgaaggccgtgctggtgagaacgtaggtgttctgctgcgtggtatcaagcgtgaagacatcgaacgtggtcaggtactggctaaaccaggttcaatcaagccacacaccaaattcgactcagaagtttacatcctgagcaaagaagaaggtggtcgtcacactccattcttcaaaggctaccgtccacagttctacttccgtacaactgacgtgaccggtaccatcgaactgccagaaggcgtagagatggtaatgccaggcgataacgtgaacatggttgtaaccctgattcacccaatcgcgatggacgacggtctgcgtttc

SEQ ID NO: 736 - DNA, 798 bp, Clostridium difficile
  ref <308>: DATABASE ACCESSION NUMBER: ATCC 9689
tattagtttgttcagcaacagatggaccaatgccacaaacaagagagcatatactattatcaagacaagttggagtaccatatatagtagtattcttaaacaaatgtgacatggtagatgatgaagagttattagagttagtagagatggaagtaagagatttattaacagaatatgatttcccaggagatgacactccaatagtaagaggttcagcattaatggcattagaagatccaaagagygagtggggagataagatagtagaattattcgagcaaatagatgagtatataccagctccagagagagatacagataaaccattcttaatgccagtagaggacgtattctcaatcacaggaagaggaacagttgcaacaggaagagtggaaagaggagtactaaaagtacaagacgaagtagakttagtaggattaacagaagcaccaagaaaagtagtagtaacaggagtagagatgttcagaaaattattagaccaagcacaagcaggggataatataggagcattattaagaggagtacaaagaaacgagatagaaagaggacaagtactagcaaagactggatcagtaaaggcacacacaaagtttacagcagaagtatatgtacttaaaaaagaagarggtggaagacatacaccattctttgatggatatagaccacaattctatttcagaacaacagacgtaacaggagcttgtaagttaccagaaggaatagagatggtaatgcctggagataacgtaacaatggaagtagacttaataaactcaa

SEQ ID NO: 737 - DNA, 411 bp, Burkholderia pseudomallei
  strain 1026B
gtcaacatgatggagctcatcaacaacatcgcgaaggagcacggcggttactccgtgttcgcgggcgtgggcgagcgtacccgtgaagggaacgacttctaccacgaaatgaaggactcgaacgttctcgacaaggtcgcgctggtgtacggccagatgaacgagccgccgggcaaccgtctgcgcgtggcgctgacgggcctcacgatggccgagcacttccgtgacgaaggcctcgacgtgctgttcttcgtcgacaacatctaccgtttcacgctggccggtaccgaagtgtcggcgctgctcggccgtatgccgtcggcagtgggctatcagccgacgctggctgaagaaatgggcaagctgcaagagcgcatcacgtcgacgaagaagggctcgatcacgtcggtt

SEQ ID NO: 738 - DNA, 394 bp, Clostridium bifermentans
  ref <308>: DATABASE ACCESSION NUMBER: ATCC 638
tacaagagcttattaacaatatagctactcaacacggtggtatatcagtattcgcaggtgttggagagagaacaagagaaggtaacgacttattccatgagatgagcgatacaggagttataaataaaacagctctagtattcggacaaatgaatgagccacctggagcaagaatgagagttgctttaactggtcttacaatggctgaatacttcagagatcaacaagggcaagacgttttattattcgtagataatatattccgtttcactcaagcaggatctgaggtttctgcacttcttggacgtactccatcagcagttggataccaaccaacattagcaacagagatgggtagattacaagagagaataacatctacaaataaagggtc

SEQ ID NO: 739 - DNA, 394 bp, Clostridium beijerincki
  ref <308>: DATABASE ACCESSION NUMBER: ATCC 8260
ttaataaacaacatagctaaacaacatggtggtttatcagtatttactggagttggtgaaagatcaagagaaggtaatgacttatatcatgaaatgagagagtcaggagttattgataagacagcattagtatttggacaaatgaatgagccaccgggtgccagaatgagagttgcattaacaggtcttactatggcagagtattttagagataaaggtcaagatgtgttactattcatagataacatattcagatatactcaagcaggttcagaggtttcagcattacttggaagaacaccttcagcggttggatatcagccaacacttgcaactgaaatgggtgcacttcaggaaagaattacatcaacagttaatggttctattacgtcag

SEQ ID NO: 740 - DNA, 393 bp, Clostridium difficile
  ref <308>: DATABASE ACCESSION NUMBER: ATCC 9689
ttataaacaatattgctaagcaacatggtggtatttctgtattttcaggagtaggagaaagaacaagagaaggtaacgacctttatggcgaaatgagtgagtctggagttataaataaaacagctctagtatttggtcaaatgaatgaaccacctggagcgagaatgagagttgctttaactggacttacaatggcagaacattttagagatgagcaaggacaagacgttttacttttcgttgataatatattccgtttcacacaagctggttcagaagtttcagcacttctaggacgtatgccatcagctgttggttatcagccaacattagctactgaaatgggtgcacttcaagagagaataacatcaactaagaaaggttcaataacat

SEQ ID NO: 741 - DNA, 398 bp, Clostridium ramosum
  ref <308>: DATABASE ACCESSION NUMBER: ATCC 25582
ttgattcaagaattcattaataacattgctacagaacatggtggtttatcagtttttgctggagttggtgaacgtagccgtgaaggtaatgatttatattatgaaatgaaggaaagtggtgttttatctaaaacaacactagtatttggacagatgaatgaacccccaggagctcgtttaagagttgctttaacgggtcttactatggcagaagaattccgtgatgaacaaggtcaggatgtcttattattcatcgataatattttccgttttactcaagctggatctgaagtatctgccttacttggacgggtaccatcacaagctgggtatcagccaactttagcaaccgaaatgggtgctttacaagaacggattacatcaactaaaaaaggatc

SEQ ID NO: 742 - DNA, 380 bp, Clostridium septicum
  ref <308>: DATABASE ACCESSION NUMBER: ATCC 12964
tagctaaggaacacggtggactttcagtattcacaggtgttggagaaagatcaagagaaggtaatgatttatattacgaaatgaaagaatcaggagttatagacaagacagctctagtgtttggacaaatgaatgaatctccaggagctagaatgagagtatctttaacaggattaactatggctgaatatttcagagatcaaggtcaagatgtgcttttattcatagataacatatttagatttactcaagctggatcagaagtatcggctttacttggaagaataccatcagcagttggttatcaaccaacactagcaactgaaatgggtgcacttcaagaaagaattacttcaactaaaaatggatcaataacttca

SEQ ID NO: 743 - DNA, 389 bp, Clostridium tertium
  ref <308>: DATABASE ACCESSION NUMBER: ATCC 14573
ttaataaataatatagcaaaagagcatggtggtctttctgtatttacaggagttggagaaaggtcaagagaaggtaacgacttatattatgaaatgaaagagtcaggggttatagataagacagctttagtatttggacaaatgaatgaatcaccaggagcaagaatgagagtttcattaactggattaactatggctgaatattttagagatcaaggtcaagacgttcttttatttatagataatatatttagatttactcaagcgggatcagaagtttctgcgttattaggaagaattccttcagcagttggatatcaaccaactcttgcaactgaaatgggagcacttcaagaaagaataacatcaacaaagaatggatcaatcac

SEQ ID NO: 744 - DNA, 843 bp, Comamonas acidovorans
  ref <308>: DATABASE ACCESSION NUMBER: ATCC 15668
ttcccccgcacgcatgcccaaggtgttcgatgccctgaagctcgacggctcggccctgacgctggaagtgcagcaactgctgggtgacggcgttgtgcgtaccatcgccctgggttcgtccgacggtctgcgtcgcggcctgatggtgtccaacaccggcaaccccatcaccgtgcccgtgggcaaggcgacgctgggtcgcatcatggacgtgctgggcaatcccatcgacgaacgtggtcccgtggatcaggcgctgacggctcccatccaccgcaaggcaccggcttatgacgagctgtcgccttcgcaggaactgctggaaaccggcatcaaggtgatcgacctgatctcgcccttcgccaagggcggcaaggtgggtctgttcggtggcgccggtgtgggcaagaccgtgaacatgatggaactcatcaacaacatcgccaagggccacggtggtctgtcggtgttcgccggtgtgggtgaacgtacccgcgaaggcaatgacttctatcacgaaatgtcggacgccggcgtggtcaaccaggagtcgctgaacgactccaaggtggccatggtctacggccagatgaacgaacccccgggcaaccgtctgcgcgtggcgctgaccggcctgaccatggccgaagccttccgtgacgaaggcaaggacgtgctgttcttcgtggacaacatctaccgctacacgctggccggtaccgaagtgtccgctctgctgggtcgcatgccttccgccgtgggctaccagcccacgctggccgaggaaatgggccgcctgcaagagcgcatcacctcgaccaaggtcggttcgatcacttccac

SEQ ID NO: 745 - DNA, 819 bp, Klebsiella pneumoniae subsp. rhinoscleromatis
  ref <308>: DATABASE ACCESSION NUMBER: ATCC 13884
gccgtaccacgcgtgtacgaagcccttgaggtacagaatggtaatgaagttctggtgctggaagttcagcagcagctgggcggcggtatcgtacgtaccatcgccatgggttcttctgatggtctgcgccgcggtctggatgtaaaagacctcgagcacccgatcgaagtcccggtaggtaaagcaacgctgggtcgtatcatgaacgtactgggtcaaccggttgacatgaaaggcgacatcggcgaagaagagcgttgggctatccaccgcgcggcaccgtcctatgaagagctgtccagctctcaggaactgctggaaaccggcatcaaagttatcgacctgatgtgtccgttcgccaagggcggtaaagttggtctgttcggcggtgcgggtgtaggtaaaactgtaaacatgatggagctgatccgtaacatcgcgatcgagcactccggttactctgtgtttgcgggcgtaggtgagcgtactcgtgagggtaacgacttctaccacgaaatgaccgactccaacgttatcgataaagtatccctggtgtacggccagatgaacgagccgccgggaaaccgtctgcgcgttgcgctgaccggcctgaccatggctgagaaattccgtgacgaaggtcgtgacgtactgctgttcgtcgataacatctatcgttacaccctggccggtactgaagtatccgcgctgctgggtcgtatgccttcagcggtaggttatcagccgaccctggcggaagagatgggcgttctgcaggaacgtatcacctccaccaaaaccggttctatcacctccgta

SEQ ID NO: 746 - DNA, 824 bp, Neisseria canis
  ref <308>: DATABASE ACCESSION NUMBER: ATCC 14687
gcgattctattccgcgcgtatatgatgctcttaaactagtggatagagaactgacgcttgaagtacaacaacagttgggtgatggtgtcgttcgtactattgcgatgggtagttccgacggcctcaaacgaggtttggcggtagttaacaccggtgctccaattacagtgcctgtgggcaaagcaacattaggccgtattatggacgtattaggtaatccggttgatgaagctggtccgattggctccgagcaaacccgagcaatccaccaacctgctcctaagttcgacgagctttctagcgccacagagattttggaaacaggtattaaagtaattgatttgctttgcccgtttgccaaaggcggtaaagtaggtttgtttggtggtgcgggagtgggcaaaaccgtaaatatgatggagttgattaacaacatcgcgaaagcacacagcggtttgtctgtatttgccggtgtgggtgaacggacgcgtgaaggtaatgacttttatcatgagatgaaagattccaatgtattagataaagtagccatggtttacggtcagatgaacgagcctcccggtaaccgtttgcgcgttgcgctaactggcttgtctatggccgaattcttccgtgacgagaaagatgaaaacggtaaaggccgtgatgtattgttctttgtagacaatatttaccgctataccctagccggtacagaagtatctgcattgcttggccgtatgccttcggcagtaggttatcagccgacgttggcagaggaaatgggccgcttgcaagagcgtattacytcamcccaaacaggctct

SEQ ID NO: 747 - DNA, 831 bp, Neisseria cinerea
  ref <308>: DATABASE ACCESSION NUMBER: ATCC 14685
cgcgacgctatcccgcatgtttacgatgccctgaaattggacgagaacggtctgactctggaggttcaacagcttctgggcgacggcgttgtccgtactattgcaatgggtagttcagacggccttaaacgcggtatgtctgtaagcaatactggtgcgccaatcactgtgccggtaggtaaaggtacattgggtcgtattgtcgacgtattgggtacgcctgttgatgaagcaggtccgatcgataccgacaaaagccgtgccattcaccaaactgctccgaaattcgacgagttgtcttcagctaccgaattgttggaaaccggtattaaagtgatcgacttgctgtgtccgtttgctaaaggcggtaaagtaggtctgttcggtggtgccggtgtgggcaaaaccgtgaacatgatggaattgatcaacaacatcgccaaagcgcacagcggtctgtccgtgttcgcaggtgtgggtgagcgtacccgtgaaggtaacgacttctaccacgagatgaaagattccaacgtattggataaagtagccatggtgtatggccaaatgaacgaacctccgggcaaccgtctgcgcgttgctttgaccggtttgactatggccgaatacttccgtgacgaaaaagacgaaaacggtaaaggccgcgacgtattgttcttcgttgacaacatctaccgttacactttggccggtactgaagtatctgcactgttgggccgtatgccttctgcagtgggttaccaaccgacattggctgaagaaatgggtcgtttgcaagagcgtattacctctacccaaaccggttccattact

SEQ ID NO: 748 - DNA, 862 bp, Neisseria cuniculi
  ref <308>: DATABASE ACCESSION NUMBER: ATCC 14688
ccgtggccaagtaccacaaatttatgacgcactgagtgttgatggcaccgaaacaaccttggaagttcaacagcagttgggtgatggcgtggtgcgtaccattgcgatgggttcaaccgaaggcttgaagcgtggtttgactgtatctaactctggtgcaccgatttctgtgccagtgggtcaagcgactttgggtcgtattatggatgtgttgggtcgtccaatcgacgaggcaggtcctgtaaatgctcaagaaaaatggtcaattcaccgtgaagcaccaagctatgatgagcaatcaaactcaactgagctgctagaaacaggcatcaaagtaattgatttgctttgcccatttgctaaaggtggtaaagttggcttgttcggtggtgcaggtgtgggtaaaaccgtgaatatgatggagctgattaataatatcgctctgaagcattcaggtctttctgtttttgcaggtgttggtgagcgtactcgtgagggtaacgatttttatcacgaaatgcaagaagcaggcgttgttaataccgaagacttcaccaagtcaaaagtagcgatggtttatggtcagatgaatgagccaccaggaaaccgtttgcgtgttgcattgacaggcttgacgatggcagaatatttccgtgacgaaaaagatgaagcaacaggcaaagggcgtgatgttctattgttcgttgataacatctatcgttacacactggctggtacggaagtgtcagcacttctaggtcgtatgccatcagcagtaggttatcaaccgactctggctgaagaaatgggtgcgttgcaagagcgtattacctcaacgcaatcgggttcgatcacttcgggg

SEQ ID NO: 749 - DNA, 844 bp, Neisseria elongata subsp. elongata
  ref <308>: DATABASE ACCESSION NUMBER: ATCC 25295
ggaactcccacgtgacgctatcccgcatgtttttgatgcattaaaattagttgaaaatgacctaaccttagaagttcaacaacttttgggggatggtgtagtgcgtaccattgcgatgggtagttcagatggattaaagcgtggtatggctgtgaataataccggagctccgattactgttcctgttggccgtgaaactttgggtcgtatcatggatgtattgggtaatccggttgatgaggcaggtccggtaaatgcatccaatacacgtgcgatccatcaagaggctcctaagtttgatgagctttcttcaacaacggaattattagaaactggcattaaggttatcgacttgttatgtccgtttgccaaaggtggtaaagtaggtctgtttggtggtgcgggtgtaggtaaaaccgtaaatatgatggagttaattaacaacattgccaaggcacatagcggtttgtctgtgtttgcaggcgtgggtgaacgtactcgtgaaggtaatgacttctatcacgagatgaaagattccaacgtattggacaaagtggcaatggtttacggtcagatgaacgaacctccaggcaaccgtctgcgcgttgctttgaccggtttgactatggccgaatacttccgtgacgaaaaagacgaaaacggtaaaggtcgcgacgtattgttcttcgtggacaacatttaccgttacactttggccggtacggaagtatccgcattgctgggtcgtatgccttcagcagtaggttaccaaccgacattggctgaagaaatgggtcgtttgcaagagcgtattacctctacccagacaggctctattacttcc

SEQ ID NO: 750 - DNA, 834 bp, Neisseria flavescens
  ref <308>: DATABASE ACCESSION NUMBER: ATCC 13120
cgcgacgctattccgcatgtttacgatgccctgaaattggacgagaacggtctgactctggaagttcaacagcttctgggtgacggcgttgtccgtactattgcaatgggtagttcagacggcctgaaacgcggcatgtctgtaagcaataccggtgcgccaatcactgtgccggtaggtaaaggtacattgggccgtattgtcgacgtattgggtacgcctgttgatgaagcaggtccgatcgataccgacaagagccgtgccattcaccaaactgctccgaaattcgatgagttgtcttcaactaccgaattgttggaaaccggtattaaagtgatcgacttgctgtgtccgtttgctaagggcggtaaagtaggtctgttcggtggtgccggtgtgggcaaaaccgtgaacatgatggaattgatcaacaacatcgccaaagcgcacagcggcctgtccgtgttcgcaggtgtgggtgaacgtacccgtgaaggtaacgacttctaccacgagatgaaagattccaacgtattggataaagtagccatggtgtatggtcaaatgaacgaacctccaggcaaccgtctgcgcgttgctttgaccggtttgactatggccgaatacttccgtgacgaaaaagatgaaaacggtaaaggtcgcgacgtattgttcttcgttgacaacatctaccgttacactctggccggtaccgaagtatccgcactgttgggtcgtatgccttctgcagtgggttaccaaccgacattggctgaagaaatgggtcgtttgcaggagcgtattacttctacgcaaaccggttccattacttcc

SEQ ID NO: 751 - DNA, 834 bp, Neisseria gonorrhoeae
  ref <308>: DATABASE ACCESSION NUMBER: ATCC 31426
cgcgacatgattccgcgcgtttacgacgctttgaaattagacgaaaacggtctgactttggaagtccaacagcttttgggtgatggcgtagtccgtaccatcgctatgggcagctcggacggtttgaaacgcggcatgactgtgagcaatactggttcgcccattactgtgccggtaggtaaaggtacgttgggacgcattgtcgatgtattgggaactcctgttgacgaggcaggtccaattgataccgacaagagtcgtgccatccaccaagccgctcctaagtttgacgaactgtcttccacaaccgaattgctcgaaacgggcattaaagtgattgacttgctgtgtccgtttgccaaaggcggtaaagtaggtctgttcggcggtgccggtgtgggtaaaaccgtgaacatgatggaattgatcaacaacatcgccaaagcgcacagcggcttgtccgtgttctcaggcgtgggtgagcgtacccgcgaaggtaacgacttctaccacgagatgaaagattccaacgtattggataaagtagccatggtgtatggccaaatgaacgaacctccaggcaaccgtctgcgcgttgctttgaccggtttgactatggctgaatacttccgtgacgaaaaagacgaaaacggtaaaggtcgtgacgtattgttcttcgttgacaacatctaccgttacactctggccggtaccgaagtatccgcactgttgggccgtatgccttctgcagtgggttaccaaccgacattggctgaagaaatgggtcgtttgcaagagcgtattacctctacccaaaccggttccattacttcc

SEQ ID NO: 752 - DNA, 825 bp, Neisseria gonorrhoeae
  ref <308>: DATABASE ACCESSION NUMBER: ATCC 27628
acatgattccgcgcgtttacgacgctttgaaattagacgaaaacggtctgactttggaagtccaacagcttttgggtgatggcgtagtccgtaccatcgctatgggcagctcggacggtttgaaacgcggcatgactgtgagcaatactggttcgcccattactgtgccggtaggtaaaggtacgttgggacgcattgtcgatgtattgggaacgcctgttgacgaggcaggtccaattgataccgacaagagtcgtgccatccaccaagccgctcctaagtttgacgaactgtcttccacaaccgaattgctcgaaacgggcattaaagtgattgacttgctgtgtccgtttgccaaaggcggtaaagtaggtctgttcggcggtgccggtgtgggtaaaaccgtgaacatgatggaattgatcaacaacatcgccaaagcgcacagcggcttgtccgtgttctcaggcgtaggtgagcgtacccgcgaaggtaacgacttctaccacgagatgaaagattccaacgtattggataaagtagccatggtgtatggccaaatgaacgaacctccaggcaaccgtctgcgcgttgctttgaccggtttgactatggctgaatacttccgtgacgaaaaagacgaaaacggtaaaggtcgtgacgtattgttcttcgttgacaacatctaccgttacactctggccggtaccgaagtatccgcactgttgggccgtatgccttctgcagtgggttaccaaccgacattggctgaagaaatgggtcgtttgcaagagcgtattacctctacccaaaccggttccatta

SEQ ID NO: 753 - DNA, 831 bp, Neisseria lactamica
  ref <308>: DATABASE ACCESSION NUMBER: ATCC 23970
gatgcgattccgcatgtttacgatgccctgaaattggacgagaacggtctgaccctggaagtccaacagcttttgggtgacggcgttgtccgtactattgcaatgggtagttcagacggcctgaaacgcggcatgtctgtcagcaataccggtgcgccaatcactgtgccggtaggtaaaggtacgttgggccgtattgtcgacgtattgggtacacctgttgacgaagcaggtccgatcgataccgacaagagccgcgccatccaccaaaccgccccgaaattcgacgagttgtcttcaactaccgaattgttggaaaccggcattaaagtgatcgatttgctgtgtccgtttgctaagggcggtaaagtaggtctgttcggtggtgccggtgtgggcaaaaccgtgaacatgatggaattgatcaacaacatcgccaaagcgcacagcggtctgtccgtgtttgcaggcgtgggcgagcgtacccgcgaaggtaacgacttctaccacgagatgaaagattccaacgtattggataaagtagccatggtgtatggtcagatgaacgaacctccgggcaaccgtctgcgcgttgctttgaccggtttgacgatggccgaatacttccgcgacgaaaaagacgaaaacggcaaaggccgcgacgtattgttcttcgtggacaacatctaccgttacaccctggccggtaccgaagtatccgcactgttgggccgtatgccttccgcagtgggttaccaaccgacattggctgaagaaatgggtcgtttgcaagagcgtattacctctacccaaaccggttccattacttcc

SEQ ID NO: 754 - DNA, 836 bp, Neisseria meningitidis
  strain 2241C
ccacgcgacatgattccgcgcgtttacgacgctttgaaattagacgaaaacggtctgactttggaagtccaacagcttttgggcgacggcgtagtccgtaccattgcgatgggcagctcggacggtttgaaacgcggcatgactgtgagcaataccggtgcgcccattactgtgccggtaggtaaaggtacgttgggacgcattgtcgatgtattgggaacgcctgttgacgaggcaggtccaatcgataccgacaagagccgtgccatccaccaagccgctcctaagtttgacgaactgtcttccacaaccgaattgctcgaaacgggcattaaagtgattgacttgctgtgtccgtttgccaaaggcggtaaagtaggtctgttcggcggtgccggtgtgggtaaaaccgtgaacatgatggaattgatcaacaacatcgccaaagcgcacagcggcttgtccgtgttcgcaggcgtgggtgagcgtacccgcgaaggtaacgacttctaccacgagatgaaagattccaacgtattggataaagtggcaatggtttacggtcagatgaacgaacctccgggcaaccgtttgcgcgtcgcattgaccggtttgaccatggcggaatacttccgtgacgaaaaagacgaaaacggcaaaggccgcgacgtattgttcttcgtggacaacatctaccgttacactctagctggtaccgaagtatccgcattgttgggccgtatgccgtctgcagtgggctaccaaccgacattggcagaagaaatgggtcgtttgcaggagcgtattacctctacccaaaccggttctattacttc

SEQ ID NO: 755 - DNA, 837 bp, Neisseria mucosa
  ref <308>: DATABASE ACCESSION NUMBER: ATCC 19696
ccgcgtgatgccattccgcgtgtttacgacgccctgaaattggatgcaaacggcctgactttggaagtgcaacagcttctgggtgacggcgtagttcgtactattgcaatgggtagttcggatggtttgaaacgcggcatgactgtaagcaatacaggtgcgccgattacagtaccggtaggtaaaggtactttgggacgtattgtcgatgtattgggtacgcctgttgacgaagcaggtccgattgataccgacaaacaccgtgccatccatcagacagctccgaaatttgatgaactgtctgcgactactgagctgctggaaaccggcattaaagtgattgacttgctgtgtccgtttgccaaaggcggtaaagtaggtctgttcggtggtgccggtgtaggcaaaaccgtcaacatgatggaattaattaacaacatcgccaaagcacatagcggtttgtccgtgtttgcaggtgtgggtgagcgtacccgtgaaggtaatgacttctaccacgagatgaaagattccaacgtattggacaaagtggcgatggtttacggtcagatgaacgaacctccgggtaaccgtctgcgtgtagccttgaccggtttgacgatggccgaatacttccgtgatgaaaaagacgaaagcggcaaaggccgtgacgtattgttcttcgtggacaatatctaccgttacaccctggccggtaccgaagtatccgcattgttgggtcgtatgccttcagcagtaggttaccaaccgacattggctgaagaaatgggtcgtttgcaagagcgtattacctctacccaaacaggctccattacctcc

SEQ ID NO: 756 - DNA, 834 bp, Neisseria subflava
  ref <308>: DATABASE ACCESSION NUMBER: ATCC 14221
cgcgacgctatcccgcatgtttacgatgccctgaaattggacgagaacggtctgactctggaagttcaacagcttctgggtgacggcgttgtccgtactattgcaatgggtagttcagacggcctgaaacgcggcatgtctgtaagcaatactggtgcgccaatcactgtgccggtaggtaaaggtacattgggtcgtattgtcgacgtattgggtacgcctgttgatgaagcaggtccgatcgataccgacaagagccgtgccattcaccaaactgctccgaaattcgacgagttgtcttcaactaccgaattgctggaaaccggtattaaagtgatcgacttgctgtgtccgtttgctaagggcggtaaagtaggtctgttcggtggtgccggtgtgggcaaaaccgtgaacatgatggaattgatcaacaacatcgccaaagcgcacagcggtctgtccgtgttcgcaggtgtgggtgaacgtacccgtgaaggtaacgacttctaccacgagatgaaagattccaacgtattggataaagtagccatggtgtatggccaaatgaacgaacctccgggcaaccgtctgcgcgttgctttgaccggtttgactatggccgaatacttccgtgacgaaaaagacgaaaacggtaaaggtcgcgacgtattgttcttcgttgacaacatctaccgttacactctggccggtaccgaagtatctgcactgttgggccgtatgccttctgcagtgggttaccaaccgacattggctgaagaaatgggtcgtttgcaagagcgtattacctctacccaaactggttccattacttcc

SEQ ID NO: 757 - DNA, 833 bp, Neisseria weaveri
  ref <308>: DATABASE ACCESSION NUMBER: ATCC 51223
cccgtgatgctattcccatgtatacgatgccctgaaattggtagataacgatctgaccctggaagtgcaacaacttttaggtgatggtgtggttcgtaccattgcaatgggtagttcagacggcctaaaacgtggtatggctgttaacaataccggcgctccgattactgttccggtggggaaagccaccttgggacgtattatggatgtgttgggtaatccggttgatgaagcaggtcctgttgtatcagaagaaactcgcgctattcatcaagctgcccctaaatttgacgaactgtcttcagcaactgagttgttggaaacaggcattaaagtaattgacttgctgtgcccgtttgccaaaggtggtaaagtaggtttgtttggtggtgccggcgtgggtaaaaccgtaaatatgatggagttgatcaacaacatcgcgaaggcacatagtggtttgtctgtattcgccggtgtaggtgagcgtacccgtgaaggtaacgacttctaccatgaaatgaaagactctaacgtattggataaagtagccatggtttatggccagatgaatgaacctccgggtaaccgtttgcgcgttgctttgactggtttgactatggccgaatatttccgtgacgagaaagatgaaaacggcaaaggtcgtgacgtcttgttctttgtggataatatctatcgctatactctggccggtactgaagtgtctgcactgttaggtcgtatgccgtctgcagtaggttatcagcctacattggcagaagaaatgggtcgcttgcaggagcgtattacttctactcaaacaggttcgattactt

SEQ ID NO: 758 - DNA, 833 bp, Neisseria animalis
  ref <308>: DATABASE ACCESSION NUMBER: ATCC 19573
cgcgatgccattcctcacgtttacgatgccctgaaattggacgacaccggtctgactttggaagtacaacaacttctgggcgacggtgtggtacgtaccattgcaatgggtagttcagacggcctgaaacggggtttgtctgtgagcaataccggttctccgattgccgttcctgtcggtaaagcgactttgggtcgtattatggacgtattgggcaatccggttgatgaagccggtccggttgctaccgaagagaaacgtgctattcaccaagccgcaccgaagtttgatgaattgtcatcagctaccgagttgttggaaaccggtattaaagtaatcgacttgctgtgtccgtttgcaaaaggcggtaaagtaggtctgttcggcggtgccggtgtgggcaaaaccgtaaacatgatggaattgatcaacaacatcgccaaagcacacagcggtctgtctgtgtttgccggtgtaggtgaacgtacccgcgaaggtaacgacttctaccacgagatgaaagattccaacgtgttggataaagtagccatggtgtacggtcagatgaatgagccgccgggcaaccgcttgcgcgtggctttgaccggcctgactatggccgaatacttcgtgacgaaaaagacgaaaacggcaaaggtcgtgacgtattgttcttcgtggacaacatttaccgctacacactggccggtaccgaagtatcagcattgttgggccgtatgccgtctgcagtaggttatcagccgacattggcagaggaaatgggtcgcttgcaagagcgtattacctctacccaaaccggttcgattacctct

SEQ ID NO: 759 - DNA, 819 bp, Proteus penneri
  ref <308>: DATABASE ACCESSION NUMBER: ATCC 33519
agcgtccctaaagtatacgacgctcttgaggttatgaatggtaaagaaaaactggtgctggaagttcagcaacagttaggcggtggtatcgttcgttgtatcgcaatgggtacatcagacggtttaagccgtggcttaaaagttgaagatttaggccacccaattgaagtaccagtaggtaaagcaacactgggacgtatcatgaacgttctgggtacacctattgatatgaaaggtgatattgcaactgaagaacgttggtctattcaccgtgaagcaccaacctacgaagagttatcaaactcacaagaactgcttgaaaccggtatcaaagtaatggacttaatctgtccgtttgctaaaggtggtaaagtaggtctgttcggtggtgcgggtgtgggtaaaacagttaacatgatggaattgatccgtaatatcgcgatcgagcactcaggttactctgtatttgctggtgttggtgagcgtactcgtgagggtaacgacttctatcatgaaatgacagattctaacgttcttgacaaagtatcgttagtttatggtcagatgaatgagccaccaggaaaccgtctgcgtgtagcactgactggtctgactatggctgaaaaattccgtgatgaaggccgtgacgtactgttattcgtcgataacatttatcgttacaccttagccggtacagaagtatcagcactgttaggtcgtatgccatcagcggtaggttaccagccaacattggctgaagagatgggtgttctgcaagaacgtatcacttcaaccaaaacaggttcaatcacctctgta

SEQ ID NO: 760 - DNA, 819 bp, Salmonella choleraesuis subsp. choleraesuis
  ref <308>: DATABASE ACCESSION NUMBER: ATCC 13076
gccgtaccacgcgtgtacgatgcccttgaggtgcagaatggtaatgagaagctggtgctggaagttcagcagcagcttggcggcggtatcgtgcgtaccatcgcgatggggtcttctgacggtctgcgtcgcggtctggatgtaaaagatctcgaacacccgatcgaagtcccggtaggtaaagccacgctgggtcgtatcatgaacgtcctgggcgaaccggtcgacatgaaaggcgagatcggcgaagaagagcgttgggcgattcaccgcgcagcaccttcctacgaagagttgtcaaactctcaggaactgctggaaaccggtatcaaagttatcgacctgatgtgtccgttcgcgaagggcggtaaagtcggtctgttcggtggtgcgggtgtaggtaaaaccgtaaacatgatggagcttattcgtaacatcgcgatcgagcactccggttactcagtgtttgcgggcgtaggggaacgtactcgtgagggtaacgacttctaccacgaaatgaccgactccaacgttatcgataaagtatccctggtgtatggccagatgaacgagccgccgggaaaccgtctgcgcgttgcactgaccggcctgaccatggcggagaaattccgtgacgaaggtcgtgacgtactgctgttcgtcgataacatctatcgttacaccctggccggtacggaagtatccgcactgctgggccgtatgccttccgcagtaggttaccagccgactctggcggaagagatgggcgttctgcaggaacgtatcacctccaccaaaaccggttctatcacctccgta

SEQ ID NO: 761 - DNA, 812 bp, Yersinia pestis
  strain KIM D27
accaaaagtgtacaacgcccttgaggtagaaggtacaactgaaaagttagtgctggaagttcagcaacagttgggcggtggtgttgttcgttgtatcgcaatgggctcttccgatggtctgagccgtgggttgaaagtaaccaacctagaacacccgatcgaagtaccggttggtaaagcgacccttggccgtatcatgaacgtattgggtgaaccaatcgacatgaaaggtcctatcggtgaagaagagcgttgggcaatccatcgcgaagcgccttcttatgaagagcttgctagctcacaagatctgttagaaaccggtatcaaggttatggacctgatttgtccgtttgctaagggcggtaaagtcggtctgttcggtggtgcgggtgtaggtaaaacagtaaacatgatggagctgatccgtaacatcgcgatcgagcactctgggtattctgtatttgccggtgtaggtgagcgtacccgtgagggtaatgacttctaccatgaaatgactgactccaacgttttggacaaagtatccttggtttacggccagatgaatgagccaccaggtaaccgtctacgcgttgcactgaccggcctgaccatggcggagaaattccgtgatgaaggtcgtgacgtactgctgtttatcgataatatctatcgttataccctagctggtacggaagtatccgcattgctgggtcgtatgccatcagcggtaggttatcagccaacactggctgaagagatgggtgtgttgcaggaacgtattacttccactaagacgggttcaatcacctctg

SEQ ID NO: 762 - DNA, 408 bp, Burkholderia mallei
  strain GB8
cgacgtgatcgagcccttcttcgtcgacgtgatgcgctcttgcagcttgcccatttcttcagccagcgtcggctgatagcccactgccgacggcatacggccgagcagcgccgacacttcggtaccggccagcgtgaaacggtagatgttgtcgacgaagaacagcacgtcgaggccttcgtcacggaagtgctcggccatcgtgaggcccgtcagcgccacgcgcagacggttgcccggcggctcgttcatctggccgtacaccagcgcgaccttgtcgagaacgttcgagtccttcatttcgtggtagaagtcgttcccttcacgggtacgctcgcccacgcccgcgaacacggagtaaccgccgtgctccttcgcgatgttgttgatgagctccatcatgttgac

SEQ ID NO: 763 - DNA, 400 bp, Clostridium sordellii
  ref <308>: DATABASE ACCESSION NUMBER: ATCC 9714
gaacttataaacaacatagctactcaacatggtggtatatcagtattcgcaggtgttggagagagaacaagagaaggtaacgacctttacggagaaatgagtgagtctggagttataaacaagacagctctagtattcggacaaatgaatgagccacctggagcaagaatgagagttgctttaactggtcttacaatggctgaatatttcagagatcaagaaggacaagacgttttattattcgtagataatatattccgtttcactcaagcaggatctgaggtttctgcacttcttggacgtactccatcagcagttggataccaaccaacattagctacagagatgggtagattacaagagagaataacatctacaaataaagggtctataacatcag

SEQ ID NO: 764 - DNA, 405 bp, Clostridium novyi
  ref <308>: DATABASE ACCESSION NUMBER: ATCC 19402
ttaattcaagaattaatcaacaatatagcgaaggaacacggtggattatctgtatttacaggagttggagaaagaacaagagaaggtaatgacctttactatgaaatgaaagaatctggtgttataaataaaacagcactagtatttggtcaaatgaatgagccacctggagcaagaatgagagttgctcttacaggacttactatggcagaatatttcagggatcaaggacaaaacgtacttttattcatagacaacatatttagattcactcaagcaggttcagaggtgtcagctttacttggaagaatacctagtgccgttggataccaaccaacactagcaacagaaatgggtgcgcttcaagaaagaataacatctacaaagcatggttctataacatca

SEQ ID NO: 765 - DNA, 393 bp, Clostridium botulinum
  strain 20:3.1
aattaataaataacatagctaaagaacatggtggattatcagtgtttactggagttggagaaagatctagagaaggtaatgatctttatcatgaaatgagagaatcaggcgttatagataaaaccgcattagtatttggtcaaatgaatgagccacctggtgctagaatgagagttgcattaacagggttaactatggctgaatattttagagataaaggtcaagatgtattactatttatagataatatatttagatttactcaagctggatcagaagtttcagcattacttggaagaataccatcagcagttggttaccaaccaactttagcaactgaaatgggtgcacttcaagagagaattacatcaactaagaatggttctataacat

SEQ ID NO: 766 - DNA, 399 bp, Clostridium histolyticum
  ref <308>: DATABASE ACCESSION NUMBER: ATCC 19401
aggaacttataaataatattgcaaaacaatatggaggtctatctgtatttacaggtgttggtgaaagaacaagagaaggtaatgacctatataatgaaatgaaagattctggggttatagagaaaactgcactagtatttggacagatgaatgaaccaccaggagcgagaatgagagtagcattgacaggacttactatggcagaatattttagagatcaagggcaagatgtacttttatttatagataatatatttagatttacgcaggctggttctgaagtttctgcattgttaggaagaattccaagtgcagttggatatcaaccaacccttgcaactgaaatgggtgcattacaagaaagaataacatccacaaaaaatggatcaattacttcag

SEQ ID NO: 767 - DNA, 390 bp, Peptostreptococcus prevotii
  ref <308>: DATABASE ACCESSION NUMBER: ATCC 9321
catgatggaactgatccgtaacatcgccatcgagcacagcggttattccgtgttcgccggtgtgggtgagcgtactcgtgagggtaacgacttctaccacgagatgaaggactccaacgttctggacaaagtggcactggtctacggtcagatgaacgagccgccgggtaaccgtctgcgcgtagcactgactggcctgaccatggccgagaagttccgtgacgaaggtaacgacgttctgttgttcgtcgacaacatctaccgttacaccctggccggtactgaagtatccgcactgctgggccgtatgccttcggcagtaggttaccagccgaccctggctgaagagatgggcgttctgcaagaacgtatcacttcgaccaaggaagg

SEQ ID NO: 768 - DNA, 953 bp, Absidia corymbifera
  ref <308>: DATABASE ACCESSION NUMBER: ATCC 46775
aggtcttgttcgtggcaaaaggtcattgacactggtgctcctatcaccattcctgttggtaacgaagtccttggtcgtatcattaacgtcattggtgagcccattgatgagcgtggtccyatcaagtccaaggccactcgtgctatccacgctgatgctcccgagttcgttgatcaatcccccactcccgagattctcgagactggtatcaaggttgtcgatttgcttgctccctatgctcgtggtggtaagattggtcttttcggtggtgccggtgtcggcaagactgtcttgattcaagaattgatcaacaacattgccaaggctcacggtggttactctatcttctgtggtgtcggtgaacgtactcgtgaaggcaacgatttgtaccacgaaatgatttccactggtgtcatcaagcttgaaggtgaatccaagtgtgctcttgtctttggtcaaatgaacgaaccccccggagctcgtgcccgtgttgccttgactggtttgaccattgccgaatacttccgtgatgaggaaggtcaagatgtgttgctcttcattgacaacattttccgtttcactcaagccggttctgaagtgtccgctttgcttggtcgtattccctctgctgtcggttaccaacccactctytccactgatatgggtggtatgcaagagcgtattactaccaccaagaacggttccattacctccgtgcaagctgtctacgtccctgctgacgatttgactgatcctgctcctgctactacttttgctcacttggacgccaccactgtgttgtctcgttccattgctgagttgggtatctaccctgctgtcgatccccttgactccaagtcccgtatcttggatccccgtatcgttggtgatgagcactactctgttgccactggtgtccaacaaatccttcaaaactacaagtcgcttcaaga

SEQ ID NO: 769 - DNA, 1343 bp, Alternaria alternata
  ref <308>: DATABASE ACCESSION NUMBER: ATCC 62099
cgcggttccaaggccaccgacaccggtgcccccatcaagattcccgttggtcacggtacccttggtcgtatcatgaacgtcactggtgaccccattgacgagcgtggtcccatcaaggccaccaagtacgctcccatccacgccgaccccccggagttcaccgagcaatccacctccgctgaggtcctcgttaccggtatcaaggttgtcgacctgttggctccttacgctcgtggtggaaagattggtctcttcggaggtgctggtgtcggaaagactgtcttcattcaggagctgattgtaaggagacacactgtctactggctgagcattagctaacggcaggcagaacaacatcgccaaggcccacggtggtttctctgtcttcactggtgtcggtgagcgtacccgtgagggtaacgatctgtaccacgagatgcaggagacttccgtcattcagcttgacggtgactccaaggtcgccctcgtcttcggtcagatgaacgagcccccgggtgcccgtgcccgtgtcgctcttactggtcttactgttgctgagtaagtcttgaattcactgtgttgacaacgtcgtggctaatgggaaaaaagatacttccgtgacgaagagggacaggatgtgcttctcttcatcgacagtaagtgcttgtacgaactgcctgtgagacatacactgacttcggcaatagacattttccgtttcacccaggccggttccgaggtgtccgctcttcttggtcgtatcccctctgccgtcggttaccagcccaccctcgccattgacatgggtgtcatgcaggagcgtattaccaccaccaccaagggttccatcacctccgtccaggccgtctacgtgcccgctgacgatttgactgaccctgcccccgccaccaccttcgcccatttggacgccaccactgtcttgtcccgtggtatctccgagttgggtatctaccccgccgtcgaccctcttgactccaagtcccgtatgttggacccccgtgtcattggtcaggaccactacgacaccgccacccgcgttcagcagattctccaggagtacaagtcgctccaggatatcattgccattctcggtatggacgagttgtcggaagctgacaagcttaccgtcgagcgtgcccgtaagatccagcgtttcttgagccagcctttcgctgtcgcccaggtcttcactggtattgagggcaagcttgtcgacctcaaggacaccatccgatcattcaaggctatcttgactggtgagggtgacgaccttcccgagggtgagtctcgactatctccgcattcatagcgtataactgaca

SEQ ID NO: 770 - DNA, 480 bp, Aspergillus flavus
  ref <308>: DATABASE ACCESSION NUMBER: ATCC 26947
ttcaggagttgattgtatgttcacctgcaacataagacttcccattctccactcttttctaactcttcacagaacaacattgccaaggctcacggtggttactctgtcttcactggtgtcggtgagcgtacccgtgagggtaacgatctgtaccacgaaatgcaggagactggtgtcattcagctcgagggtgaatctaaggtcgcccttgtcttcggtcagatgaacgagcccccaggtgcccgtgcccgtgtcgcccttaccggtctgaccatcgccgagtacttccgtgacgaggaaggtcaggatgtgctgctcttcattgacaacattttccgtttcacccaggccggttctgaggtgtctgcccttcttggtcgtatcccctccgctgtcggttaccagcccactctggccgtcgacatgggtggtatgcaggagcgtattaccaccaccaccaagggttccattacctccgtc

SEQ ID NO: 771 - DNA, 1174 bp, Mucor circinelloides
  misc_feature (1)...(1174): n=a,t,c or g
  ref <308>: DATABASE ACCESSION NUMBER: ATCC 38592
ctcgaacaagayaacttgccygccattttgaacgcccttgaagtcaaggaycactctggtggacgtctcgtyctcgaagtctctcaacatttgggtgagaacactgtccgtactattgctatggatggtactgaaggtaagttatgtycatcccannggatacagtcaracagmaatgtctagtggttatagcagyagcagatgattgaccaatatgttaggtcttgtccggtggtcaaaaggttgttgacactggtgctcccattaccatccccgttggtaaggaagtccttggtcgtatcatcaacgttattggtgaacccattgatgaacgtggtcccattgacgccaagactcaccgtcctattcacgctgaagctcccgaattcgttgatcaatcccccactcccgaaatcctcgagactggtatcaaggtygtcgatttgttggctccttatgctcgtggtggtaagattggtctcttcggtggtgctggtgtcggtaagactgtcttgattcaagaattgattaacaacatygccaaggctcacggtggttactctatcttctgtggtgtcggtgaacgtactcgtgagggtaacgatttgtaccatgaaatgattgaaaccggtgtcattcaattggaaggcgagtccaagtgtgctctcgtctttggtcaaatgaacgaacccccaggtgctcgtgcccgtgtcgctttgactggtttgactattgctgaatacttccgtgatgatgagggtcaagatgtcttgcttttcattgataacattttcagattcactcaagctggttctgaggtatctgcccttttgggtcgtattccttccgctgtcggttaccaacccactctttccacygatatgggtggtatgcaagagcgtattactaccaccaagaacggttccattacctccgtccaagctgtctacgtccctgctgatgatttgaccgatcctgctcctgccaccacttttgctcacttggatgccaccactgtcttgtctcgttccatcgctgaattgggtatctaycccgctgtcgatcctcttgattccaagtctcgtatcctcgatccccgtattgtcggtgatgagcactacaaggttgccactgaagttcaacaaatcctccaaaactacaagtctctccaaga

SEQ ID NO: 772 - DNA, 467 bp, Piedraia hortai
  ref <308>: DATABASE ACCESSION NUMBER: ATCC 24292
aggagcttatcaacaacatcgccaaggctcacggtggttactccgtcttcactggtgtcggtgagcgtactcgtgagggtaacgatttgtaccacgagatgcaagagacttccgtcattcagcttgacsgcgagtccaaggtcgctctcgtgttcggtcagatgaacgagcccccgggtgcccgtgcccgtgttgccctgactggtcttaccatcgctgagtacttccgtgatgccgagggtcaggatggtaagttctataactcttgtcgcaaaggtttcattctggtcgctaacttgctcagtgctcctgttcatcgacaacattttccgtttcacccaggctggtatggaggtgtctgccctcctcggtcgtattccttctgccgtcggttaccaacctactctcgccgtcgacatgggtggtatgcaagagcgtattaccactaccaagaagggatccattac

SEQ ID NO: 773 - DNA, 578 bp, Pseudallescheria boydii
  ref <308>: DATABASE ACCESSION NUMBER: ATCC 44331
ttgccaaggcccacggtggttactctgtcttcactggtgtcggtgagcgtacccgtgagggtaacgatctgtaccacgaaatgcaggaaacctccgtcattcagcttgatggcgagtccaaggtcgcgcttgtcttcggtcagatgaacgagccccctggtgcccgtgctcgtgtcgctcttactggtcttaccgttgccgagtacttccgtgatgaggagggtcaggatggtaagttatatcgtttttattatcttctttgccaccacccctctacgaatccatgcctccgttggtgaaggcatcgtttgtagggcgggtcggagtttgcggcaatttctgccgtcggcttgaagccgcggatgcccgatgtttgacgcgtatcgatgctaacaacaatgacaacagtgcttctcttcattgacaacattttccgattcacccaggccggttccgaggtgtctgcccttctcggtcgtattccctctgccgtcggttaccagcccactcttgccgtagacatgggtgccatgcaggaacgtattaccaccaccaagaagggttcgattacctccgtc

SEQ ID NO: 774 - DNA, 1123 bp, Rhizopus oryzae
  ref <308>: DATABASE ACCESSION NUMBER: ATCC 56015
aacttaccygctatcttgaacgctctcgaagtccaagatcactctggtggacgtcttgtccttgaagttcgctcaacacttgggtgaaaatactgtccgtactattgctatggatggtactgaaggtaagctatactataaccgtkttatccgagtatgatattaacttgaaaaaaggtctcgtycgtggtcaaaaggttattgacactggtgctcccattaccattcctgytggtaaggaagttctcggtcgtatcattaacgtcattggtgaacccatcgatgaacgtggtcctatcaacgccaagagccaacgtcccattcacgccgaagctcccgaattcgttgaccaatctcctactcccgaaattcttgaaactggtatcaaggttgtcgacttgttggctccttatgctcgtggtggtaagattggtcttttcggtggtgctggtgtcggtaagactgtgttgattcaagaattgattaacaacatcgccaaggctcacggtggttactctattttctgtggtgtcggtgaacgtactcgtgaaggtaacgatctttaccacgaaatgattgaaactggtgtcatcaagctcgatggtgactccaagtgtgctcttgtctttggtcaaatgaacgaacccccaggagctcgtgcccgtgttgccttgactggtttgaccattgctgaatacttccgtgatgatgaaggtcaagatgtgttgcttttcattgataacattttccgtttcacccaagctggttcwgaagtatctgcccttttgggtcgtattccctccgctgtcggttaccaacccactctttctactgatatgggtggtatgcaagaacgtattacaaccaccaagaacggttccattacatccgtccaagctgtctacgtccctgctgatgatttgaccgatcctgctcccgccaccacttttgctcacttggatgccaccactgtcttgtctcgttccattgccgaattgggtatttaccctgccgtcgatcctcttgaytccaagtctcgtatcttggatcctcgtatcgttggtgacgaacactacaaggtcgctaccgaagttcaacaaatccttcaaaactacaagtctct

SEQ ID NO: 775 - DNA, 477 bp, Scopulariopsis koningii
  ref <308>: DATABASE ACCESSION NUMBER: ATCC 38745
attcaggagctcatcaacaacattgccaaggctcacggtggttactctgtgttcactggtgtcggtgagcgtacccgtgagggtaacgatctgtaccacgaaatgcaggagacttcggtcattcagctcgagggcgagtccaaggtcgcgcttgtgttcggtcagatgaacgagccccccggtgcccgtgcccgtgtcgcccttaccggtctgaccgttgccgagtacttccgtgacgaggagggccaggatggtgagtaaccgacgaagtctgagatcttgtcgggcattattctaacgacaactagtgcttctcttcatcgacaacattttccgcttcacccaggccggttccgaggtgtccgcgcttctcggccgtatcccctctgccgtcggttaccagcccaccctggccgtcgacatgggaggtatgcaggagcgtattaccacgactcagaagggctcgattacctcggt

SEQ ID NO: 776 - DNA, 610 bp, Trichophyton mentagrophytes
  ref <308>: DATABASE ACCESSION NUMBER: ATCC 8125
tccggagttgattgtaagtcatttgaaacccagccccaagaaacagaagctaggcgaaaattggacaattgagcaatttagccattggagaaaagaaatttcgagtattaattgtttttatagaacaacattgccaaggctcacggtggttactctgtcttcactggtgtcggagagcgtacccgtgaaggaaacgatctctaccatgaaatgcaggagacccgtgtcattcagcttgatggcgagtccaaggtcgccctggtcttcggccagatgaacgagcccccaggtgcccgtgcccgtgttgctcttactggtttgaccattgctgagtacttccgtgatgaggaaggtcaagacggtgagtttyttatggataaaarattttttttttttttttttttttmaaraaattcatgttctaacaaagtatatcctagtgcttctcttcatcgacaacattttccgtttcactcaggctggttccgaagtgtctgccctgcttggtcgtatcccatctgccgtcggttaccaacccactcttgccgtcgacatgggtggtatgcaggaacgtattaccaccaccaagaagggatccattacctccgtc

SEQ ID NO: 777 - DNA, 593 bp, Trichophyton tonsurans
  ref <308>: DATABASE ACCESSION NUMBER: ATCC 56185
ggagttgattgtaagtcatttgaaacccagccccaagaaacagaagctaggtgaaaattggacaattgaacaatttagcccttggagaaaagaaatttcgagtattaattatttttatagaacaacattgccaaggctcacggtggttactctgtcttcactggtgtcggagagcgtacccgtgaaggaaacgatctctaccatgaaatgcaggagacccgtgtcattcagcttgatggcgagtccaaggtcgccctggtcttcggccagatgaacgagcccccaggtgcccgtgcccgtgttgctcttactggtttgaccattgctgagtacttccgtgatgaggaaggtcaagacggtgagtttcttatggatgaaagatttttttttttcaagaaattcatgttctaacaaagtgtattctagtgcttctcttcatcgacaacattttccgtttcactcaggctggttccgaagtgtctgccctgcttggtcgtatcccatctgccgtcggttaccaacccactcttgccgtcgacatgggtggtatgcaggaacgtattaccaccaccaagaagggatccattacctcc

SEQ ID NO: 778 - DNA, 1141 bp, Trichosporon cutaneum
  ref <308>: DATABASE ACCESSION NUMBER: ATCC 62965
ccgtggtcaagaagttattgacactggtgccccaattaccattcctgttggtcgtggtactcttggtagaattatcaacgtcattggtgaaccaattgacgaacgtggccctatcaaggcttctaagtatgctcctatccatactgaaccaccaacctttgctgaacaatctacttctgctgaagttcttgaaaccggtatcaaggttgtcgatcttcttgctccttacgcccgtggtggtaagattggtcttttcggtggtgctggtgtcggtaagactgtcttcattcaagaacttattaacaacattgccaaggctcacggtggtttctctgtcttcactggtgtcggtgaaagaacccgtgaaggtaacgatctttaccgtgaaatgaaggaaactggtgtcatcaacctcgaaggtgactccaaggtcgctctcgttttcggtcaaatgaacgaacctccaggtgcccgtgcccgtgtcgctttgactggtcttaccattgccgaatacttccgtgatgaagaaggacaagatgtcttgcttttcgttgacaacattttcagattcacccaagccggttctgaagtctctgctcttttgggtcgtattccatctgccgtcggttaccaacctacccttgctaccgatatgggtgccctccaagaacgtattaccaccacccaaaagggttccgtcacatctgtccaagccgtctatgtcccagcagacgatttgactgatcctgccccagccaccactttcgctcacttggacgccaccactgtcttgtctcgttccatttccgaattgggtatctacccagctgtcgatcctctcgattccaagtctcgtcttttggatcctgaagttattggacacgaacactacgaagttgccactcaagttcaacaaaccctccaagcttacaagtctctccaagatatcattgccattttgggtatggatgaattgtctgaagctgataagcttactgtcgaacgtgcccgtaagatccaaagattcctttcccaaccattcgctgttgccgaagttttcactggtatcgaaggtcgtctcgttccattgaaggaaaccgtcagatctttcaaggaaatccttgaaggtaagtacgatcac

SEQ ID NO: 779 - DNA, 1093 bp, Cladophialospora carrionii
  ref <308>: DATABASE ACCESSION NUMBER: ATCC 22864
gctgaaggccgaacgtgagcgtggtatcaccatcgatatcgcgctctggaagttcgagactcccaagtacttcgtcaccgtcatcgatgcccctggtcatcgtgacttcatcaagaacatgatcactggtacctcccaggctgattgtgctattctcatcattgccgctggtactggtgagttcgaggccggtatctccaaggatggccagacccgtgagcatgctctgctcgcctacaccctgggcgtgaagcagcttatcgtcgccatcaacaagatggacaccaccaaatggtctgaggatcgtttcaacgaaatcatcaaggagacttccaacttcatcaagaaggtcggatacaaccccaagtccgttccattcgtgcccatctccggcttcaacggtgacaacatgatcgacgtctccaccaatgccccctggtacaagggctgggaaaaggagtccaaggctggcaaggccaccggcaagaccctccttgaggctatcgactccatcgaccctcctgctcgtcccaccgacaagcctctccgtctcccactccaggatgtctacaagatttctggtatcggcacggtgcccgtcggtcgtgttgagactggtaccatcaaggccggtatggtcgtcacctttgcccccgccaacgtcaccactgaagtcaagtccgtcgaaatgcaccacgaacagctcgccgagggcgttccgggtgacaacgtcggcttcaacgtcaagaacgtctccgtgaaggaggttcgtcgtggaaacgttgctggtgactccaagaacgacccccccaagggtgccgactccttcaacgcccaggtcatcgtcctcaaccaccctggtcaggtcggtgctggctacgccccggtcttggattgccacactgcccacattgcctgcaagttctctgagctcctcgagaagatcgatcgtcgtaccggcaagtccatggaaaacaaccccaagttcatcaagtctggtgatgctgccatcgtgaagatggttcccagcaagcctatgtgcgttgaggctttcaccgactaccctcctcttggtcgtttcgccgtccgtgac

SEQ ID NO: 780 - DNA, 752 bp, Cunninghamella bertholletiae
  ref <308>: DATABASE ACCESSION NUMBER: ATCC 42115
tacttgtaaatggtctcaagatcgttacaacgaaattgttaaggaagtttcttccttcatcaagaagattggttacaatcctaaatccgttcctttcgtycctatctctggttggcacggtgataacatgttggaagcttctaccaacatgccttggtacaagggatggaccaaggaaactaaagctggttcttccactggtaagactctcttagaagccattgacagcattgaacctcctacccgtccttctgacaagcctttacgtcttcctttacaagatgtttacaagattggtggtattggtactgtccctgttggtcgtgttgaaactggtgtcatcaaggctggtatggttgttacyttcgctcccgctaacgtcaccactgaagttaagtccgttgaaatgcatcacgaacaattagaacaaggtgttcctggtgacaacgttggtttcaacgtcaagaacgtttccgttaaggatatccgtcgtggtaacgtctgttccgactccaagaacgaccccgctaaggaatctgcttccttcaacgctcaagttatcgtcttgaaccaccctggtcaaattggtgctggttatgccccagttcttgactgtcacactgctcacattgcttgtaagttcgctgaattattagaaaagatcgatcgtcgttccggtaagaaactcgaagatgctcctaaattcgttaaatctggtgactctgctatcgttaagatggttccttccaagc

SEQ ID NO: 781 - DNA, 728 bp, Curvularia lunata
  ref <308>: DATABASE ACCESSION NUMBER: ATCC 26425
caagtggtctgaggaccgttaccaggaaatcatcaaggagacctccaacttcatcaagaaggtcggctacaaccccaagcacgttcccttcgtccccatctccggtttcaacggagacaacatgattgaggcctccaccaactgcccctggtacaagggttgggagaaggagaccaaggccaaggccactggtaagaccctccttgaggccatcgacgccatcgaccctcctgtccgtcctaccgacaagcccctccgccttcccctccaggatgtttacaagattggtggtattggcacggtccccgtcggtcgtgtcgagaccggtatcatcaagcccggtatggtcgtcaccttcgcccccgctggtgtcaccaccgaagtcaagtccgtcgagatgcaccacgagcagcttactgagggtgtccccggtgacaacgtcggcttcaacgtcaagaacgtctccgtcaaggagatccgtcgtggtaacgttgccggtgactccaagaacgacccccccaagggttgcgagtccttcaacgcccaggtcatcgtcctcaaccaccctggtcaggtcggtgccggttacgccccagtccttgactgccacactgcccacattgcctgcaagttctccgagctcctcgagaagatcgaccgccgtaccggaaagtctgttgagaactcccccaagttcatcaagtccggtgacgccgccatcgtcaaga

SEQ ID NO: 782 - DNA, 1145 bp, Fonsecaea pedrosoi
  ref <308>: DATABASE ACCESSION NUMBER: ATCC 18831
tgaagtccgagcgtgagcgtggtatcaccatcgatatcgccctctggaagttcgagactcccaagtaaggctcaacagacacaacaagcaaatgcatactcgctaacctattcacccaccacaggtacaacgtcaccgtcattgacgcccccggtcaccgtgatttcatcaagaacatgatcactggtacctcccaggctgactgcgccattctcatcattgccgccggtactggtgagttcgaggccggtatctccaaggacggtcagacccgtgagcacgctcttctcgcctacacccttggtgtcaagcagctcatcgttgccatcaacaagatggacaccaccaagtggtctgaggcccgttaccaggagatcatcaaggagacctccggtttcatcaagaaggtcggcttcaaccccaagcacgttcccttcgtgcccatctccggtttcaacggtgacaacatgatcgacgtctccaccaactgcccctggtacaagggttgggagaaggagaccaaggccaaggccaccggcaagaccctcctcgaggccattgacgccatcgacccccccactcgtcccaccgacaagcccctccgtcttcccctycaggatgtctacaagatcggtggtattggcacggttcccgtcggtcgtgtcgagaccggtaccatcaaggccggcatggtcgtcaccttcgcccccgctggtgtcaccactgaggtcaagtccgtcgagatgcaccacgagcagcttcccgagggtctccccggtgacaacgtcggcttcaacgtcaagaacgtctccgtcaaggagatccgtcgtggcaacgtcgccggtgactccaagaacgacccccccaagggctgcgacagcttcaacgcccaggtcatcgtcctcaaccaccccggtcaggtcggcgccggctacgcgcccgtcctcgactgccacactgctcacattgcttgcaagttctctgagctcctcgagaagatcgaccgccgtaccggcaagtccattgaggccagccccaagttcatcaagtctggtgacgccgccatcgtcaagatggttccctccaagcctatgtgcgttgaggccttcaccgactacccccctcttggacgtttcgccgtccgt

SEQ ID NO: 783 - DNA, 1151 bp, Microsporum audouinii
  ref <308>: DATABASE ACCESSION NUMBER: ATCC 11347
gctcaaggctgagcgtgagcgtggtatcaccattgacatcgccctctggaagttcgagacccccaagtacatggtcaccgtcatcggtatgctttatctgtttcccatttatagttgcgacaagtaactaataaaaagtagatgcccccggacaccgtgacttcatcaagaacatgattactggtacctcccaggccgactgcgctattctcatcattgctgccggtactggtgagttcgaggctggtatctccaaggatggccagactcgtgagcacgccctgctcgctttcaccctcggtgtcaagcagctcatcgttgccatcaacaagatggacaccaccaactggtctgagtcccgtttcggtgaaatcatcaaggaagtcaccaacttcatcaagaaggtcggctacgaccccaagggtgtcccattcgtcccaatctctggcttcaacggtgacaacatgattgagccctccaccaactgcccatggtacaagggatggaacaaggagaccaaggccggtggcaaatcctctggtaagaccctccttgaggccatcgatgccattgacatgcccactcgtcccaccgacaagcctctccgtctcccactccaggatgtctacaagatctctggtatcggaacagtaccagtcggtcgtgttgagactggtatcatcaagcctggtatggttgtcactttcgcccccgccaacgtcaccactgaagtcaagtccgtcgaaatgcaccaccagcagctcgttcagggtgttcccggtgacaacgttggcttcaacgtcaagaacgtctctgtcaaggaagtccgccgtggtaacgttgccggtgattccaagaacgacccaccatctggctgcgcctctttcaaggcccaggtcatcgtcctcaaccaccccggccagatcggtgctggttacgccccagtcctcgactgccacactgcccacattgcttgcaagttctctgagcttcttgagaagattgaccgccgtactggtaaatccgtcgaaaccagccctaagttcgtcaagtctggtgatgccgctattgccaccatggttccatccaagcccatgtgcgttgaggctttcactgactacccaccacttggtcgtttcgccgtccgtgac

SEQ ID NO: 784 - DNA, 979 bp, Mucor circinelloides
  ref <308>: DATABASE ACCESSION NUMBER: ATCC 38592
ccaagtggtctcaagatcgttacaacgaaattgtcaaggaagtttccggtttcatcaagaagatcggtttcaaccccaagtccgttcctttcgttcccatttctggctggcacggtgataacatgttggatgaatccaccaacatgccctggttcaagggatggaacaaggagaccaaggccggttccaagactggtaagactctcctcgaagccatcgatgccattgagccccctgtccgtccttctgacaagcctctccgtcttcctcttcaagatgtctacaagattggtggtattggtacagttcccgtcggtcgtgttgaaactggtactatcaaggctggtatggttgtcaacttcgctcccgctgctgtcaccactgaagttaagtccgttgaaatgcatcacgaaaccctctctgaaggtctccccggtgacaacgttggtttcaacgtcaagaacgtctccgtcaaggatatccgtcgtggtaacgtctgttccgactccaagaacgatcccgctaaggaatctgcctctttcactgctcaagttattatcttgaaccatcccggtcaaatctctgctggttacgcaccagttctcgattgtcacactgctcacatcgcctgtaagttctctgaactcattgagaagattgatcgtcgttccggtaagtacctgcatctgtcagaattgaaggtccgccgttatagcaaaggctgggtttaaatgttggggtttgtctgatctataatgatgattgctccttcaatttttgacataatttgatgatctgaattgtgttgctaacgtcgcatttgcttcttttgcttcttttgcatgtaggtaagaagatggaagatgctcccaaagtaagtattacgattgatggacaattaaaatagaatactaacaattattgtttatagttcgtcaagtctggtgactctgctatcgtcaagatggttccctccaag

SEQ ID NO: 785 - DNA, 1099 bp, Phialaphora verrucosa
  ref <308>: DATABASE ACCESSION NUMBER: ATCC 38561
ggacaagctgaaggccgaacgtgagcgtggtatcaccatcgatatcgcgctctggaagttcgagactcccaaatacttcgtcaccgtcattgatgcccctggtcatcgtgacttcatcaagaacatgatcactggtacctcccaggctgattgtgccatcctcatcattgccgccggtaccggtgagttcgaagccggtatctccaaggatggccagacccgtgagcacgctctcctcgcctacaccctaggtgtgaagcagcttatcgtcgccatcaacaagatggacaccgccaaatggtccgaggatcggttcaacgaaatcatcaaggagacttccaacttcatcaagaaggtcggatacaaccccaagtccgtcccgttcgtgcccatctccggtttcaacggtgacaacatgatcgacgtctcctccaacgccccctggtacaagggttgggagaaggagaccaaggccggcaaggccactggcaagaccctcctcgaggccatcgacgcgattgaccctcctactcgtcccaccgacaagcccctccgtctccctctccaggatgtctacaagatctctggtatcggcacggtgcccgttggtcgtgttgagaccggtaccatcaaagccggtatggtcgtcaccttcgctcccgccaacgtcaccactgaagtcaagtccgtcgaaatgcaccacgaacagctcgccgaaggtgttccaggtgacaatgtcggcttcaacgtcaagaacgtctccgtcaaggaggttcgtcgtggaaacgttgccggtgactccaagaatgacccccccaagggtgccgactccttcaacgctcaggtcatcgtcctcaaccaccctggtcaggtcggtgccggctacgccccggtcttggattgccacactgcccacattgcttgcaagttctctgagctcctcgagaagatcgatcgtcgtaccggcaagtccatggaaaacaaccccaagtttatcaagtctggtgatgctgccatcgtgaagatggttcccagcaagcctatgtgcgttgaggccttcaccgactatcctcctcttggtcgtttcgccgtccgtgac

SEQ ID NO: 786 - DNA, 750 bp, Saksenaea vasiformis
  ref <308>: DATABASE ACCESSION NUMBER: ATCC 60625
accaccaagtggtctgaggcccgttaccaggagatcatcaaggagacctccggyttcatcaagaaggtcggcttcaaccccaagcacgttcccttcgtgcccatctccggtttcaacggtgacaacatgatcgacgtctccaccaactgcccctggtacaagggttgggagaaggagaccaaggccaaggccaccggcaagaccmtcctcgaggccattgacgccatcgaccccccyagycgtcccaccgacaagcccctycgtcttcccctmcaggatgtytacaagattggcggtattggcacggttcccgtcggtcgtgtygagaccggtrccatcaagggtggcatggtcgtcaccttcccccccgctggtgtcaccactgaggtcaagtccgtcgagatgcaccacgagcagctcgccgagggtstccccggtgacaacgtcggcttcaacgtcaagaacgtctccgtcaaggagatccgtcgtggcaacgttgccggtgactccaagaacgacccccccaagggctgcgacagcttcaacgcccaggtcatcgtcctcaaccaccccggtcaggtcggcgccggctacgcgccsgtcctsgactgccacactgctcacattgcctgcaagttctctgagctcctcgagaagatcgaccgccgttccggcaagtccatcgagtccggccccaagttcatcaagtctggtgacgccgccatcgtcaagatggttccctccaagccc

SEQ ID NO: 787 - DNA, 1084 bp, Syncephalastrum racemosum
  ref <308>: DATABASE ACCESSION NUMBER: ATCC 32330
gctcaaggccgagcgtgagcgtggtatcaccatcgatatcgctctctggaagttcgagacccccaagtaccacgtcaccgtcattgatgcccccggccatcgtgatttcatcaagaacatgatcactggtacctcgcaggctgactgcggtatcctcatcattgccgccggtactggtgagttcgaggctggtatctccaaggatggccagacccgtgagcacgctctgcttgccttcaccctcggtgtccgtcagctgatcgtcgccatcaacaagatggactcgaccaagtactctgaggcccgttacaacgaaatcgtcaaggaggtctccaccttcatcaagaagatcggtttcaaccccaagtccgttcccttcgtccccatctctggctggaacggtgacaacatgttggaggagtcctccaacatgccctggttcaagggctggaagaaggagaccaaggctggcgagaagtccggcaagaccctccttgaggccattgacaacattgaccccccggtccgtccctcggacaagcccctccgtcttcccctccaggatgtctacaagatcggtggtatcggcacagtccccgtcggtcgtgtcgagactggtgtcatcaaggctggtatggtcgtgaccttcgcccccgccaacgtcaccactgaagtcaagtccgtcgagatgcaccacgagcagctcgtcgagggtgtccccggtgacaacgtcggtttcaacgtcaagaacgtttccgtcaaggatatccgccgtggtaacgtctgctctgactccaagaacgaccccgccaaggagtctgcctcgttcaccgcccaggtcatcgtcctgaaccaccccggtcagatcggtgccggttacgccccggttcttgactgccacaccgctcacattgcctgcaagttcgctgagctcctcgagaagatcgaccgtcgttccggyaagaagctcgaagagtcccccaagttcgtcaagtcgggtgactccgccatcgtcaagatggttccctccaagcccatgtgcgttgaggcctacactgagtacccccctcttggccgtttcgcc

SEQ ID NO: 788 - DNA, 1155 bp, Trichophyton tonsurans
  ref <308>: DATABASE ACCESSION NUMBER: ATCC 56185
gctcaaggccgagcgtgagcgtggtatcaccatcgatatcgccctctggaagttcgagacccccaagtacaatgtcaccgtcattggtatgtttttctttacctttcccctccatcgtcttgctgtgccataactaacgagagtagacgcccccggtcaccgtgacttcatcaagaacatgatcactggtacctcccaggctgactgtgctattctcatcattgctgccggtactggtgagttcgaggctggtatctccaaggatggccagacccgtgagcacgctctgctcgccttcacccttggtgtcaagcagctcatcgttgccatcaacaagatggacaccaccaactggtccgaggaccgtttcaaggaaatcatcaaggaagtcaccaacttcatcaagaaggttggctacgaccccaagggtgttccattcgttccaatctctggtttcaacggtgacaacatgattgaggcctccagcaactgcccatggtacaagggatggaacaaggagaccaaggccggtggtgccaagactggcaagaccctyctcgaggccatcgatgccatcgacatgccaacccgtcctaccgacaagcccctycgtctcccactccaggatgtctacaagatctctggtatcggaactgtaccagtcggtcgtgttgagaccggtatcatcaagcctggtatggtcgtcaccttcgcccctgccaacgtcaccactgaagtcaagtccgtcgaaatgcaccaccagcagcttcagcagggtgtccccggtgacaacgtcggcttcaacgtcaagaacgtttccgtcaaggaagtccgccgtggtaacgttgccggtgactccaagaacgacccaccatccggctgtgcctccttcaacgcccaggtcatcgtcctcaaccaccccggccagatcggtgctggttacgccccagtcctcgactgccacactgctcacattgcttgcaagttcgctgagctcctcgagaagattgaccgccgtaccggtaaatccgtcgaagccaaccccaagttcgtcaagtctggtgatgccgctatcgccaagatggttccctccaagcccatgtgcgttgaggctttcactgactaccccccacttggtcgtttcgccgtccgtga

SEQ ID NO: 789 - DNA, 1138 bp, Trichophyton mentagrophytes
  ref <308>: DATABASE ACCESSION NUMBER: ATCC 8125
tcaaggccgagcgtgagcgtggtatcaccatcgatatcgccctctggaagttcgagacccccaagtacaatgtcaccgtcattggtatgtttctctttacctttcccctccatcgtcttgctgtgccataactaacgagagtagacgcccccggtcaccgtgacttcatcaagaacatgatcactggtacctcccaggctgactgtgctattctcatcattgctgccggtactggtgagttcgaggctggtatctccaaggatggccagacccgtgagcacgctctgctcgccttcacccttggtgtcaagcagctcatcgttgccatcaacaagatggacaccaccaactggtccgaggaccgtttcaaggaaatcatcaaggaagtcaccaacttcatcaagaaggttggctacgaccccaagggtgttccattcgttccaatctctggtttcaacggtgacaacatgattgaggcctccaccaactgcccatggtacaagggatggaacaaggagaccaaggccggtggtgccaagactggcaagaccctcctcgaggccatcgatgccatcgacatgccaacccgtcctaccgacaagcccctccgtctcccactccaggatgtctacaagatctctggtatcggaactgtaccagtcggtcgtgttgagaccggtatcatcaagcccggtatggtcgtcaccttcgcccctgccaacgtcaccactgaagtcaagtccgtcgaaatgcaccaccagcagcttcagcagggtgtccccggtgacaacgtcggcttcaacgtcaagaacgtttccgtcaaggaagtccgccgtggtaacgttgccggtgactccaagaacgacccaccatccggctgtgcctccttcaacgcccaggtcatcgtcctcaaccaccccggccagatcggtgctggttacgccccagtcctcgactgccacactgctcacattgcttgcaagttcgctgagctcctcgagaagattgaccgccgtaccggtaaatccgtcgaagccaaccccaagttcgtcaagtctggtgatgccgctatcgccaagatggttccatccaagcctatgtgcgttgaggctttcactgactaccccccacttggtcg

SEQ ID NO: 790 - DNA, 748 bp, Bipolaris hawaiiensis
  ref <308>: DATABASE ACCESSION NUMBER: ATCC 26067
caccaccaagtggtctgaggagcgttaccaggaaatcatcaaggagacctccaacttcatcaagaaggtcggctacaaccccaagcacgttcccttcgtccccatctctggtttcaacggagacaacatgattgaggcttccaccaactgcccctggtacaagggttgggagaaggagaccaaggccaaggccactggtaagacccttctcgaggccatcgacgccatcgacccccctgtccgtcctaccgacaagcccctccgccttcccctccaggatgtgtacaagattggtggtattggcacggttcccgtcggtcgtgtcgagaccggtatcatcaagcccggtatggtcgtcaccttcgcccccgctggtgtcaccactgaagtcaagtccgtcgagatgcaccacgagcagcttgccgagggtgtccccggtgacaacgtcggcttcaacgtcaagaacgtctccgtcaaggagatccgtcgtggtaacgttgccggtgactccaagaacgacccccccaagggttgcgagtccttcaacgcccaggtcatcgtcctcaaccaccccggtcaggtcggtgccggttacgcaccagtccttgactgccacactgcccacattgcttgcaagttctccgagctcctcgagaagattgaccgccgtaccggaaagtctgttgagaactcccccaagttcatcaagtccggtgacgccgccatcgtcaagatggttccctccaag

SEQ ID NO: 791 - DNA, 958 bp, Aspergillus fumigatus
  ref <308>: DATABASE ACCESSION NUMBER: ATCC 14110
cgctattgtcgttgttgctgcctccgacggtcagatgtaggtggaacatcttgggaaatacgtcgtaaaacacggcgcttacgttttcgcgaataggccccagactcgtgagcatttgctgctcgcccgccaggttggtgtccagaagatcgttgtcttcgtcaacaaaatcgatgctattgatgatccggagatgctggaactggtcgaactcgagatgcgtgagctgctgaacagctacggtttcgagggtgaagagactccgatcattttcggttccgctctctgtgctctcgaaggacgccgtgacgacatcggtaaagacagaattgagcagcttatgaacgctgtcgacacctggatccccactcctcagcgtgacctcgacaaacctttcttgatgtctgtcgaggaagtgttctctatcgccggccgtggtaccgtggcttctggtcgtgtcgagcgtggtatcttgaagaaggactctgaggttgagattgttggaggctccttcgaacccaagaagaccaaagtcaccgacattgaaaccttcaagaagagctgtgatgaatcgcgtgctggtgacaactctggtctcctcctgcgtggtatccgacgtgaagacgtcaagcgtggtatggtcattgctgttcccggcagcaccaaagctcacgacaagttcctcgtctccatgtacgtcctgaccgaggcggagggtggtcgtcgtactggcttcggtgccaactaccgtccccaagtcttcatccgtactgcaggtaagttcccgcacaccgtgtccagatcttccgagagattagcgatatatgctaatgattcatcagacgaggctgctgacctcagcttccctgacggcgaccaatctcgcagagttatgcctggtgacaacgtcgagatgatcctgaagacccaccaccctgttgctgctgaggctggtcaa

SEQ ID NO: 792 - DNA, 936 bp, Trichophyton mentagrophytes
  ref <308>: DATABASE ACCESSION NUMBER: ATCC 8125
cgttgtcgcagcttctgacggtcaaatgtaattgaatgcccgcccagacggatgaaaggatttgacgtttctaacatcattctaggcctcagaccagagaacatttgctccttgcccgccaggtcggtgtccagaagctggtcgttttcgttaacaaggtcgatgccgttgaggacccagagatgttggagcttgtcgaacttgaaatgcgtgaactcctcagccactacggtttcgagggtgaggagacccccatcatttttggctctgctctctgtgccctcgagtcccgtcgacctgagcttggtgtcgagaagattgacgagctattgaacgccgtcgacacctggatccccacccccgagcgcgccactgataagcctttcctcatgtccattgaggaagtgttctctatctctggtcgtggtaccgtcgtctccggtcgtgttgagcgtggtatcctcaagaaggattccgacgtcgaaattgttggtggctctaccacccctatcaagaccaaggtcacagatatcgaaaccttcaagaagtcctgcgatgaatctcgagctggtgacaactctggtctccttctccgaggtatcaagcgtgaggacttgaagcgtggaatggttgttgctgcccccggatccaccaaggctcacaccgacttcatggtctccctctacgtcctgactgaggctgagggtggtcgttccaacggcttcacccacaagtaccgcccccaaatgttcatccgtactgctggtatgtaacccaagtttccgctatttactaagtagatcattgctaacttgtatttccttccgtagacgaagccgcatctttcagctggcctggagaagaccaagacaagaaggctatgcctggtgacaacgtcgagatgatttgcaagaccctccaccccattgctgccga

SEQ ID NO: 793 - DNA, 20 bp, Artificial Sequence
  Synthetic DNA Sequence
ttattgttgctgctggtact

SEQ ID NO: 794 - DNA, 20 bp, Artificial Sequence
  Synthetic DNA Sequence
gacgacaagtcggtgaactt

SEQ ID NO: 795 - DNA, 20 bp, Artificial Sequence
  Synthetic DNA Sequence
acttgcacgcgatgtggcag

SEQ ID NO: 796 - DNA, 21 bp, Artificial Sequence
  Synthetic DNA Sequence
ggtccaatgccwcaaacwaga

SEQ ID NO: 797 - DNA, 27 bp, Artificial Sequence
  Synthetic DNA Sequence
cattaagaatggyttatctgtskctct

SEQ ID NO: 798 - DNA, 22 bp, Artificial Sequence
  Synthetic DNA Sequence
tggttgtcccagccgatcgttt

SEQ ID NO: 799 - DNA, 21 bp, Artificial Sequence
  Synthetic DNA Sequence
acctgtgaatacaagcaatct

SEQ ID NO: 800 - DNA, 24 bp, Artificial Sequence
  Synthetic DNA Sequence
gatgaaatcttcaacgaagttgat

SEQ ID NO: 801 - DNA, 20 bp, Artificial Sequence
  Synthetic DNA Sequence
acaacaccgagaagatccca

SEQ ID NO: 802 - DNA, 20 bp, Artificial Sequence
  Synthetic DNA Sequence
ttgccatttctggtttcgtt

SEQ ID NO: 803 - DNA, 20 bp, Artificial Sequence
  Synthetic DNA Sequence
acttcagtggtaacaccagc

SEQ ID NO: 804 - DNA, 20 bp, Artificial Sequence
  Synthetic DNA Sequence
cctgggacggcctctggcat

SEQ ID NO: 805 - DNA, 20 bp, Artificial Sequence
  Synthetic DNA Sequence
ctcttgtccatcttagcagt

SEQ ID NO: 806 - DNA, 21 bp, Artificial Sequence
  Synthetic DNA Sequence
agcatcaccagacttgataag

SEQ ID NO: 807 - DNA, 20 bp, Artificial Sequence
  Synthetic DNA Sequence
aaagtggcttcaaaggttgc

SEQ ID NO: 808 - DNA, 24 bp, Artificial Sequence
  Synthetic DNA Sequence
  modified_base (3): i
  modified_base (7): i
gcnttanwrgcattagaaraycca

SEQ ID NO: 809 - DNA, 24 bp, Artificial Sequence
  Synthetic DNA Sequence
tcttcctgtwgcaactgttcctct

SEQ ID NO: 810 - DNA, 24 bp, Artificial Sequence
  Synthetic DNA Sequence
agagmwacagataarscattctta

SEQ ID NO: 811 - DNA, 25 bp, Artificial Sequence
  Synthetic DNA Sequence
traartagaattgtggtctrtatcc

SEQ ID NO: 812 - DNA, 26 bp, Artificial Sequence
  Synthetic DNA Sequence
  modified_base (3): i
  modified_base (6): i
  modified_base (9): i
  modified_base (21): i
  modified_base (24): i
gtnacnggntcytyrarrttnccncc

SEQ ID NO: 813 - DNA, 22 bp, Artificial Sequence
  Synthetic DNA Sequence
aatcygtygaaatgcaycacga

SEQ ID NO: 814 - DNA, 20 bp, Artificial Sequence
  Synthetic DNA Sequence
  modified_base (3): i
  modified_base (15): i
gcnggcacgtacacngcctg

SEQ ID NO: 815 - DNA, 20 bp, Artificial Sequence
  Synthetic DNA Sequence
tggtgcatytckacrgactt

SEQ ID NO: 816 - DNA, 20 bp, Artificial Sequence
  Synthetic DNA Sequence
gctacgacgagatcaagggc

SEQ ID NO: 817 - DNA, 20 bp, Artificial Sequence
  Synthetic DNA Sequence
tggaagaaggccgaggagtt

SEQ ID NO: 818 - DNA, 20 bp, Artificial Sequence
  Synthetic DNA Sequence
agccgggctggatcttcttc

SEQ ID NO: 819 - DNA, 20 bp, Artificial Sequence
  Synthetic DNA Sequence
tcgagcttctggaggaagag

SEQ ID NO: 820 - DNA, 21 bp, Artificial Sequence
  Synthetic DNA Sequence
gaaggaggtgtctgcttacac

SEQ ID NO: 821 - DNA, 21 bp, Artificial Sequence
  Synthetic DNA Sequence
ggcgcaaacgtcaccacatca

SEQ ID NO: 822 - DNA, 21 bp, Artificial Sequence
  Synthetic DNA Sequence
cggcggatgtccttaacagaa

SEQ ID NO: 823 - DNA, 20 bp, Artificial Sequence
  Synthetic DNA Sequence
gagcggtatgaygagattgt

SEQ ID NO: 824 - DNA, 20 bp, Artificial Sequence
  Synthetic DNA Sequence
ggcttctgcggcaccatgcg

SEQ ID NO: 825 - DNA, 26 bp, Artificial Sequence
  Synthetic DNA Sequence
atgagcarcgsaaccatcgttcagtg

SEQ ID NO: 826 - DNA, 26 bp, Artificial Sequence
  Synthetic DNA Sequence
tcgatcgtgccgaccatgtagaacgc

SEQ ID NO: 827 - DNA, 446 bp, Clostridium novyi
  ref <308>: DATABASE ACCESSION NUMBER: ATCC 19402
caccaacttgctaaatggggagatgcccagattgttgtatatataggctgtggagaacgtggaaatgaaatgacagatgttcttaatgagtttccagaacttaaagatcctaagactggcaaatcaataatggaaagaacagttttaatagcaaatacttctaatatgccagttgcagcccgtgaagcttgtatatatacaggaatcacaatagcagaatattttagagatatgggatattcagtagcacttatggcggattccacttcacgttgggcagaggcattaagagaaatgtctggaagacttgaagaaatgcctggtgatgaaggttacccagcttatttaggatcaagacttgctgatttctatgaaagagctggaaaagttgtgtgtttaggagacgatgaaagagaaggtgccattactgcaataggtgctgtatc

SEQ ID NO: 828 - DNA, 445 bp, Clostridium difficile
  ref <308>: DATABASE ACCESSION NUMBER: ATCC 9689
cagcatcagcttgctaaatgggcagatgcagatatagttgtatatataggctgtggcgagcgtggaaatgaaatgacagatgttcttcttgaatttcctgaattaaaagacccaagaacaggcgagtcacttatgcaaagaactgtgcttatagcaaatacatcagatatgccggttgctgcacgtgaagcttctatatacactggtattacaatagctgaatattttagagatatgggatatagtgttgcacttatggcagactctacatcaagatgggctgaggctcttagagagatgagtggtcgtttagaggagatgcctggtgaagaaggttatcctgcatacttaggttcacgtcttgctcaattctatgagagagcaggaaaggtaaattgtctaggtatggatgaaagagaaggaacacttacagcaattggtgcag

SEQ ID NO: 829 - DNA, 445 bp, Clostridium septicum
  ref <308>: DATABASE ACCESSION NUMBER: ATCC 12464
atgctatagctaaatggggagacagcgaaatagttgtttacgttggatgtggagaacgtggtaacgaaatgacagacgttcttaacgaattcccagaacttattgacccaaaaactggggaaagtttaatgaagagaacagtacttatagctaatacttcaaacatgccagttgctgctagagaagcttgcatatacacaggtattacaatagctgaatacttcagagatatgggatactcagtatctataatggctgattcaacttcaagatgggcagaagcattaagagaaatgtcaggtagacttgaagaaatgccaggtgatgaaggatatccagcgtacttaggatcaagacttgctgattattacgaaagagcaggtaaggttgtttgtctaggtaaagatggtagagaaggtgctgtaacagcaattggagctgtatc

SEQ ID NO: 830 - DNA, 444 bp, Clostridium botulinum
  strain 20:3.1
tcaaattgctaaatggggagatgcagaaatcgttgtttacgttggatgcggagaacgtggtaacgaaatgacagacgttgttaatgagttcccagaacttattgaccctaagactggcgaaagcttaatgaagagaacagttcttatagctaatacttcaaacatgccagttgcagcgagagaagcttcaatatatacaggtatcacaatagctgaatatttcagagatatgggatatgcagtatcaataatggctgactcaacttcaagatgggctgaggcattaagagaaatgtctggtagacttgaagaaatgcctggtgatgaaggatatccagcttaccttggatcaagacttgctgattactatgaaagagctggtaaggttgaatgtttaggtaatgatggaagaattggttctataacagcaatcggtgcggtatc

SEQ ID NO: 831 - DNA, 456 bp, Clostridium perfringens
  ref <308>: DATABASE ACCESSION NUMBER: ATCC 13124
tagttcagcaccaagttgctaaatggggagatactgagatagttgtttacgttggatgtggagaacgtggtaacgagatgacagacgttcttaacgaattcccagaacttaaagaccctaaaactggggaaagcttaatgaagagaacagttcttattgctaatacatctaacatgccagttgctgccagagaagcatcaatatatactggtataacaatagcagagtatttcagagatatgggatactcagtatcaatcatggctgactcaacttcacgttgggcagaggctttaagagaaatgtcaggaagacttgaagaaatgccaggagacgaaggttacccagcatacttaggatcaagacttgctgattactatgaaagagctggtaaagttgtagctttaggtaaagatggaagagaaggagctgttacagctatcggagcagtatccc

SEQ ID NO: 832 - DNA, 444 bp, Clostridium tetani
  ref <308>: DATABASE ACCESSION NUMBER: ATCC 19406
ccaacttgcaaaatgggctgatgctcaaatagttgtgtacataggatgtggagaacgtggaaatgaaatgacagacgttttaaatgagttcccagaattaaaggatcctaaaaccggggaatctttaatgaaaagaactgtgttaatagcaaatacatctaatatgcctgttgcagctagagaagcatctatatatactggtataacaataggggaatattttagagatatgggatattcaatagcactaatggcagattcgacttctagatgggcagaggctctaagagaaatgtctggaagactagaggagatgccaggtgaagaaggttatccagcttatttaggatctagattagcagagttctatgaaagagcaggtaatgttatatgtttaggtcaggatggaagagaaggagcattaacagctataggagcagtttc

SEQ ID NO: 833 - DNA, 1786 bp, Streptococcus pyogenes
tgaaccaaggaaaaataataaccgtttcgggacctcttgttgtggcttctgggatgcaagaagctaatattcaagatatttgtcgtgtgggacatcttggcttagtcggagaaattattgaaatgcgtcgcgatcaagcgtctattcaggtttatgaggaaacatcagggatcggtccaggagaaccagtagtgactactggttgtcctttgtcggtcgagttaggcccgggcctgatttcagaaatgtttgacggtattcagcgaccgcttgatcgttttcaaaaagcaacggacagcgactttttaatccgtggtgtggctatcccaagtcttgatcgaaaggctaagtgggcatttattcccaagctaagtgttggtcaagaagtagttgcaggtgatattttaggaactgtgcaagaaacagctgtcattgagcaccgtatcatggttccttataaagtttcagggaccttggtggctattcatgcaggggacttcacagtaacagatacagtttatgaaattaagcaggaagacggttccatttaccaaggtagcctcatgcagacttggccagttcgtcaaagtcgccctgttgctcaaaagcttatcccagtcgaacctttggttacaggtcaacgggttattgacacctttttccctgttacaaaaggtggtgccgctgccgttcctggaccatttggggcaggaaaaacagttgtgcagcatcaaatagctaaatttgccaacgttgatattgttatttatgtcggttgtggggaacgcggcaacgagatgaccgacgttttgaatgagtttccagagttaattgacccaaatacaggccagtccattatggagcgcacggtgttaattgcaaacacctctaatatgccagtagcagcgcgtgaagcgtcgatttacacaggtattaccattgccgaatatttccgtgatatgggctattctgtggctatcatggcagactcgacatcacgttgggcagaagctctgcgcgagatgtcaggacgcctacaagaaatgcctggtgatgaaggctacccggcttacttagggagtcgtattgccgaatattatgaacgggctggtcgtgttcggaccttgggaagtcaagaacgtgagggaaccattacagccatcggcgcggtttctcctcctggaggggatatttcagagcctgtcactcaaaacacccttcggattgtcaaagttttctgggggctcgacgcgcctcttgcgcaacggcgtcacttcccagcgattaactggctgacgtcttattcattgtatcaagatgatgtaggaagctatattgaccgtaaacagcaatctaattggtccaacaaggtaactcgtgccatggctattttgcagcgtgaagccagtctagaagaaattgtacgcttggtggggcttgattcactgtctgaacaagatcgtttgaccatggctgttgcccggcaaattcgggaggattatctccagcaaaatgcctttgattcggtggatacctttacttcctttccgaaacaagaggccatgctaaccaatattttgacctttaatgaggaagccagcaaagccctttctttgggagcttattttaatgagattatggaaggcactgctcaggtacgcgatcgcatcgcacgcagcaaatttatcccagaagaaaacttagagcagattaaagggcttactcagaaggttaccaaagagattcaccacgttttagcaaagggaggaatttagatgagcgttct

SEQ ID NO: 834 - DNA, 499 bp, Babesia bovis
  strain Suarez-3
tatctcacgtaagtttttgcgcggcggttatatatcactccaggccctggctaagtacgctaatactgacgttactgtctatgtgggatgtggagagcgtggaaacgagattgcggaggtgcttaaggagttccctgagctgaagaccaaggttgatggcaaggaagtgagcattatgaaacgcacttgcttggtggccaatacttcaaacatgccagtggccgccagggaggctagtatctacactggcattaccctatgtgaatacttcagggatatgggatacaacgcctgtgtgatggcggattccaccagtcgttgggctgaggctttgcgtgagatatcaggtcgtttagctgagatgcctgctgattcaggttatcccgcctaccttgcttctaggctttcggcgttctatgagcgtgctggtacagctgagtgtattggaacaccacttcgtgaaggttcagttaccattgttggtgctgtatctccacca

SEQ ID NO: 835 - DNA, 464 bp, Cryptosporidium parvum
tttctcaagctttgagtaaatatagtaactctgatgttattatttacattggttgtggagaaagaggaaatgaaatggcagaagttcttacagaattccctgagctttatactatggttgatggaaagaaggagtcaattatgcaaagaacttgtttagtagctaatacatcaaatatgcctgtcgctgctagagaagcttccatctacactggtattacactttctgaatactttagagatatgggatgtaatgtttctatgatggcagattcaacttctcgttgggctgaagctcttagagaaatttctggtagattagctgaaatgcctgcagattcgggttacccagcatatttaggcgccagacttgcttcattctatgaaagatcaggaagagttaaatgtatgggttccccagatagagaaggtacagtaacaattgttggtgcagtttctccacct

SEQ ID NO: 836 - DNA, 446 bp, Leishmania infantum
  strain MOU
gccctctccaagtactccaactccgattgcgtcatctatgtcggctgcggcgagcgcggtaatgagatggccgaggtgctcatggagttcccgaccctgacgaccgtgatcgatggccgcgaggagtcgatcatgaagcgcacctgcctcgtggcgaacacctcgaacatgccagtcgcagcccgtgaggcctctatttacaccggcatcaccctggccgagtactaccgtgatatgggcaagcatatcgccatgatggctgactcgacgtctcgctgggccgaggcgcttcgtgagatttcgggtcgtctggcggagatgccggcggatggtggctaccccgcctacctcagcgctcgtctcgcctccttctacgagcgcgccggcctcgtcacctgcatcggcgggccgaagcgccagggctccgtcacgatcgtcggtgccgt

SEQ ID NO: 837 - DNA, 456 bp, Leishmania major
  ref <308>: DATABASE ACCESSION NUMBER: ATCC 50122
ttagtcaggccctctccaagtactccaactccgactgcgtcatctatgtcggctgcggcgagcgcggtaatgagatggctgaggtgctcatggatttcccaactctgacgaccgtgatcgatggtcgcgaggagtccatcatgaagcgcacctgcctcgtggcaaacacttcgaacatgccagtcgcagcccgcgaggcctctatttacaccggcatcaccctggccgagtactaccgtgatatgggcaagcatattgccatgatggccgactcgacatctcgctgggccgaggcgcttcgtgagatttccggtcgtctggcggagatgccagccgatggtggctaccctgcctacctcagcgctcgtctcgcctccttctacgagcgcgccggcctcgtcacctgcatcggcgggccgaagcgccagggctccgtcacgatcgtcggtgctgtgt

SEQ ID NO: 838 - DNA, 450 bp, Leishmania tarentolae
  strain MOU-2
aggccctctccaagtactccaactccgactgcgtcatctacgtcggctgcggcgagcgcggtaatgagatggccgaggtgctcatggagttcccgaccctgacgactgtgattgatggccgtgaggagtcgatcatgaagcggacctgcctcgtggccaacacctccaacatgccagtcgcagcccgtgaagcctctatttacactggtatcaccctggccgaatactaccgtgatatgggcaagcatatcgccatgatggctgactcgacgtctcgctgggcggaggcgcttcgtgagatttcgggtcgcctggcggagatgccggctgatggtgggtaccccgcctaccttagtgctcgtcttgcctccttctacgagcgtgccggcctcgtcacctgcatcggtgggccgaagcgccagggctccgtcacgatcgtcggtgccgtgt

SEQ ID NO: 839 - DNA, 437 bp, Trypanosoma brucei subsp. brucei
  strain EATRO795
gcactctcgaagtactcgaacagtgacgctgttatttacgtgggttgtggtgagcgtggcaatgagatggcggaggtgctcatggactttcccaccctcaccaccattattgatggacgtgaggagtctatcatgaagcgcacatgcctggtggcaaatacttccaatatgcctgttgctgctcgtgaggcatctatttacactggtatcaccttagctgagtattatcgggatatgggaaaacacatcgccatgatggccgattcaacctcccgctgggctgaggctttgcgtgagatttccggtcgtcttgctgaaatgcctgcagatggaggttatcccgcgtacctcagcgcccgtttggcctccttctacgagcgtgctggccgtgtgacatgcatcggtgggccgaagcgtgaagggtctgtaacaattgt

SEQ ID NO: 840 - DNA, 1052 bp, Trypanosoma cruzi
  strain MM3
tgaaggctgagcgcgagcgcggcatcacgatcgacatcgcgctctggaagttcgagtcgcccaagtctgtgttcacgatcatcgacgcccccggccaccgcgacttcatcaagaacatgatcacgggcacgtctcaggcggacgccgccgtccttgtcattgcgtcatcgcagggtgagtttgaggcgggcatctcgaaggacggccagacacgcgagcacgcgctgctcgccttcacgctcggcgtgaagcagatggttgtgtgctgcaacaagatggacgacaagtcggtgaacttcgcccaggagcgctacgatgagattgtgaaggaggtgtcggcgtacctgaagaaggttgggtacaacgtggagaaggtgcgcttcatccccatctccggctggcagggcgacaacatgattgacaagtcggaaaatatgccgtggtacaagggccccacgctgctggaggcactcgacatgctggagcccccggtgcgccccagcgacaagccgctgcgcctgccgctgcaggacgtgtacaagatcggcggtatcggcaccgtgccggtcggtcgcgtggagacgggcacgatgaagcccggcgacgtggtgacgtttgcgcccgccaacgtgacgacggaggtgaagtcgattgagatgcaccacgagcagctggccgaggccacgcccggcgacaacgtcggcttcaacgtgaagaacgtgtccgtgaaggacatccgccgtggcaacgtgtgcggcaactcgaagaacgaccccccaaaggaggcggccgacttcacggcgcaggtgatcatcctgaaccaccccggccagatcggcaacggctatgcgccggtgctcgactgccacacctgccacatcgcgtgcaagttcgccgagatcgagtccaagatcgaccgccgctccggcaaggagcttgagaagaaccccaagtcgatcaagtccggtgacgccgccatggtgcgcatggtgccgcagaagcccatgtgcgtggaggtgttcaacgactacgctcctcttggccgctttgcc

SEQ ID NO: 841 - DNA, 1061 bp, Trypanosoma cruzi
  strain CGL-1
tgaaggctgagcgcgagcgcggcatcacgatcgacatcgcgctctggaagttcgagtcgcccaagtctgtgttcacgatcatcgacgcccccggccaccgcgacttcatcaagaacatgatcacgggcacgtctcaggcggatgccgccgtccttgtcattgcgtcatcgcagggtgagtttgaggcgggcatctcgaaggacggccagacacgcgagcacgcgctgctcgccttcacgctcggcgtgaagcagatggttgtgtgctgcaacaagatggacgacaagtcggtgaactttgcccaggagcgctacgatgagattgtgaaggaggtgtcggcgtacctgaagaaggttgggtacaacgtggagaaggtgcgcttcatccccatctccggctggcagggcgacaacatgattgacaagtcggaaaatatgccgtggtacaagggccccacgctgctggaggcactcgacatgctggagcccccggtgcgccccagcgacaagccgctgcgcctgccgctgcaggatgtgtacaagatcggcggtatcggcaccgtgccggtcggtcgcgtggagacgggcacgatgaagcccggcgacgtggtgacgtttgcgcccgccaacgtgacgacggaggtgaagtcgattgagatgcaccacgagcagctggccgaggccacgcccggcgacaacgtcggcttcaacgtgaagaacgtgtccgtgaaggacatccgccgtggcaacgtgtgcggcaactcgaagaacgatcccccaaaggaggcggccgacttcacggcgcaggtgatcatcctgaaccaccccggccagatcggcaacggctatgcgccggtgcttgactgccacacctgccacatcgcgtgcaagttcgccgagatcgagtccaagatcgaccgccgctccggcaaggagcttgagaagaaccccaagtcgatcaagtccggtgacgccgccatggtgcgcatggtgccgcagaagcccatgtgcgtggaggtgttcaacgactacgctcctcttggccgctttgccgtgcgtgac

SEQ ID NO: 842 - DNA, 1062 bp, Trypanosoma cruzi
  strain PCU-1
gctgaaggctgagcgcgagcgcggcatcacgatcgacatcgcgctctggaagttcgagtcgcccaagtctgtgttcacgatcatcgacgcccccggccaccgcgacttcatcaagaacatgatcacgggcacgtctcaggcggacgccgccgtccttgtcattgcgtcatcgcagggtgagtttgaggcgggcatctcgaaggacggccagacacgcgagcacgcgctgctcgccttcacgctcggcgtgaagcagatggttgtgtgctgcaacaagatggacgacaagtcggtgaacttcgcccaggagcgctacgatgagattgtgaaggaggtgtcggcgtacctgaagaaggttgggtacaacgtggagaaggtgcgcttcatccccatctccggctggcagggcgacaacatgattgacaagtcggaaaatatgccgtggtacaagggccccacgctgctggaggcactcgacatgctggagcccccggtgcgccccagcgacaagccgctgcgcctgccgctgcaggacgtgtacaagatcggcggtatcggcaccgtgccggtcggtcgcgtggagacgggcacgatgaagcccggcgacgtggtgacgtttgcgcccgccaacgtgacgacggaggtgaagtcgattgagatgcaccacgagcagctggccgaggccacgcccggcgacaacgtcggcttcaacgtgaagaacgtgtccgtgaaggacatccgccgtggcaacgtgtgcggcaactcgaagaacgaccccccaaaggaggcggccgacttcacggcgcaggtgatcatcctgaaccaccccggccagatcggcaacggctatgcgccggtgctcgactgccacacctgccacatcgcgtgcaagttcgccgagatcgagtccaagatcgaccgccgctccggcaaggagcttgagaagaaccccaagtcgatcaagtccggtgacgccgccatggtgcgcatggtgccgcagaagcccatgtgcgtggaggtgttcaacgactacgctcctcttggccgctttgccgtgcgtga

SEQ ID NO: 843 - DNA, 1057 bp, Babesia bovis
  strain Suarez-3
tacattgacagctgcattgaccaaggtctgttcgatgggtggtcatggcgagtacactccttatgaagcaattgaccgtgctcctgaggagcgtaaacgtggtattactataaattcgacacatgttgaatatgagactaagaaccgtcattacggtcacgtggactgtccaggtcactctgattatgtgaagaacatgatatctggcgctgctcagatggatggtgccatattggttgtttcttgtgttgacggtcccatgcctcagactaaggagcacgtgttgcttgctaagcagattggtgtacctcgtttagttgtgtttttgaacaagcttgacatgttagaggactctgagctattggagttggtggagttagaggttcgtgagttattgagtgagtttggttacgacggtgacaacacgcctatcgttcgtggcagtgctataaaggcattgaacagtagttccgaggctgacattaagccaattcaggatttattggatgcgtgtgatgcctttttactgactccagaacgtaaggatgacatgccgctcttggttgctattgacgatgttcttgccattcctggcaagggtactgttgtaaccggtaggatagagcagggcaagattcgttgtggtgaccctattgaggtttgcgccggtccgaagtccggcaagaagactgtgtgtgttggtcttraratgttccgcaagagtctcagtragggtattgctggtgaccagattggtgttttgctcaagggtgtgaagcgcgacraggtagagcgcgggtttgtattgattcaacccggaagttacaaatgtcacggtgaatttgatgctgacttgtacgtgttgactacgraggaaggtgggcgcaagcatccgtttgtgtctaactaccgtcctcaggcgtttatacgtactggagacgtttgctgctcagttcatttggatragggtgttgagatggcagctcctggtgacaacgtgcgttgcaagatcaagttactttatcccatgcctgtccatgaaggtttacgatttgcg

SEQ ID NO: 844 - DNA, 943 bp, Leishmania aethiopica
  ref <308>: DATABASE ACCESSION NUMBER: ATCC 50119
cggtggcatcattgtggtggcggccaccgacggcgtcatgccgcagacacgcgagcacctcctgatctgctcgcagattgggcttccggcgctcgtagggttcatcaacaaagtggatatgacggacgaggacacgtgcgacctggtggacatggaggtgcgcgagcagctggagaaatacaagtttccggcggaggagacaccaatcgtgcgcggctcggccctcaaggccgtcgagggcgacgcgaagtacgaggagaacatcctcgaactggtgcggaagtgcgacgagtggatccccgacccgccgcgcaacacagacaagcctttccttatggccatcgagcacgtttacgagatcggcaaggacaagaagagcgtcatcgtgaccggccgcgtcgatcagggcgtgctgaagctcaacacagacgccgagctggccggcttcagcgccaagaagtcgacggtgagggtgacgggcatcgagatgtaccacaagacgctgagcgagtgcatgcccggtgactccgtcggcgtcagcattgtcggcaccggcgacacaaccagtctgtccaaggacaacgtggaacgcggcatggtaatggcggcgacgggtagcacgaacctgtacaacaaggtgaaggcgcaggtgtacgtgctgacgaaggatgagggcggccgccacaccggcttcagcccccactaccgcccgcagctcttcttccattgcgctgacgtgacagcggacatgagcttcccggaggcggagaagcaccgggaggagctgaacaagaaattcggccgcggccccgaggaggacaagaagaaagaggcggagatgaaggagttcgagagcaagctcgtctgcatgccgggcgataaccgcgagctgatcctgacgctcgcgtacccgatgcccattgaaaagggcctgaagttcacc

SEQ ID NO: 845 - DNA, 939 bp, Leishmania amazonensis
  ref <308>: DATABASE ACCESSION NUMBER: ATCC 50131
cggtggcatcattgtggtggcggccaccgacggcgtcatgccgcagacacgcgagcatctcttgatctgctcgcagattgggcttccggcgctcgtagggttcatcaacaaagtggacatgacggacgaggacacgtgcgacctggtggacatggaggtgcgtgagcagctggagaaatacaagtttccggcggaagagacgcccatcgtgcgcggctcggccctcaaagccgtcgagggcgacgcgaagtacgaggagaacatcctcgaactggtgcggaagtgcgacgaatggatccccgacccgccgcgcaacacagacaagcctttccttatggccattgagcacgtttacgagatcggcaaggacaagaagagcgtcatcgtgaccggccgcgtcgatcagggcgtgctgaagctcaacacagacgccgagctggccggcttcagcgccaagaagtcgacggtgagggtgacgggcatcgagatgtaccacaagacgctgagtgagtgcatgcccggtgactccgtcggcgtcagcattgtcggcaccggcgacacgatcagtctctccaaggacaacgttgaacgcggcatggtaatggcggcaacgggtagcacgaacctgtacaacaaggtgaaggcgcaggtgtacgtgctgacgaaggatgagggcggccgccacactggcttcagcccccactaccgcccgcagctcttcttccattgtgctgacgtgacggcggacatgagcttcccggaggcggagaagcaccgcgaggagctcaacaagaaattcggccgcggccccgaggaggacaagcagaaggaggcggagatgaaagagttcgagagcaagctcgtctgcatgccgggcgacaaccgcgagctgatcctgacgctggcgtacccgatgcccattgacaagggtctgaagtt

SEQ ID NO: 846 - DNA, 945 bp, Leishmania donovani
  ref <308>: DATABASE ACCESSION NUMBER: ATCC 50212
cattgtggtggcggccaccgacggcgtcatgccgcagacacgcgagcacctcctgatctgctcgcagatcgggcttccggcgctcgtagggttcatcaacaaggtggacatgacggacgaggacacgtgcgacctggtggacatggagctgcgcgagcagctggagaaatacaagtttccggcggaggagacgccaatcgtgcgcggctcagccctcaaagccgtcgagggcgatgcgaagtacgaggagaacattctcgaactggtgcggaagtgtgacgagtggatccctgacccgccgcgcaacacagacaagcctttccttatggccatcgagcacgtttacgagatcggcaaggacaagaagagcgttgtcgtgaccggccgcgtcgatcagggcattctgaagctcaacacagacgccgagctggccggcttcagctccaagaagtcgacggtgagggtgacgggcatcgagatgtaccacaagacgctgagcgagtgcatgcctggtgactccgtcggcgtcagcattgtcgggaccggcgacacgaccagtctatccaagggcaacgtggaacgcggcatggtgatggcggcgacgggtagcacgaacctgtacaacaaggtgaaggcgcaggtgtacgtgctgacgaaggatgagggcggccgccacactggctttagtcctcactaccgcccgcagctcttcttccattgtgctgacgtgacggcggacatgagcttcccggaggcggagaagcaccgcgaagagctcaacaagaaattcggccgcggccccgaggaggacaagaagaaagaggcagcgatgaaggagttcgagagcaagctcgtctgcatgccgggcgataaccgcgagctgatcctgacgctggcgtacccgatgcccattgaaaagggtctgaagttcaccatccgtgaggg

SEQ ID NO: 847 - DNA, 939 bp, Leishmania infantum
  strain MOU
ggcatcattgtggtggcggccaccgacggcgtcatgccgcagacacgcgagcacctcctgatctgctcgcagatcgggcttccggcgctcgtagggttcatcaacaaggtggacatgacggacgaggacacgtgcgacctggtggacatggagctgcgcgagcagctggagaaatacaagtttccggcggaggagacgccaatcgtgcgcggctcagccctcaaagccgtcgagggcgatgcgaagtacgaggagaacattctcgaactggtgcggaagtgtgacgagtggatccctgacccgccgcgcaacacagacaagcctttccttatggccatcgagcacgtttacgagatcggcaaggacaagaagagcgttgtcgtgaccggccgcgtcgatcagggcgttctgaagctcaacacagacgccgagctggccggcttcagctccaagaagtcgacggtgagggtgacgggcatcgagatgtaccacaagacgctgagcgagtgcatgcctggtgactccgtcggcgtcagcattgtcggcaccggcgacacgaccagtctatccaagggcaacgtggaacgcggcatggtgatggcggcgacgggtagcacgaacctgtacaacaaggtgaaggcgcaggtgtacgtgctgacgaaggatgagggcggccgccacactggctttagtcctcactaccgcccgcagctcttcttccattgtgctgacgtgacggcggacatgagcttcccggaggcggagaagcaccgcgaagagctcaacaagaaattcggccgcggccccgaggaggacaagaagaaagaggcagcgatgaaggagttcgagagcaagctcgtctgcatgccgggcgataaccgcgagctgatcctgacgctggcgtacccgatgcccattgaaaagggtctgaagttcacc

SEQ ID NO: 848 - DNA, 933 bp, Leishmania enriettii
  ref <308>: DATABASE ACCESSION NUMBER: ATCC 50120
caccgacggcgtcatgccgcagacacgggagcacctgctcatctgctcgcagatcgggctgccggcgcttgtagggttcatcaataaagttgacatgacggacgaggatacgtgcgacctcgtggacatggaggtgcgggaacagctggagaagtacaagtttccggccgaggagacgcccatcgtacgtggctcggccctcaaggccctcgagggggatgcgcaatacgaggggagtattctcgagctggtgcgaaagtgcgacgagtggatccccgacccgccgcgcaacaccgaaaagcctttcctcatggctatcgagcacgtttacgagctcggcaaagacaagaagagcgtcatcgttaccggccgcgtcgatcaaggtgtgctgaagctcaacacagacgccgagctggccggcttcagcgccaagaaggcgacagtcaaagtgacgggcatcgagatgtatcacaagacactcaatgagtgcatgcccggcgactctgtcggtgtcagcatcgtcggtaccggtgacacgaccagcttatccaaggataatgttgagcgcggtatggtaatggcggcaacgggtagcacgaacctgtacaacaagctgaaggcgcaggtttacgtgctgacaaaggaggagggtggccgccacaccgggttcagcccccactaccgcccgcagctcttcttccactgcgctgacgtgaccgcagacatgagcttcccggaggcggagaagtaccgcgaggagctcaacaagaagttcggccgtggccctgaggaggacaagaagaaagaggcggagatgaaggagttcgaaagcaaacttgtctgcatgccaggcgataaccgcgagctgatcctaactctggcgtacccgatgcccatcgacaagggcctgaagttcaccatccgtgagggcgg

SEQ ID NO: 849 - DNA, 943 bp, Leishmania gerbilli
  ref <308>: DATABASE ACCESSION NUMBER: ATCC 50121
cggtggcatcattgtggtggcggccaccgacggcgtcatgccgcagacacgcgagcacctcctgatctgctcgcagattgggcttccggcgctcgtagggttcatcaacaaagtggacatgacggacgaggacacgtgcgacctggtggacatggaggtgcgcgagcagctggagaaatacaagtttccggcggaggagacaccaatcgtgcgcggctcggccctcaaggccgtcgagggcgacgcgaagtacgaggagaacatcctcgaactggtgcggaagtgcgacgagtggatccccgacccgccgcgcaacacagacaagcctttccttatggccatcgagcacgtttacgagatcggcaaggacaagaagagcgtcatcgtgaccggccgcgtcgatcagggcgtgctgaagctcaacacggacgccgagctggccggcttcagcgccaagaagtcgacggtgagggtgacgggcattgagatgtaccacaagacgctgagcgagtgcatgcccggtgactccgtcggcgtcagcattgtcggcaccggcgacacgaccagtctgtccaaggacaacgtggaacgcggcatggtaatggcggcgacgggtagcacgaacctgtacaacaaggtgaaggcgcaggtgtacgtgctgacgaaggatgagggcggccgccacactggcttcagcccccactaccgcccgcagctcttcttccattgcgctgacgtgacagcggacatgagcttcccggaggcggagaagcaccgcgaggagctcaacaagaaattcggccgcggccccgaggaggacaagaagaaagaggcggagatgaaggagttcgagagcaagctcgtctgcatgccgggcgataaccgcgagctgatcctgacgctggcgtacccgatgcccattgaaaagggtctgaagttcacc

SEQ ID NO: 850 - DNA, 918 bp, Leishmania major
  ref <308>: DATABASE ACCESSION NUMBER: ATCC 50122
ggcatcattgtggtggcggccaccgacggcgtcatgccgcagacacgcgaacacctcctgatctgctcgcaaattggccttccggcgctcgtagggttcatcaacaaagtggacatgacggacgaggacacgtgtgacctggtggacatggaggtgcgcgagcagctggagaaatacaagtttccggcggaggagacaccaatcgtgcgcggctcggccctcaaggccgtcgagggcgacgcgaagtacgaggagaacatcctcgaactggtgcggaagtgcgacgagtggatccccgacccgccgcgcaacacagacaagcctttccttatggccatcgagcacgtttacgagatcggcaaggacaagaagagcgtcatcgtgaccggccgcgtcgatcagggcgtgctgaagctcaacacagacgccgagctggccggcttcagcgccaagaagtcgacggtgagggtgacgggcattgaaatgtaccacaagacgctgagcgagtgcatgcccggtgactccgtcggcgtcagcattgtcggcaccggcgacacgaccagtctgtccaaggacaacgtggagcgcggcatggtaatggcggcgacgggtagcacgaacctgtacaacaaggtgaaggcgcaggtgtacgtgctgacgaaggatgagggcggccgccacactggcttcagcccccactaccgcccgcagctcttcttccattgcgctgacgtgacagcggacatgagcttcccggaggcggagaagcaccgcgaggagctcaacaagaaattcggccgcggccccgaggaggacaagaagaaagaggcggagatgaaggagttcgagagcaagctcgtctgcatgccgggcgataaccgcgagctgatcctgacgctggcgtacccgatgcccatt

SEQ ID NO: 851 - DNA, 939 bp, Leishmania mexicana
  ref <308>: DATABASE ACCESSION NUMBER: ATCC 50156
cggtggcatcattgtggtggcggccaccgacggcgtcatgccgcagacacgcgagcatctcctgatctgctcgcagattgggcttccggcgctcgtagggttcatcaacaaagtggacatgacggacgaggacacgtgcgacctggtggacatggaggtgcgtgagcagctggagaaatacaagtttccggcggaagagacgcccatcgtgcgcggctcggccctcaaggccgtcgagggcgacgcgaagtacgaggagaacatcctcgaactggtgcggaagtgcgacgaatggatccccgacccgccgcgcaacacagacaagcctttccttatggccattgagcacgtttacgagatcggcaaggacaagaagagcgtcatcgtgaccggccgcgtcgatcagggcgtgctgaagctcaacacagacgccgagctggccggcttcagcgtcaagaagtcgacggtgagggtgacgggcatcgagatgtaccacaagacgctgagtgagtgcatgcccggtgactccgtcggcgtcagcattgtcggcaccggcgacacgatcagtctctccaaggacaacgttgaacgcggcatggtaatggcggcaacgggtagcacgaacctgtacaacaaggtgaaggcgcaggtgtacgtgctgacgaaggatgagggcggccgccacactggcttcagcccccactaccgcccgcagctcttcttccattgtgctgacgtgacggcggacatgagcttcccggaggcggagaagcaccgcgaggagctcaacaagaaattcggccgcggccccgaggaggacaagcagaaggaggcggagatgaaagagttcgagagcaagctcgtctgcatgccgggcgacaaccgcgagctgatcctgacgctggcgtacccgatgcccattgagaagggtctgaagtt

SEQ ID NO: 852 - DNA, 912 bp, Leishmania tarentolae
  strain MOU-2
tcattgtggtggccgccaccgacggcgtcatgccgcaaacacgggagcaccttttgatctgctcgcagatcgggctgccggcgctcgtagggttcatcaacaaagtggacatgacagacgaagacacgtgcgacctggtagacctggaggtgcgtgagcagctggagaagtacaagtttccggcagaggaaacaccaatcgtgcgtggctcggccctcaaggccgttgagggcgatgcaaagtacgaggagaacatcctcgaactggtgcggaagtgcgacgagtggatcccagacccgccacgcaatacggacaagcctttccttatggccattgaacacgtgtacgagatcggcaaggataggaaaagcgtcatcgtaaccggccgcgtcgatcaaggtgtgctgaagctgaacacagacgccgagctggccggcttcagcgccaagaagtcgacggtgaaagtgacgggcattgagatgtaccacaagacactgacagagtgcatgcccggcgactctgtcggcgtcagcattgtgggcactggygacacgaccagcctctctaaggacaatgttgagcgtggcatggtactggccgctacgggtagcacgaacctgtacaacaaagtaaaggcgcaggtgtatgtactcacgaaggatgagggcggccgccacaccggcttcagcccccactaccgtccgcagctcttcttccactgcgctgacgtaacggcggacatgagcttcccggaggcggagaagcaccgcgaggaactcaataagaaattcggccgcggccccgaggaggacaagaaaaaggaggcggagatgaaggagttcgagagcaagctggtctgcatgccaggcgataaccgcgagctgatcctgacattggcgtacccgatgccta

SEQ ID NO: 853 - DNA, 936 bp, Trypanosoma cruzi
  strain MM3
attcttgtggtggcagctaacgacggatgcatgccgcagacgcgtgagcacctgcttatttgttcgcagattggccttcctgctcttgtatgctttatcaataagtgtgacatgatgcaagggcaggaggaaatgattgaacttgttgaaatggaggtacgtgaacttttggagaagtacaagttccctgcggaggagacgccatttgtgcgggggtctgcggtgaaggcattggagggtgatgctgaaaatgaaggaaagattttggagcttgtaaaaaaatgtgatgaatggattcccgacccaccgcgtgccattgaaaaaccgttccttatggccattgagcacgtttttgaggttggaaaggataagaaggccgttgttgtgagcgggcgtgtggaccaggggcagttgaaggtcggcgcagatgcagaactttccgggtttagcgcaaagaagctgacggtgaaggttgctagcatcgaaatgtaccataaaattctggaggattgcatgcctggtgactctgttggcgcgaagatcgttggcagcggtgaaacagtgaacctgtcgaaggaaaatgtggaacgcggcatggtactctccgcaccaggtgcaacgacactgttcaacaaggtccgcgcgcaggtgtacgtgttgacaaaggaagaaggcggtcgtcacacagcctttagtcctcactatcgtccgcagcttttcttccactgtgctgatgtcacggcagatattaacttcccggaaagcgagaagcttgcaggggagctgaacaaaaagtatggccgtgatgcggcggaacagaagaagaaggaggcagaactgaaagagtttgaaaagacgcttgtctgcatgcctggtgataaccgcgaactcctgctcacccttgcctatccaatgccaatggaaaagggactcaag

SEQ ID NO: 854 - DNA, 934 bp, Trypanosoma cruzi
  strain PCU-1
cggcattcttgtggtggcagctaacgacggatgcatgccgcagacgcgtgagcacctgcttatttgttcgcagattggccttcctgctcttgtatgctttatcaataagtgtgacatgatgcaagggcaggaggaaatgattgagcttgttgaaatggaggtacgtgaacttttggagaagtacaagttccctgcggaggagacgccatttgtgcgggggtctgcggtgaaggcattggagggtgatgctgaaaatgaaggaaagattttggagcttgtaaaaaaatgtgatgaatggattcccgacccaccgcgtgccattgaaaaaccgttccttatggccattgagcacgtttttgaggttggaaaggataagaaggccgttgttgtgagcgggcgtgtggaccaggggcagttgaaggtcggcgcagatgcagaactttccgggtttagtgcaaagaagctgacggtgaaggttgctagcatcgaaatgtaccataaaattctggaggattgcatgcctggtgactctattggcgcgaagatcgttggcagcggtgaaacagtgaacctgtcgaaggaaaatgtggaacgcggcatggtactctccgcaccaggtgcaacgacactgttcaacagggtccgcgcgcaggtgtacgtgttgacaaaggaagaaggcggtcgtcacacagcctttagtcctcactatcgtccgcagcttttcttccactgtgctgatgtcacggcggatattaacttcccggaaagcgagaagcttgcaggggagctgaacaaaaagtatggccgtgacgcggcggaacagaagaagaaggaggcagaactgaaagagtttgaaaagacgcttgtctgcatgcctggtgataaccgcgaactcctgctcacccttgcctatccaatgccaatggaaaaggga

SEQ ID NO: 855 - DNA, 937 bp, Trypanosoma cruzi
  strain CGL-1
tggcggcattcttgtggtggcagctaacgacggatgcatgccgcagacgcgtgagcacctgcttatttgttcgcagattggccttcctgctcttgtatgctttatcaataagtgtgacatgatgcaagggcaggaggaaatgattgaacttgttgaaatggaggtacgtgaacttttggagaagtacaagttccctgcggaggagacgccatttgtgcgggggtctgcggtgaaggcattggagggtgatgctgaaaatgaaggaaagattttggagcttgtaaaaaaatgtgatgaatggattcccgacccaccgcgtgccattgaaaaaccgttccttatggccattgagcacgtttttgaggttggaaaggataagaaggccgttgttgtgagcgggcgtgtggaccaggggcagttgaaggtcggcgcagatgcagaactttccgggtttagcgcaaagaagctgacggtgaaggttgctagcatcgaaatgtaccataaaattctggaggattgcatgcctggtgactctgttggcgcgaagatcgttggcagcggtgaaacagtgaacctgtcgaaggaaaatgtggaacgcggcatggtactctccgcaccaggtgcaacgacactgttcaacaaggtccgcgcgcaggtgtacgtgttgacaaaggaagaaggcggtcgtcacacagcctttagtcctcactatcgtccgcagcttttcttccactgtgctgatgtcacggcagatattaacttcccggaaagcgagaagcttgcaggggagctgaacaaaaagtatggccgtgatgcggcggaacagaagaagaaggaggcagaactgaaagagtttgaaaagacgcttgtctgcatgcctggtgataaccgcgaactcctgctcacccttgcctatccaatgccaatggaaaaggga

SEQ ID NO: 856 - DNA, 888 bp, Babesia bigemina
  strain Suarez-2
cttattatggagctgatcaacaacgtcgcgaagaagcacggtggtttctccgtgttcgccggcgtcggcgagcgcaccagggagggcaacgagctgtaccacgagatgatggagaccggcgtcatcaagcgccgccagctggatgacggcacgttcgacttctccggctccaaggccgcgctggtgtacggccagatgaacgagccgccaggtgccagggcgcgtgttgccctcactggcctgacggtggccgagtacttccgtgatgaggacggccaggacgtgctgctcttcatcgacaacatctaccgtttcacccaggctggttctgaggtgagtgcccttttggggcgcatcccgtccgccgtcggttaccagccgaccctcgccaccgaccttggcgcgctgcaggagcgtatcacgacgaccaacaagggctccatcacctccgtgcaggccgtctacgtgccggccgacgatatcaccgacccggcgcctgcgaccaccttcacccatctggacgcgaccactgtgctctcccgttccatcgccgagctgggtatctaccccgccgtcgacccgctcgactccacctcgcgtatgctgtccgcgaacatcgtcggcgaggagcagtacaacgtggcgcgtggcgtgcagaaaatactgcaggactacaaatcgctgcaggatatcatcgccatcctgggtatggacgagctgtctgagcaggacaagttcgtcgtcgcgcgtgcgcgcaaggttcagcgtttcctatcccagcccttccaggtggctgaggtattcaccggcaagcccggacgtttcgtcgagctgcaggacaccatcagcggcgtcaaggagattttggacggcgagtgcgacgacatg

SEQ ID NO: 857 - DNA, 884 bp, Babesia bovis
  strain Suarez-3
tgattatggaattgatcaacaatgtcgccaagaaacacggtgggttctccgtgttcgctggtgttggtgaacgtacgagggaaggtaacgaactgtaccatgaaatgatggaaacgggtgtcatcaagcgccgtcaactggaagacggaacatttgacttctcgggctctaaagctgctttggtgtacggacaaatgaacgaaccaccaggtgctagagcccgtgttgcactcacgggattgaccgttgccgagtatttccgtgatgaagaggggcaggatgtgctactcttcatcgataacatctaccgtttcacccaggccggttccgaagtgagtgcgctgttaggaagaattccatccgccgtgggttatcaacctacattggccactgatctcggagcactccaggaacgcattactacaaccaacaagggttcgattacatcagtccaggcagtatacgtcccagccgatgatatcactgatcccgctccagctaccactttctcgcacttggatgccactacagtgctttctcgttcaattgcggagttgggtatttaccctgcggtcgacccgcttgactcaacgtcacgtatgctgtcggccaacattgtaggacaggaacagtacgatgccgcacgtggtgtacagaaaattttacaggactacaaatcactgcaggatatcattgccattctgggtatggacgagctgtctgagcaggacaagttcgttgtagcacgcgcccgtaaggtacagcgtttcctgtctcagccgttccaagtggctgaggtgttcaccggcaagcctgggaggttcgttgaactacaggataccatcagcggtgtcaaggaaatctggaaggtgagtgtgacgata

SEQ ID NO: 858 - DNA, 871 bp, Babesia microtti
  strain Persing-1
tggaactgattaataatgtggccaaaaagcatggcggttactctgtttttgcaggtgtaggtgaaaggacgagggagggtaatgaattgtaccatgaaatgatggagacaggtgttataaagaaaaaggcactaggtggtgggaagtttgatttcagtggatctaaagcagcgctggtctatggacaaatgaacgagccacctggggcccgtgctagagtggcactaactggattaacagtcgcagaatatttccgtgacgaacaaggacaagacgtgttgttgtttattgataatatttaccgatttactcaggcagggtctgaggtttcagccttgctaggccgtataccttcagctgtgggataccagcctacattggcaacagatcttggctgtttacaagaacgaattactacgaccaaatctggttcaatcaccagtgtacaagctgtgtatgtgccagcagatgatattactgatccagcgcctgccacaacttttactcacttggacgctactactgtacttagcaggccaattgctgaactcggtatttatccagcggtagacccgttggattcaacaagccgtatgctaagcgcgaacattgtgggaaatgaacactatagtgtagcccgttccgtgcagaagatactgcaagattacaaatcgcttcaggacattattgccattttgggtatggatgaactgtcggaacaagacaaaaatatagtagcccgagcaaggaagatgcaaaggttcttatcacagccattccaagtggcggaagtttttactggtaaaccgggaagatttgtggaattggaagatacaattgccggggcacgagatataattgcgggtaattg

SEQ ID NO: 859 - DNA, 1255 bp, Leishmania guyanensis
  ref <308>: DATABASE ACCESSION NUMBER: ATCC 50126
tgacggcgctggacgtgacggaggacctcggccgcgatgagccgctgacgctggagatcgtgcagcacttggatgcgaacaccggccgctgcattgcgatgcagacgacggacctgctgaagctgaagtcgaaggttgtgtcgaccggcggcaacatctccgtgccggtgggccgcgagacactgggccgcatcttcaacgtgctgggcgacgcgattgaccaccgcggccccgtgtgcgagaagatgcgcatggcgatccacgccgaggcgccgaagctggcggaccaggctgcggaggacacgatcctgacgaccggcatcaaggtgatcgacctgattctgccctactgcaagggcggcaagatcggcctgttcggcggtgccggtgtgggcaagactgtgatcatcatggagctgatcaacaacgtcgcgaaggggcacggcggcttctccgtgttcgccggcgttggcgagcgcacgcgcgagggcacggacctgtacctggagatgatgcagtcaaaggtgattgacctgaagggcgagtcgaagtgcgtgcttgtgtacgggcagatgaacgagcccccgggtgcgcgcgcgcgcgttgcgcagtctgcgctgacgatggccgagtacttccgcgacgtggagggccagaacgtgctgctgttcatcgacaacatcttccgcttcacgcaggcgaactccgaggtgtctgcgctgctgggccgcatcccggccgccgtgggttaccagccgacgcttgcggaggatcttggcatgctgcaggagcgcattacgtcgacgacgaagggatcgattacgtctgtgcaggctgtgtacgtgcctgcggatgatatcacggaccccgcgcccgcgacgacgttctcgcacctggacgcgacgactgtgctggaccgcgcggtggcggagtcgggcatctaccctgccgtgaacccgctggagtgcgcgtcgcgcatcatggaccccgatgtgatcgacgtggaccattacaacgttgcacaggatatcgtccagatgctgaccaagtacaaggagctgcaggacatcattgcggtgcttggcatcgacgagctgagcgaggaggacaaggtcgtggtggaccgcgcgcgcaaggtgacgcggttcctgtcgcagccgttccaggttgcggaggtgttcaccggcatgacgggccactacgtgcagctgagcgacacggtggagtcgttctctggcctgctgatggggtcgta

SEQ ID NO: 860 - DNA, 1222 bp, Leishmania mexicana
  ref <308>: DATABASE ACCESSION NUMBER: ATCC 50156
ctcggagggcgtcccgcccgtgctgacggcgctggatgtgacggaggaccttggccgcgatgagccgctgacgctggagatcgtgcagcacctggacgcgaacaccggccgctgcattgcgatgcagacgacggacctgctgaagctgaagtcgaaggttgtgtcgaccggcggcaacatctctgtgccggtgggccgtgagacgctgggccgcatcttcaacgtgctgggcgacgcgatcgaccagcgcggccccgtgggtgagaagatgcgcatggcgatccacgccgaggccccgaagctggcggatcaggccgcggaggacacgatcctgacgaccggcatcaaggtgatcgacctgattctgccctactgcaagggtggcaagatcggcctgtttggcggcgccggtgtgggcaagaccgtgatcatcatggagctgattaacaacgtcgcgaagggccacggtggtttctcggtgtttgccggcgttggcgagcgcacgcgcgagggcacggacctgtacctggagatgatgcagtcgaaggtgattgacctgaagggcgagtcgaagtgcgtgcttgtgtacgggcagatgaacgagcccccgggtgcgcgcgcgcgcgttgcgcagtctgcgctgacgatggcggagtacttccgagacgtggagggccagaatgtgctgctgttcatcgacaacatcttccgcttcacgcaggcgaactccgaggtctctgcgctgctgggccgcattccggccgccgtgggctaccagccgacgcttgcggaggatcttggtatgctgcaggagcgcatcacgtcgacgacgaaggggtcgatcacgtccgtgcaggccgtgtacgtgcctgcggatgatatcacggatccggcgcccgcgacgacgttctcgcacctggacgcgacgactgtgctggaccgcgcggtggcggagtcggggatctaccctgccgtgaacccgctggagtgcgcgtcgcgtatcatggaccccgatgtgatcgacgtggaccactacaacgttgcgcaggatatcgtgcagatgctgaccaagtacaaggagctgcaggatatcattgcggtgcttggtatcgacgagctgagcgaggaggacaaggtcgtggtggaccgcgcgcgcaaggtgacccggttcctgtcgcagccgttccaggttgcggaggtgttcacgggcatgacgggccac

SEQ ID NO: 861 - DNA, 1246 bp, Leishmania tropica
  ref <308>: DATABASE ACCESSION NUMBER: ATCC 50129
ccgtgctgacggcgctggatgtgacggaggaccttggccgcgatgagccgctgacgctggagatcgtgcagcacttggacgcgaacaccggccgctgcattgcgatgcagacgacggacctgctgaagctgaagtcgaaggttgtgtcgaccggcggcaacatctctgtgccggtgggccgtgagacgctgggccgcatcttcaacgttctgggcgacgcgatcgaccagcgcggccccgtgggcgagaagatgcgcatggcgatccacgccgaggccccgaagctggcggatcaggccgcggaggacacgatcctgacgaccggcatcaaggtgatcgacctgattctgccctactgcaagggtggcaagatcggcctgttcggcggtgccggtgtgggcaagactgtgatcatcatggagctgatcaacaacgtcgcgaagggccacggtggtttctccgtgtttgccggcgttggcgagcgcacgcgcgagggcacggacctgtacctggagatgatgcagtcgaaggtgattgacctgaagggcgagtcgaagtgcgtgcttgtgtacgggcagatgaacgagcccccgggtgcgcgcgcgcgcgttgcgcagtctgcgctgacgatggcggagtacttccgcgacgtggagggccagaacgtgctgctgttcatcgacaacatcttccgcttcacgcaggcgaactccgaggtgtctgcgctgctgggccgcattccggccgccgtgggctaccagccgacgcttgcggaggatcttggtatgctgcaggagcgcatcacgtcgacaacgaaggggtcgatcacgtccgtgcaggccgtgtacgtgccagcggatgatatcacggatcccgcgcccgcgacgacgttctcgcacctggacgcgacgactgtgctggaccgcgcggtggcggagtcgggcatctaccctgccgtgaacccgctggagtgcgcgtcgcgtatcatggaccccgatgtgatcgatgtggaccactacaacgttgcgcaggatatcgtgcagatgctgaccaagtacaaggagctgcaggatatcattgcggtgcttggcatcgacgagctgagcgaggaagacaaggttgttgtggaccgcgcgcgcaaggtgacccggttcctgtcgcagccgttccaggttgcggaggtgttcacgggcatgacgggccactacgtgcagctggtcgacacggtggagtcgttctctggcct

SEQ ID NO: 862 - DNA, 1265 bp, Leishmania tropica
  ref <308>: DATABASE ACCESSION NUMBER: ATCC 30815
ggcgtgccgcccgtgctgacggcgctggatgtgacggaggaccttggccgcgatgagccgctgacgctggagatcgtgcagcacttggacgcgaacacgggccgctgcattgcgatgcagacgacggacctgctgaagctgaagtcgaaggtcgtgtcgaccggcggcaacatctctgtgccggtgggccgtgagacgctgggccgcatcttcaaygttctgggcgacgcgatcgaccagcgcggccccgtgggcgagaagatgcgcatggcgatccacgccgaggccccgaagctggcggatcaggccgcggaggacacgatcctgacgaccggcatcaaggtgatcgacctgattctgccctactgcaagggtggcaagatcggcctgttcggcggtgccggtgtgggcaagactgtgatcatcatggagctgatcaacaacgtcgcgaagggccacggcggtttctccgtgtttgccggcgttggcgagcgcacgcgcgagggcacggacctgtacctggagatgatgcagtcgaaggtgattgacctgaagggcgagtcgaagtgygtgcttgtgtatgggcagatgaacgagcccccgggtgcgcgcgcgcgcgttgcgcagtctgcgctgacgatggcggagtacttccgcgacgtggagggccagaacgtgctgctgttcatcgacaacatcttccgcttcacgcaggcgaactccgaggtgtctgcgctgctgggccgcattccggccgccgtgggctaccagccgacgcttgcggaggatcttggtatgctgcaggagcgcatcacgtcgacaacgaaggggtcgatcacgtccgtgcaggccgtgtacgtgccagcggatgatatcacggatcccgcgcccgcgacgacgttctcgcacctggacgcgacgactgtgctggaccgcgcggtggcggagtcgggcatctaccctgccgtgaacccgctggagtgcgcgtcgcgtatcatggaccctgatgtgatcgatgtggaccactacaacgttgcgcaggatatcgtgcagatgctgaccaagtacaaggagctgcaggatatcattgcggtgcttggcatcgacgagctgagcgaggaagacaaggttgttgtggaccgcgcgcgcaaggtgacccggttcctgtcgcagccgttccaggttgcggaggtgttcacgggcatgacgggccactacgtgcagctggtcgacacggtggagtcgttctctggcctgctgatggg

SEQ ID NO: 863 - DNA, 1191 bp, Bordetella pertussis
atggcaaaaggcaagtttgaacgtaccaagccgcacgtgaacgtgggtacgattggtcacgttgaccacggcaaaacgacgttgacggcggcgatcacgacggtgctgtcgaacaagttcggcggcgaggctcgcggctacgaccagattgacgcggcgccggaagagaaggcgcgtgggatcacgatcaacacctcgcacgttgagtacgagacggagacgcgtcactacgcgcacgttgattgcccgggtcacgctgactacgtgaagaacatgatcacgggtgctgcgcagatggacggcgcgatcctggtggtgtcggccgcagacggcccgatgccgcagacgcgcgagcacattttgctgtcgcgccaggttggcgtgccgtacatcatcgtgttcctgaacaaggcggacatggttgatgacgcggagctgctcgagctggtggagatggaagtccgcgaactgctgagcaagtacgatttcccgggcgatgacacgccgatcgtgaatggtgcggccaagctggcgctggaaagcgacaacggcgacctgggcgagcaggcgattctgtcgctggcgcaagcgctggacacgtacattccgacgccggagcgcgcggtcgacggtgcgttcctgatgccggtggaagacgtgttctcgatctcgggccgtggcacggtggtgactggccgtatcgagcgcggcgtggtgaaggttggcgaggaaatcgaaatcgtgggcatcaagccgacggtgaagacgacctgcacgggcgtggagatgttccgcaagctgctggaccagggccaggcgggcgacaacgtgggtatcttgctgcgcggcaccaagcgtgaagacgtcgagcgtggccaggtgctggccaagccgggttcgatcaacccgcacacggacttcacggccgaggtgtacattctgtccaaggaagagggtggccgtcacacgccgttcttcaacggctatcgtccgcagttctacttccgcacgacggacgtgaccggcacgatcgacctgccggcggacaaggaaatggtgctgccgggcgacaacgtgtcgatgaccgtcaagctgctggccccgatcgccatggaagaaggtctgcgtttcgccatccgtgaaggcggtcgtaccgtcggtgccggcgtcgtcgccaagatcatcaagtaa

SEQ ID NO: 864 - DNA, 1350 bp, Trypanosoma brucei
  strain LVH/75/USAMRU-K/18
atgggaaaggaaaaggtgcacatgaatcttgtggtggtgggccacgtcgatgccggtaaatccactgcaacgggtcacttgatctacaagtgcggtggtattgacaaacgtacgatcgagaagttcgagaaagaagctgccgacattggtaaggcctcattcaagtacgcatgggtgctggacaagctgaaggctgagcgcgaacgtggtatcacgatcgacattgcactgtggaaattcgagtcacccaagtctgtcttcactattattgatgctcctgggcaccgtgacttcatcaagaacatgatcaccggcacatcgcaagccgacgcagccatcctcatcattgcctctgcgcagggtgagttcgaggctggtatctccaaggatggacagacccgcgagcacgcgttgctggccttcactttgggtgtgaagcagatggttgtgtgctgcaacaaaatggacgacaagactgtgaactacggacaggagcggtatgacgagattgtgaaggaggtgtctgcttacatcaagaaggttgggtacaacgtggagaaggtgcgcttcgtccccatctccggatggcagggcgacaacatgattgagaaatccgagaagatgccatggtacaagggtccaacgctcctggaggcactagacatgctggagccaccagtgcgtccgagcgacaagcccctgcgtctgccactgcagacgtgtacaaagatcggtggtattggcaccgtgcccgttggtcgtgtggagaccggcgtgatgaagcctggtgatgtggtgacgtttgcccccgccaacgtgacgaccgaggtgaaatcgatcgagatgcaccacgagcagctcgctgaggcgacccccggtgacaacgtcggctttaacgtgaagaacgtttctgtaaaggacatccgccgtggcaacgtctgcggtaacaccaagaacgaccccccaaaggaggccgccgacttcacggcacaggtgatcatcctgaaccaccccggacagattggaaacggttatgcgcccgtgctggactgccacacatcgcacattgcctgcaagttcgcggagatcgagtcgaagatcgaccgtcgctctggcaaggagctggagaaggctcccaagtcgatcaagtctggcgacgccgcgatcgtgcgcatggtgccgcagaagcctatgtgcgtggaggtcttcaacgactacgcgccactcggccgctttgccgtgcgtgacatgcgccagaccgtcgctgtcggtatcatcaaggccgtgaccaagaaggacggttctggtggtaaggtgacgaaggctgcggtgaaggcttcgaagaaataa

SEQ ID NO: 865 - DNA, 1052 bp, Cryptosporidium parvum
aagctcaaggctgagagagaaagaggtattaccatcgatattgctttatggcaattcgaaaccccaaaataccactacactgtcattgatgccccaggtcacagagatttcatcaagaatatgattactggtacctctcaagctgatgttgctttattggttgtcccagccgatcgtttcgaaggtgccttctccaaggaaggtcaaaccagagaacatgctttattggccttcactttgggtgtcagacaaatgattgtcggtattaacaagatggatacctgtgaatacaagcaatctcgttttgatgaaatcttcaacgaagttgatggttacctcaagaaggttggttacaacaccgagaagatcccattcgttgccatttctggtttcgttggtgataatatggttgagagatctgacaagatgccatggtataagggtaagaccttagtcgaagccctcgacactatggaaccaccaaagagaccaactgacaagccactccgtctcccattacaagatgtttacaagataggtggtgtaggtactgtcccagtcggtcgtgttgagactggtatcatcagaccaggtatgaatgttaccttcgctccagctggtgttaccactgaagttaagtcagtagaaatgcaccatgagcagatgccagaggccgtcccaggtgacaacgttggtttcaatgttaagaacgtctccatcaaggatatcaagagaggtttcgttgcttctgatgccaagaatgacccagctaagggctgtgaagacttcactgctcaagttatcgtcctcaaccacccaggtgaaatcaagaacggttactctccagtcgttgactgtcacaccgctcacatttcctgcaaattccagactatcactgctaagatggacaagagatctggtaaggttttggaagaaaacccaaagcttatcaagtctggtgatgctgctttggttgttatgcaacctttgaagccactttgtgttgaggccttcactgactacccacctctaggtcgtttcgctgtccgtga

SEQ ID NO: 866 - DNA, 837 bp, Staphylococcus saprophyticus; identical to SEQ ID NO: 245
  ref <308>: DATABASE ACCESSION NUMBER: ATCC 35552

SEQ ID NO: 867 - DNA, 818 bp, Zoogloae ramigera
  ref <308>: DATABASE ACCESSION NUMBER: ATCC 25935
aaggtattcgatgccttgaaaatggaaggctccgagctgaccctggaagtacaacagcagctgggcgacggcattgtccgtaccattgcactgggtacctccgacggcctgcgtcgcggcatgatgatccagaacaccggcaaacctatcatggtgccagtcggtaaagcaaccctgggtcgcatcatggacgtgctgggtaacccgatcgacgaatgcggcgcggtcgctcacgaccagatcgcttcgatccaccgcgctcctcctgcgtacgacgaactgtcgccatcgcaagatctgctggaaaccggcattaaagttattgacctggtgtgcccgttcgccaagggcggtaaagtcggtctgttcggcggtgcaggtgtgggcaagaccgtgaacatgatggaactgatcaacaacatcgccaaagcacactcgggtctgtccgtgtttgccggtgtgggtgagcgtacccgtgaaggtaacgacttctaccacgagatggctgacgccaaagtggtcgatctggaaaatccagagaactccaaggttgcgatggtctacggtcagatgaatgaaccaccaggcaaccgtctgcgcgtggcgctgaccggtctgaccatggctgaagcattccgtgacgaaggcaaagacgttctgttcttcgtggacaacatctaccgcttcaccctggccggtaccgaagtatcggcactgctgggccgtatgccatcggctgtgggttaccagcctacgctggccgaagaaatgggtcgcctgcaagagcgcatcacttcgaccaagaccggttcgatcac

SEQ ID NO: 868 - DNA, 778 bp, Staphylococcus saprophyticus
  ref <308>: DATABASE ACCESSION NUMBER: ATCC 43867
ctatcttagtagtatctgctgctgatggcccaatgccacaaactcgtgaacacattcttttatcacgtaacgttggtgttccagcattagttgtattcttaaacaaagttgacatggttgacgatgaagaattattagaattagtagaaatggaagttcgtgacttattaagcgaatatgacttcccaggtgacgatgtacctgtaatctctggttctgcattaaaagctttagaaggcgacgctgactatgagcaaaaaatcttagacttaatgcaagctgttgatgacttcattccaacaccagaacgtgattctgacaaaccattcatgatgccagttgaggacgtattctcaatcactggtcgtggtactgttgctacaggccgtgttgaacgtggtcaaatcaaagtcggtgaagaaatcgaaatcatcggtatgcaagaagaatcaagcaaaacaactgttactggtgtagaaatgttccgtaaattattagactacgctgaagctggtgacaacattggtgcattattacgtggtgtttcacgtgatgacgtacaacgtggtcaagttttagctgctcctggtactattacaccacatacaaaattcaaagcggatgtttacgttttatctaaagatgaaggtggtcgtcatacaccattcttcactaactaccgcccacaattctatttccgtactactgacgtaactggtgttgttaacttaccagaaggtactgaaatggttatgcctggcgataacgttgaaatgga

SEQ ID NO: 869 - DNA, 640 bp, Enterococcus casseliflavus
  strain R689
tggtcctatgcctcaaacacgtgaacacatcttgttatcacgtaacgttggtgtaccatacatcgttgttttcttaaacaaaatggatatggttgatgacgaagaattactagaattagttgaaatggaagttcgtgacttattgtcagaatatgacttcccaggcgacgatgttcctgtaatcgctggttctgctttgaaagctcttgaaggcgatgcttcatacgaagaaaaaatcatggaattaatggctgcagttgacgaatacgttccaactccagaacgtgacactgacaaaccattcatgatgccagtcgaagacgtattctcaatcactggacgtggtactgttgctacaggccgtgttgaacgtggacaagttcgcgttggtgacgaagttgaaatcgttggtattgctgaagaaactgctaaaacaactgtaactggtgttgaaatgttccgtaaattgttagactatgctgaagcaggggataacattggtgcattgctacgtggtgttgctcgtgaagacatccaacgtggacaagtattggctaaagctggtacaatcacacctcatacaaaatttaaagctgaagtttacgttttaacaaaagaagaaggtggacgtcacactcca

SEQ ID NO: 870 - DNA, 644 bp, Enterococcus casseliflavus
  strain R754
gtcctatgcctcaaacacgtgaacacatcttgttatcacgtaacgttggtgtaccatacatcgttgttttcttaaacaaaatggatatggttgatgacgaagaattactagaattagttgaaatggaagttcgtgacttattgtcagaatatgacttcccaggcgacgatgttcctgtaatcgctggttctgctttgaaagctcttgaaggcgatgcttcatacgaagaaaaaatcatggaattaatggctgcagttgacgaatacgttccaactccagaacgtgacactgacaaaccattcatgatgccagtcgaagacgtattctcaatcactggacgtggtactgttgctacaggccgtgttgaacgtggacaagttcgcgttggtgacgaagttgaaatcgttggtattgctgaagaaactgctaaaacaactgtaactggtgttgaaatgttccgtaaattgttagactatgctgaagcaggggataacattggtgcattgctacgtggtgttgctcgtgaagacatccaacgtggacaagtattggctaaagctggtacaatcacacctcatacaaaatttaaagctgaagtttacgttttaacaaaagaagaaggtggacgtcacacaccattcttc

SEQ ID NO: 871 - DNA, 637 bp, Enterococcus flavescens
  strain R758
tcctatgcctcaaacacgtgaacacatcttgttatcacgtaacgttggtgtaccatacatcgttgttttcttaaacaaaatggatatggttgatgacgaagaattactagaattagttgaaatggaagttcgtgacttattgtcagaatatgacttcccaggcgacgatgttcctgtaatcgctggttctgctttgaaagctcttgaaggcgatgcttcatacgaagaaaaaatcatggaattaatggctgcagttgacgaatacgttccaactccagaacgtgacactgacaaaccattcatgatgccagtcgaagacgtattctcaatcactggacgtggtactgttgctacaggccgtgttgaacgtggacaagttcgcgttggtgacgaagttgaaatcgttggtattgctgaagaaactgctaaaacaactgtaactggtgttgaaatgttccgtaaattgttagactatgctgaagcaggggataacattggtgcattgctacgtggggttgctcgtgaagacatccaacgtggacaagtattagctaaagctggtacaatcacacctcatacaaaatttaaagctgaagtttacgttttaacaaaagaagaaggtggacgtcacactcca

SEQ ID NO: 872 - DNA, 643 bp, Enterococcus gallinarum
  strain R631
gtcctatgcctcaaactcgtgaacacatcttgttatcacgtaacgttggcgtaccatacatcgttgttttcttgaacaaaatggatatggttgatgacgaagaattgctagaattagttgaaatggaagttcgtgacctattgtctgaatatgacttcccaggcgacgatgttcctgtaatcgccggttctgctttgaaagctcttgaaggagatccttcatacgaagaaaaaatcatggaattgatggctgcagttgacgaatacgttccaactccagaacgtgatactgacaaaccattcatgatgccagtcgaagacgtattctcaatcactggacgtggtactgttgctacaggccgtgttgaacgtggacaagttcgcgttggtgatgaagtagaaatcgttggtattgctgacgaaactgctaaaacaactgtaacaggtgttgaaatgttccgtaaattgttagactatgctgaagcaggggataacattggtgcattgctacgtggggttgctcgtgaagacatccaacgtggacaagtattggctaaagctggtacaatcacacctcatacaaaattcaaagctgaagtttatgttttgacaaaagaagaaggtggacgtcacactccattctt

SEQ ID NO: 873 - DNA, 641 bp, Enterococcus gallinarum
  strain R691
gtcctatgcctcaaactcgtgaacacatcttgttatcacgtaacgttggcgtaccatacatcgttgttttcttgaacaaaatggatatggttgatgacgaagaattgctagaattagttgaaatggaagttcgtgacctattgtctgaatatgacttcccaggcgacgatgttcctgtaatcgccggttctgctttgaaagctcttgaaggagatccttcatacgaagaaaaaatcatggaattgatggctgcagttgacgaatacgttccaactccagaacgtgatactgacaaaccattcatgatgccagtcgaagacgtattctcaatcactggacgtggtactgttgctacaggccgtgttgaacgtggacaagttcgcgttggtgatgaagtagaaatcgttggtattgctgacgaaactgctaaaacaactgtaacaggtgttgaaatgttccgtaaattgttagactatgctgaagcaggggataacattggtgcattgctacgtggggttgctcgtgaagacatccaacgtggacaagtattggctaaagctggtacaatcacacctcatacaaaattcaaagctgaagtttatgttttgacaaaagaagaaggtggacgtcacactccattc

SEQ ID NO: 874 - DNA, 681 bp, Staphylococcus haemolyticus
  strain LSPQ 2514
accagcattagtagtattcttaaataaagttgacatggttgacgatgaagaattattagaattagttgaaatggaagtacgtgacttattatctgaatacgacttcccaggtgacgatgtacctgtaatcgctggttcagcattaaaagctttagaaggcgatgctcaatacgaagaaaaaatcttagaattaatgcaagcagttgatgactacattccaactccagaacgtgattctgacaaaccattcatgatgccagttgaggacgtattctcaatcactggtcgtggtactgttgctacaggccgtgttgaacgtgggcaaatcaaagttggtgaagaagttgaaatcattggtatccatgacacttctaaaacaactgttactggtgtagaaatgttccgtaaattattagactacgctgaagctggtgacaacatcggtgcattattacgtggtgttgctcgtgaagacgtacaacgtggtcaagtattagctgctccaggttcaatcacacctcacacaaaatttaaagcagacgtatacgttttatctaaagacgaaggtggacgtcacactccattcttcacaaactatcgtccacaattctatttccgtactactgacgtaactggtgttgttaacttaccagaaggtactgaaatggttatgcctggcga

SEQ ID NO: 875 - DNA, 675 bp, Staphylococcus epidermidis
  strain R591
attatcacgtaacgttggtgtaccagcattagttgtattcttaaacaaagttgacatggtagacgacgaagaattattagaattagttgaaatggaagttcgtgacttattaagcgaatatgacttcccaggtgacgatgtacctgtaatcgctggttctgcattaaaagcattagaaggcgatgctgaatacgaacaaaaaatcttagacttaatgcaagcagttgatgattacattccaactccagaacgtgattctgacaaaccattcatgatgccagttgaggacgtattctcaatcactggtcgtggtactgttgctacaggccgtgttgaacgtggtcaaatcaaagttggtgaagaagttgaaatcatcggtatgcacgaaacttctaaaacaactgttactggtgtagaaatgttccgtaaattattagactacgctgaagctggtgacaacatcggtgctttattacgtggtgttgcacgtgaagacgtacaacgtggtcaagtattagctgctcctggttctattacaccacacacaaaattcaaagctgaagtatacgtattatctaaagatgaaggtggacgtcacactccattcttcactaactatcgcccacaattctatttccgtactactgacgtaactggtgttgtaaacttaccaga

SEQ ID NO: 876 - DNA, 704 bp, Staphylococcus epidermidis
  strain CSG 10
tcttattatcacgtaacgttggtgtaccagcattagttgtattcttaaacaaagttgacatggtagacgacgaagaattattagaattagttgaaatggaagttcgtgacttattaagcgaatatgacttcccaggtgacgatgtacctgtaatcgctggttctgcattaaaagcattagaaggcgatgctgaatacgaacaaaaaatcttagacttaatgcaagcagttgatgattacattccaactccagaacgtgattctgacaaaccattcatgatgccagttgaggacgtattctcaatcactggtcgtggtactgttgctacaggccgtgttgaacgtggtcaaatcaaagttggtgaagaagttgaaatcatcggtatgcacgaaacttctaaaacaactgttactggtgtagaaatgttccgtaaattattagactacgctgaagctggtgacaacatcggtgctttattacgtggtgttgcacgtgaagacgtacaacgtggtcaagtattagctgctcctggttctattacaccacacacaaaattcaaagctgaagtatacgtattatctaaagatgaaggtggacgtcacactccattcttcactaactatcgcccacaattctatttccgtactactgacgtaactggtgttgtaaacttaccagaaggtacagaaatggttatgcctggc

SEQ ID NO: 877 - DNA, 770 bp, Staphylococcus epidermidis
  ref <308>: DATABASE ACCESSION NUMBER: ATCC 35984
tcttagttgtatctgctgctgacggtccaatgccacaaactcgtgaacacatcttattatcacgtaacgttggtgtaccagcattagttgtattcttaaacaaagttgacatggtagacgacgaagaattattagaattagttgaaatggaagttcgtgacttattaagcgaatatgacttcccaggtgacgatgtacctgtaatcgctggttctgcattaaaagcattagaaggcgatgctgaatacgaacaaaaaatcttagacttaatgcaagcagttgatgattacattccaactccagaacgtgattctgacaaaccattcatgatgccagttgaggacgtattctcaatcactggtcgtggtactgttgctacaggccgtgttgaacgtggtcaaatcaaagttggtgaagaagttgaaatcatcggtatgcacgaaacttctaaaacaactgttactggtgtagaaatgttccgtaaattattagactacgctgaagctggtgacaacatcggtgctttattacgtggtgttgcacgtgaagacgtacaacgtggtcaagtattagctgctcctggttctattacaccacacacaaaattcaaagctgaagtatacgtattatctaaagatgaaggtggacgtcacactccattcttcactaactatcgcccacaattctatttccgtactactgacgtaactggtgttgtaaacttaccagaaggtacagaaatggttatgcctggcgacaacgttgaaatg

SEQ ID NO: 878 - DNA, 716 bp, Staphylococcus epidermidis
  ref <308>: DATABASE ACCESSION NUMBER: ATCC 35983
ttgtattcttaaacaaagttgacatggtagacgacgaagaattattagaattagttgaaatggaagttcgtgacttattaagcgaatatgacttcccaggtgacgatgtacctgtaatcgctggttctgcattaaaagcattagaaggcgatgctgaatacgaacaaaaaatcttagacttaatgcaagcagttgatgattacattccaactccagaacgtgattctgacaaaccattcatgatgccagttgaggacgtattctcaatcactggtcgtggtactgttgctacaggccgtgttgaacgtggtcaaatcaaagttggtgaagaagttgaaatcatcggtatgcacgaaacttctaaaacaactgttactggtgtagaaatgttccgtaaattattagactacgctgaagctggtgacaacatcggtgctttattacgtggtgttgcacgtgaagacgtacaacgtggtcaagtattagctgctcctggttctattacaccacacacaaaattcaaagctgaagtatacgtattatctaaagatgaaggtggacgtcacactccattcttcactaactatcgcccacaattctatttccgtactactgacgtaactggtgttgtaaacttaccagaaggtacagaaatggttatgcctggcgacaacgttgaaatgacagttgaattaatcgctccaatcgctatcgaa

SEQ ID NO: 879 - DNA, 640 bp, Enterococcus gallinarum
  strain R764
cggtcctatgcctcaaactcgtgaacacatcttgttatcacgtaacgttggcgtaccatacatcgttgttttcttgaacaaaatggatatggttgatgacgaagaattgctagaattagttgaaatggaagttcgtgacctattgtctgaatatgacttcccaggcgacgatgttcctgtaatcgccggttctgctttgaaagctcttgaaggagatccttcatacgaagaaaaaatcatggaattgatggctgcagttgacgaatacgttccaactccagaacgtgatactgacaaaccattcatgatgccagtcgaagacgtattctcaatcactggacgtggtactgttgctacaggccgtgttgaacgtggacaagttcgcgttggtgatgaagtagaaatcgttggtattgctgacgaaactgctaaaacaactgtaacaggtgttgaaatgttccgtaaattgttagactatgctgaagcaggggataacattggtgcattgctacgtggggttgctcgtgaagacatccaacgtggacaagtattggctaaagctggtacaatcacacctcatacaaaattcaaagctgaagtttatgttttgacaaaagaagaaggtggacgtcacactcca

SEQ ID NO: 880 - DNA, 831 bp, Pseudomonas aeruginosa
  strain PAO-1
cggcgcgatcctggtttgctcggctgccgacggccccatgccgcagacccgcgagcacatcctgctgtcccgccaggtaggcgttccctacatcgtcgtgttcctgaacaaggccgacatggtcgacgacgccgagctgctggaactggtcgagatggaagttcgcgatctgctgaacacctacgacttcccgggcgacgacactccgatcatcatcggttccgcgctgatggcgctggaaggcaaggatgacaacggcatcggcgtaagcgccgtgcagaagctggtagagaccctggactcctacattccggagccggttcgtgccatcgaccagccgttcctgatgccgatcgaagacgtgttctcgatctccggccgcggtaccgtggtaaccggtcgtgtagagcgcggcatcatcaaggtccaggaagaagtggaaatcgtcggcatcaaggcgaccaccaagactacctgcaccggcgttgaaatgttccgcaagctgctcgacgaaggtcgtgctggtgagaacgttggtatcctgctgcgtggcaccaagcgtgaagacgtagagcgtggccaggttctggccaagccgggcaccatcaagccgcacaccaagttcgagtgcgaagtgtacgtgctgtccaaggaagaaggtggtcgtcacaccccgttcttcaagggctaccgtccgcagttctacttccgtaccaccgaygtgaccggtaactgcgaactgccggaaggcgtagagatggtaatgccgggcgacaacatcaagatggttgtcaccctgatcgctccgatcgccatggaagatggcctgcg

SEQ ID NO: 881 - DNA, 642 bp, Enterococcus casseliflavus
  strain R421
cctatgcctcaaacacgtgaacacatcttgttatcacgtaacgttggtgtaccatacatcgttgttttcttaaacaaaatggatatggttgatgacgaagaattactagaattagttgaaatggaagttcgtgacttattgtcagaatatgacttcccaggcgacgatgttcctgtaatcgctggttctgctttgaaagctcttgaaggcgatgcttcatacgaagaaaaaatcatggaattaatggctgcagttgacgaatacgttccaactccagaacgtgacactgacaaaccattcatgatgccagtcgaagacgtattctcaatcactggacgtggtactgttgctacaggccgtgttgaacgtggacaagttcgcgttggtgacgaagttgaaatcgttggtattgctgaagaaactgctaaaacaactgtaactggtgttgaaatgttccgtaaattgttagactatgctgaagcaggggataacattggtgcattgctacgtggtgttgctcgtgaagacatccaacgtggacaagtattggctaaagctggtacaatcacacctcatacaaaatttaaagctgaagtttacgttttaacaaaagaagaaggtggacgtcacacaccattcttc

SEQ ID NO: 882 - DNA, 636 bp, Enterococcus casseliflavus
  strain R775
cctatgcctcaaacacgtgaacacatcttgttatcacgtaacgttggtgtaccatacatcgttgttttcttaaacaaaatggatatggttgatgacgaagaattactagaattagttgaaatggaagttcgtgacttattgtcagaatatgacttcccaggcgacgatgttcctgtaatcgctggttctgctttgaaagctcttgaaggcgatgcttcatacgaagaaaaaatcatggaattaatggctgcagttgacgaatacgttccaactccagaacgtgacactgacaaaccattcatgatgccagtcgaagacgtattctcaatcactggacgtggtactgttgctacaggccgtgttgaacgtggacaagttcgcgttggtgacgaagttgaaatcgttggtattgctgaagaaactgctaaaacaactgtaactggtgttgaaatgttccgtaaattgttagactatgctgaagcaggggataacattggtgcattgctacgtggtgttgctcgtgaagacatccaacgtggacaagtattggctaaagctggtacaatcacacctcatacaaaatttaaagctgaagtttacgttttaacaaaagaagaaggtggacgtcatacacca

SEQ ID NO: 883 - DNA, 641 bp, Enterococcus faecalis
  strain R422
ggtcctatgcctcaaacacgtgaacatatcttattatcacgtaacgttggtgtaccatacatcgttgtattcttaaacaaaatggatatggttgatgacgaagaattattagaattagtagaaatggaagttcgtgacttattatcagaatacgatttcccaggcgatgatgttccagttatcgcaggttctgctttgaaagctttagaaggcgacgagtcttatgaagaaaaaatcttagaattaatggctgcagttgacgaatatatcccaactccagaacgtgatactgacaaaccattcatgatgccagtcgaagacgtattctcaatcactggacgtggtactgttgctacaggccgtgttgaacgtggtgaagttcgcgttggtgacgaagttgaaatcgttggtattaaagacgaaacatctaaaacaactgttacaggtgttgaaatgttccgtaaattattagactacgctgaagcaggcgacaacatcggtgctttattacgtggtgtagcacgtgaagatatcgaacgtggacaagtattagctaaaccagctacaatcactccacacacaaaattcaaagctgaagtatacgtattatcaaaagaagaaggcggacgtcacactccatt

SEQ ID NO: 884 - DNA, 640 bp, Enterococcus faecalis
  strain R575
tatgcctcaaacacgtgaacatatcttattatcacgtaacgttggtgtaccatacatcgttgtattcttaaacaaaatggatatggttgatgacgaagaattattagaattagtagaaatggaagttcgtgacttattatcagaatacgatttcccaggcgatgatgttccagttatcgcaggttctgctttgaaagctttagaaggcgacgagtcttatgaagaaaaaatcttagaattaatggctgcagttgacgaatatatcccaactccagaacgtgatactgacaaaccattcatgatgccagtcgaagacgtattctcaatcactggacgtggtactgttgctacaggccgtgttgaacgtggtgaagttcgcgttggtgacgaagttgaaatcgttggtattaaagacgaaacatctaaaacaactgttacaggtgttgaaatgttccgtaaattattagactacgctgaagcaggcgacaacatcggtgctttattacgtggtgttgcacgtgaagatatcgaacgtggacaagtattagctaaaccagctacaatcactccacacacaaaattcaaagctgaagtatacgtattatcaaaagaagaaggcggacgtcacactccattcttc

SEQ ID NO: 885 - DNA, 632 bp, Enterococcus faecium
  strain R492
tgcctcaaactcgtgaacacatcctattgtctcgtcaagttggtgttccttacatcgttgtattcttgaacaaagtagacatggttgatgacgaagaattactagaattagttgaaatggaagttcgtgacctattaacagaatacgaattccctggtgacgatgttcctgtagttgctggatcagctttgaaagctctagaaggcgacgcttcatacgaagaaaaaattcttgaattaatggctgcagttgacgaatacatcccaactccagaacgtgacaacgacaaaccattcatgatgccagttgaagacgtgttctcaattactggacgtggtactgttgctacaggtcgtgttgaacgtggacaagttcgcgttggtgacgaagttgaagttgttggtattgctgaagaaacttcaaaaacaacagttactggtgttgaaatgttccgtaaattgttagactacgctgaagctggagacaacattggtgctttactacgtggtgttgcacgtgaagacatccaacgtggacaagttttagctaaaccaggtacaatcacacctcatacaaaattctctgcagaagtatacgtgttgacaaaagaagaaggtggacgtcatactcca

SEQ ID NO: 886 - DNA, 640 bp, Enterococcus faecium
  strain R576
cggcccaatgcctcaaactcgtgaacacatcctattgtctcgtcaagttggtgttccttacatcgttgtattcttgaacaaagtagacatggttgatgacgaagaattactagaattagttgaaatggaagttcgtgacctattaacagaatacgaattccctggtgacgatgttcctgtagttgctggatcagctttgaaagctctagaaggcgacgcttcatacgaagaaaaaattcttgaattaatggctgcagttgacgaatacatcccaactccagaacgtgacaacgacaaaccattcatgatgccagttgaagacgtgttctcaattactggacgtggtactgttgctacaggtcgtgttgaacgtggacaagttcgcgttggtgacgaagttgaagttgttggtattgctgaagaaacttcaaaaacaacagttactggtgttgaaatgttccgtaaattgttagactacgctgaagctggagacaacattggtgctttactacgtggtgttgcacgtgaagacatccaacgtggacaagttttagctaaaccaggtacaatcacacctcatacaaaattctctgcagaagtatacgtgttgacaaaagaagaaggtggacgtcatactcca

SEQ ID NO: 887 - DNA, 806 bp, Zoogloae ramigera
  ref <308>: DATABASE ACCESSION NUMBER: ATCC 25935
atcctggtttgctccgcagctgacggcccaatgccacagacccgcgagcacatcctgctggcccgccaagttggcgttccatacatcatcgtgttcctgaacaagtgcgacctggttgacgacgcagaactgctggaactggtcgaaatggaagtgcgtgaattgctgtcgaaatacgagttcccaggcgacgacgtaccaatcatcaagggttcggcacgtatggcgctggaaggcaaagaaggcgagatgggcgttgacgccatcatgcgtctggccgatgcactggacagctacatccctacgccagagcgcgcagtcgatggcgccttcctgatgccagtggaagacgtgttctcgatctcgggtcgcggtaccgttgtgaccggtcgtatcgagcgcggcgtgatcaaggtcggcgaagagatcgaaatcgtcggcattatcgacaccgtcaaaaccacttgcaccggcgtggaaatgttccgcaagctgctggaccagggtcaagccggcgacaacgttggtctgctgctgcgcggcaccaagcgtgaagacgtacagcgtggtcaggttctggccaagccagcgtcgatcaagccgcacaaccacttcaccggcgagatctacgttctgtcgaaagatgaaggcggccgtcacaccccgttcttcaacaactatcgtccacagttctacttccgtacgactgacgtgaccggttcgatcgaactgccagcagacaaagaaatggtcatgccaggcgacaacgtgtcgatcaccgtcaagctgatcaacccgatcgcgat

SEQ ID NO: 888 - DNA, 634 bp, Enterococcus faecalis
  strain R503
tatgcctcaaacacgtgaacatatcttattatcacgtaacgttggtgtaccatacatcgttgtattcttaaacaaaatggatatggttgatgacgaagaattattagaattagtagaaatggaagttcgtgacttattatcagaatacgatttcccaggcgatgatgttccagttatcgcaggttctgctttgaaagctttagaaggcgacgagtcttatgaagaaaaaatcttagaattaatggctgcagttgacgaatatatcccaactccagaacgtgatactgacaaaccattcatgatgccagtcgaagacgtattctcaatcactggacgtggtactgttgctacaggccgtgttgaacgtggtgaagttcgcgttggtgacgaagttgaaatcgttggtattaaagacgaaacatctaaaacaactgttacaggtgttgaaatgttccgtaaattattagactacgctgaagcaggcgacaacatcggtgctttattacgtggtgtagcacgtgaagatatcgaacgtggacaagtattagctaaaccagctacaatcactccacacacaaaattcaaagctgaagtatacgtattatcaaaagaagaaggcggacgtcacactcca

SEQ ID NO: 889 - DNA, 493 bp, Aspergillus fumigatus
  ref <308>: DATABASE ACCESSION NUMBER: ATCC 14110
tgtcttcatccaggaattgattgtgagtcgttccacatgctcacctagttttcgctcgatcttttcactaacgcaaaccatgtagaacaacattgccaaggcccacggtggttactccgtcttcactggtgttggtgagcgtactcgtgagggtaacgatctgtaccacgaaatgcaggagactggtgtcattcagctcgagggtgaatccaaggtcgcactggtgttcggacagatgaacgagccccccggtgcccgtgcccgtgtcgcccttaccggtctgaccattgccgagtacttccgtgacgaggagggtcaggacgtgctgctcttcattgacaacattttccgtttcacccaggccggttctgaggtgtctgcccttctcggtcgtatcccctctgccgtcggttaccagcccaccctggccgtcgacatgggtggtatgcaggagcgtatcaccaccaccaagaagggttctattacctccgtc

SEQ ID NO: 890 - DNA, 466 bp, Penicillium marneffei
  ref <308>: DATABASE ACCESSION NUMBER: ATCC 64101
ttgattgtacgtctttacctttctgcctgactgtttacgacaactaacgaaagcgtagaacaacattgccaaggctcacggtggttactctgtcttcactggtgtcggtgaacgtactcgtgagggtaacgatttgtaccacgaaatgcaggaaactggtgtcattcagctcgagggtgaatccaaggtcgccctcgtgttcggtcagatgaacgagccccccggtgcccgtgcccgtgtcgctcttactggtttgaccattgccgagtacttccgtgacgaggaaggtcaggacgtgcttctcttcattgacaacattttccgtttcactcaggccggttctgaggtgtctgcccttctgggtcgtatcccctctgccgtcggttaccagcccacccttgccgtcgacatgggtatcatgcaggagcgtattaccaccaccaccaagggttccatcacctccgtc

SEQ ID NO: 891 - DNA, 478 bp, Paecilomyces lilacinus
  ref <308>: DATABASE ACCESSION NUMBER: ATCC 42570
aggagctgatcaacaacatcgccaaggctcacggtggttactccgtcttcactggtgtcggtgagcgtacccgtgagggtaacgatctgtaccacgaaatgcaggagacctcggtcattcagctcgagggcgagtctaaggtggccctggtctttggtcagatgaacgagcccccgggtgctcgtgcccgtgtcgctcttactggtcttaccgtcgccgagtacttccgtgaccaggagggtcaggatggttagttctcgtccactcatgccgaaacatgtgcgtgttccgaggctaatcaacgtgccagtgctgcttttcatcgacaacattttccgattcacacaggccggttccgaggtgtctgccctgctgggtcgtatcccctctgccgtcggttaccagcccaccctcgccgtcgacatgggtggcatgcaggagcgtatcaccaccaccaagaagggctctatcacctccg

SEQ ID NO: 892 - DNA, 481 bp, Penicillium marneffei
  ref <308>: DATABASE ACCESSION NUMBER: ATCC 58950
gtctttatccaggagttgattgtacgtctttacctttctgcctgactgtttacgacaactaacgaaagcgtagaacaacattgccaaggctcacggtggttactctgtcttcactggtgtcggtgaacgtactcgtgagggtaacgatttgtaccacgaaatgcaggaaactggtgtcattcagctcgagggtgaatccaaggtcgccctcgtgttcggtcagatgaacgagccccccggtgcccgtgcccgtgtcgctcttactggtttgaccattgccgagtacttccgtgacgaggaaggtcaggacgtgcttctcttcattgacaacattttccgtttcactcaggccggttctgaggtgtctgcccttctgggtcgtatcccctctgccgtcggttaccagcccacccttgccgtcgacatgggtatcatgcaggagcgtattaccaccaccaccaagggttccatcacctccgtc

SEQ ID NO: 893 - DNA, 1208 bp, Sporothrix schenckii
  ref <308>: DATABASE ACCESSION NUMBER: ATCC 14285
ctcgtccgtggtgctaaggccactgacactggttsccccattaccatccscgtcggccccggtaccctcggtcgcatcatgaacgtcaccggtgacccgatcgacgagcgcggtcccatcaagaccgacaagttccgtcccatccacgctgaggctcccgagttcgttgaccagtcgaccaccgctgaggttctcgtgactggtatcaaggtcgtcgatctgcttgctccctacgcccgtggtggtaagattggtctgtttggcggtgccggtgttggcaagaccgtgttcatccaggagctcatcaacaacatcgccaaggcccacggtggttactccgtcttcaccggtgtcggcgagcgtacccgtgagggtaacgatctgtaccacgaaatgcaggagacctctgtcattcagcttgacggtgactccaaggtcgccctggtgttcggtcagatgaacgagccccctggtgctcgtgcccgtgtcgccttgaccggtttgactgtcgctgagtacttccgtgacgaggagggccaggatggtatgttttgaattatttccttgtcgtacagttccaaatcgaagaattactaacttgtcagtgcttctcttcatcgacaacattttccgcttcacccaggccggttctgaggtgtctgcccttctgggtcgtattccctccgctgtcggttaccagcccacgctcgccgtggacatgggtctgatgcaggagcgtattaccaccacccgcaagggctcaattacctccgtccaggccgtctacgtgcccgctgacgatctgacggatcccgcccccgccaccaccttcgcccatctggacgccaccactgtgctgtcccgaggtatctctgagctgggtatctaccccgctgtcgaccccctcgactccaagtcgcgtatgctggacccccgtattgtcggtgacgaccactacgagaccgccactcgcgtccagcagatcctccaagagtacaagtcgctgcaggacatcatcgccattctgggtatggacgagctgtctgaggccgacaagcttacagtcgagcgtgctcgtaagatccagcgtttcctgagccagccgttcacggtcgcgcaggtcttcactggtatcgaaggccagctggtcgatctgaaggacactatcgcttcgttcaaggctatcctgagcggtgagggtgacagcc

SEQ ID NO: 894 - DNA, 534 bp, Malbranchea filamentosa
  ref <308>: DATABASE ACCESSION NUMBER: ATCC 48174
ttcaggaacttattgtaagccgccctctttatgcattgagggtgaataagaaggctgacaggtaatagaacaacattgccaaggctcacggtggttactccgtgttcactggtgtcggtgagcgtacccgtgaaggaaacgatctgtaccatgaaatgcaggaaacccgcgtcatccagcttgatggcgagtctaaggtcgcccttgtgttcggtcagatgaacgagccccctggagcccgtgcccgtgtcgctcttactggtcttaccgttgccgaatacttccgtgacgaggagggccaagatggtacgcctttttactcttcttattcttcgggtcggactacagaactaacctgctccagtgcttctcttcattgataacattttccgtttcacacaagccggttctgaggtgtctgccttgcttggacgtattccctctgccgtcggttaccagcccactctcgccgtcgacatgggtggtatgcaggaacgtatcacaaccaccaacaagggttccattacttccgtg

SEQ ID NO: 895 - DNA, 448 bp, Paecilomyces lilacinus
  ref <308>: DATABASE ACCESSION NUMBER: ATCC 60735
caaggctcacggtggttactccgtcttcactggtgtcggtgagcgtacccgtgagggtaacgatctgtaccacgaaatgcaggagacctcggtcattcagctcgagggcgagtctaaggtggccctggtctttggtcagatgaacgagcccccgggtgctcgtgcccgtgtcgctcttactggtcttaccgtcgccgagtacttccgtgaccaggagggtcaggatggttagttctcgtccactcatgccgaaacatgtgcgtgttccgaggctaatcaacgtgccagtgctgcttttcatcgacaacattttccgattcacccaggccggttccgaggtgtctgccctgctgggtcgtatcccctctgccgtcggttaccagcccaccctcgccgtcgacatgggtggcatgcaggagcgtatcaccaccaccaagaagggctctat

SEQ ID NO: 896 - DNA, 483 bp, Aspergillus niger
  ref <308>: DATABASE ACCESSION NUMBER: ATCC 9508
attcaggagctgattgtaagttgccaatccatgaactggagatttggtgtgacccatagaactaacaaattatttagaacaacatcgccaaggctcacggtggttactccgtcttctgtggtgtcggtgagcgtactcgtgagggtaacgatctgtaccacgaaatgcaggagactggtgtcatccagctcgagggtgactccaaggtcgctctggtcttcggtcagatgaacgagcccccgggtgcccgtgcccgtgtcgcccttaccggtctgaccattgccgagtacttccgtgacgaggagggtcaggacgtgctgctcttcattgacaacattttccgtttcacccaggccggttctgaggtgtctgcccttctgggtcgtatcccctctgccgtcggttaccagcccactctggccgtcgacatgggtggtatgcaggagcgtattaccaccaccaccaagggttccattacctccg

SEQ ID NO: 897 - DNA, 1124 bp, Aspergillus fumigatus
  ref <308>: DATABASE ACCESSION NUMBER: ATCC 14110
aagctcaagtccgagcgtgagcgtggtatcaccatcgacattgccctctggaagttccagactcccaagtatgaggtcactgtcatcggtaagctcgactcgccccgatatgttttggtgctgtagctaacacgatctgaagatgcccccggtcaccgtgacttcatcaagaacatgatcactggtacctcccaggctgactgcgctatcctcatcattgcctccggtactggtgagttcgaggctggtatctccaaggatggccagacccgtgagcacgctctgctggctttcaccctcggtgtcaagcagctcatcgtcgccctcaacaagatggacacctgcaagtggtccgaggatcgttacaacgaaattgtcaaggaaacctccaacttcatcaagaaggtcggctacaaccccaaggccgttcccttcgtccccatctctggcttcaacggtgacaacatgcttgagccctcctccaactgcccctggtacaagggatgggagaaggagaccaaggccggcaaggtcactggtaagaccctcatcgaggccatcgacgccattgagccccctgtccgtccctycaacaagcccctccgtcttcccctccaggatgtctacaagatctctggtatcggaacggtccctgtcggccgtgtcgagaccggtatcatcaagcccggcatggtcgtcaccttcgcccccgccaacgtcaccactgaagtcaagtccgtcgagatgcaccaccagcagctccaggagggtgtccccggtgacaacgtcggtttcaacgtcaagaacgtttccgtcaaggaagtccgccgtggtaacgtctgcggtgactccaagaacgatccccctcagggtgctgcctccttcaacgcccaggtcatcgtcctcaaccaccccggtcaggtcggcgctggttacgcccccgtcctcgactgccacactgcccacattgcttgcaagttctctgagctgcttgagaagattgaccgccgtaccggcaagtctgttgagaacaaccccaagttcatcaagtccggtgatgccgccatcgtgaagatggttccttccaagcccatgtgtgtcgagtccttcactgactacccccc

SEQ ID NO: 898 - DNA, 1363 bp, Penicillium marneffei
  strain WSA-214
ctcaaggctgagcgtgagcgtggtatcaccatcgatattgctctctggaagttccagactgccaagtacgaggttaccgtcattgacgcccccggtcaccgtgatttcatcaagaacatgatcactggtacctcccaggccgattgcgctattctcatcattgcctctggtactggtgaattcgaggctggtatctccaaggatggccagactcgtgagcacgctcttttggctttcaccctcggtgtccgtcagctcattgttgccctcaacaagatggacacttgcaagtggtctcagggtgagtactcgtacctgcgtttggccttgaatatcttactaatgcaccatagatcgttacaacgaaattgtcaaggagacttccaacttcatcaagaaggtcggatacaaccctaagaacgttcctttcgttcctatctccggtttcaacggtgacaacatgcttgagccctcccccaactgcccctggtacaagggttgggagaaggagaccaaggccggtaaggtcactggtaagaccctcctcgaggccatcgacgccattgagccccctacccgtcccgccaacaaggttagtccctcctcgactactcaaaccctcctcataagttcatgattacgactcgttcacagcccctccgtcttcccctccaggatgtctacaagatcggtggtattggaacggttcccgtcggtcgtgttgagactggtaccatcgttcctggtatggttgtcaccttgtaagtcactctcctcgcttatcctacctgaaatcatcatgtgctaacttgacactcagcgctcccgccaacgtcaccactgaagtcaagagtgttgaaatgcaccaccagcagctcactgccggtcagcccggtgacaacgttggtttcaacgtgaagaacgtctccgtcaaggaaatccgtcgtggtaacgttgctggtgacagcaagaacgacccccctgccggtgctgcctccttcaacgcccaggtcatcgtcctcaaccaccccggtcaggtcggtgctggttacgccccagtcctcgattgccacactgcccacattgcttgcaagttcgctgagctcctcgagaagattgaccgtcgtaccggaaagtctgttgaggaccaccccaagttcatcaagtccggtgacgctgccatcgtcaagatgattccttccaagcccatgtgtgttgaggctttcaccgagtaccctcctctcggtcgtttcgccgttcgcgagtaagttttatctccgttgtctattttccatccttcccttctcctccgtcttccatatatattttttcagttatatgtgactaaccacaaatcacggga

SEQ ID NO: 899 - DNA, 1147 bp, Piedraia hortai
  ref <308>: DATABASE ACCESSION NUMBER: ATCC 24292
caagctgaaagccgagcgtgagcgtggtatcactatcgacattgccctctggaagttcgagactcccaagtactatgtcaccgtcattggtacgtcgcattatctcactcctcacagaagcacgctcctaacatcacacagacgctcccggtcaccgtgatttcatcaagaacatgatcactggtacctcccaggccgactgcgctatcctcattatcgctgccggtactggtgagttcgaggctggtatctccaaggatggccagactcgtgagcacgccctgctcgcctacaccctcggtgtgcgtcagctcatcgtcgccatcaacaagatggacaccaccaagtggtctgaggcccgttaccaggagatcatcaaggagacctccaacttcatcaagaaggtcggctacaaccccaagaccgtcgctttcgtccccatctctggcttcaacggcgacaacatgcttgccccctccaccaactgcccctggtacaagggatgggagcgtgaggtcaagggcaacaagcagaccggcaagaccctcctcgaggccattgacggcattgagccccccaagcgtccttccgacaagcccctccgtcttcctctccaggatgtttacaagatcggtggtatcggaactgttcctgtcggccgtatcgagactggtgtcctcaagcccggtatggtcgttaccttcgctcccgccaacgtcaccactgaagtcaagtccgtcgagatgcaccacgagcagctcactgagggtcttcccggtgacaacgtcggtttcaacgtgaagaacgtttccgtcaaggacatccgccgtggtaacgttgccagtgactccaagaacgaccccgctctgggtgccgcttctttcgacgcccaggtcatcgtcctcaaccaccccggtcaggtcggtgctggttacgccccggtcctcgattgccacactgcccacattgcttgcaagttctccgagatcaaggagaagatcgaccgccgtaccggcaagtctgttgaggacgcccccaagttcatcaagtctggtgactctgccatcgtcaagatggttccctccaagcccatgtgcgttgaggctttcaccgactaccctcctctgggccgtttcgccgtccgtga

SEQ ID NO: 900 - DNA, 1150 bp, Paecilomyces lilacinus
  ref <308>: DATABASE ACCESSION NUMBER: ATCC 60735
ctcaaggccgagcgtgagcgtggtatcaccatcgacattgccctctggaagttcgagactcccaagtactatgtcaccgtcattggtacgtcgactcgcgcgagactggtcgcaatttccacgtcgctaacgtgcttgaacagacgctcccggccaccgtgacttcatcaagaacatgatcactggtacctcccaggctgactgcgctatcctcattatcgctgccggcactggtgagttcgaggctggtatctccaaggatggccagacccgtgagcacgctctgctcgcctacaccctcggtgttaagcagctcatcgtcgctatcaacaagatggacaccaccaagtggtctgaggcccgtttccaggagatcatcaaggagacctccaacttcatcaagaaggtcggctacaaccccaagaccgtcgctttcgtccccatctctggtttccacggcgacaacatgctttccccctccaccaactgcccctggtacaagggctgggagaaggagaccaaggctggcaagtccaccggcaagaccctccttgaggccatcgactccatcgagccccccaagcgccccagcgacaagcccctccgccttccccttcaggatgtgtacaagatcggcggtatcggcacagtccctgtcggccgtatcgagactggtgtcatcaagcccggcatggtcgtgaccttcgctccttccaacgtcaccaccgaagtcaagtccgttgagatgcaccacgagcagctctccgagggtgtccccggtgacaacgtcggcttcaacgtcaagaacgtctccgtcaaggagatccgtcgtggcaacgtcgccggtgactccaagaacgacccccctctgggtgccgcttctttcgatgcccaggtcatcgtcctcaaccaccccggccaggtcggtgctggctacgcccccgtcctcgactgccacaccgcccacattgcctgcaagttcgccgagatcaaggagaagatcgaccgccgtaccggcaagtctgtcgagtccgcccccaagttcatcaagtctggcgactctgccatcgtcaagatgattccctccaagcccatgtgcgttgaggctttcaccgactaccctcctctgggccgcttcgccgtccgtgac

SEQ ID NO: 901 - DNA, 751 bp, Paracoccidioides brasiliensis
  ref <308>: DATABASE ACCESSION NUMBER: ATCC 32075
taccactaagtggtccgagacccgattcaatgaaattatcaaggaagtcaccaatttcattaagaaggtcggatataaccccaagactgttcctttcgttcccatttctggtttcgagggtgacaacatgatcgagccctctgccaactgcccatggtacaagggctggtccaaggagactgctcagggcaagtactctggcaagacccttcttgaggccatcgacgccattgagccccccacccgtcctaccgataaacctctccgtcttcccctccaggatgtctacaagatctccggtattggcactgttcctgtcggacgtgttgagactggagtcatcaagcccggtatggtcgtgaccttcgctcccgccaacgtcaccactgaagtcaagtccgtcgaaatgcaccaccagcagcttaccgccggtaaccccggtgacaacgtcggcttcaacgtcaagaatgtttccgtcaaagaagtccgccgtggtaacgttgccggtgactctaagaatgatcccccaaagggctgcgattccttcaatgcccaggtcatcgtcctcaaccaccctggtcaggttggcgctggttatgccccagtcctcgactgccatactgcccacattgcctgcaaattcgctgagctccttgagaagattgatcgacgaaccggaaagtctgttgagaacaaccccaagttcatcaagtccggtgatgctgctatcgtcaagatgattccttccaag

SEQ ID NO: 902 - DNA, 1056 bp, Sporothrix schenckii
  ref <308>: DATABASE ACCESSION NUMBER: ATCC 7968
cgtgagcgcggtatcaccatcgatattgctctgtggaagttcgagacccccaagtactacgtcaccgtcattgacgcccccggtcatcgcgatttcatcaagaacatgatcactggtacctcgcaggccgactgcgccattctcatcattgccgctggtactggtgagttcgaggctggtatctccaaggatggccagactcgtgagcacgctctgctcgcctacaccctgggtgtgcggcagctgatcgtcgccatcaacaagatggacacggccaagtgggctgaggctcgttaccaggagatcatcaaggagacctccaacttcatcaagaaggtcggctacaaccccaagactgttgccttcgtccccatctcgggcttccacggcgacaacatgcttactccctcgaccaactgcccctggtacaagggctgggagaaggagggcaagagcggcaaggttaccggtaagactctgctggacgccattgacgccgtcgagccccccaagcgccccacggacaagcccctgcgtctgcccctccaggatgtctacaagatcggcggtatcggcactgtccctgtcggccgtatcgagactggtgtcctgaagcccggcatggtcgtcacctttgccccgtccaacgtcaccactgaagtcaagtccgtcgagatgcaccacgagcagcttgttgagggtgttcccggcgacaacgtcggcttcaacgtcaagaacgtctccgtcaaggagatccgtcgtggcaacgttgccggtgactccaagaacgaccccccctcgggcgccgccaccttcaacgcccaggtcattgtcctgaaccaccccggccaggtcggcaacggctacgccccggttctggactgccacaccgcccacattgcctgcaagttcaccgagatccttgagaagatcgaccgccgtaccggcaagtcggttgagaacaaccccaagttcatcaagtcgggtgacgccgccattgtcaagctgacgccctcgaagcccatgtgcgttgaggccttcactgactacccccct

SEQ ID NO: 903 - DNA, 1366 bp, Penicillium marneffei
  ref <308>: DATABASE ACCESSION NUMBER: ATCC 58950
caaggctgagcgtgagcgtggtatcaccatcgatattgctctctggaagttccagactgccaagtacgaggttaccgtcattgacgcccccggtcaccgtgatttcatcaagaacatgatcactggtacctcccaggccgattgcgctattctcatcattgcctctggtactggtgaattcgaggctggtatctccaaggatggccagactcgtgagcacgctcttttggctttcaccctcggtgtccgtcagctcattgttgccctcaacaagatggacacttgcaagtggtctcagggtgagtactcgtacctgcgtttggccttgaatatcttactaatgcaccatagatcgttacaacgaaattgtcaaggagacttccaacttcatcaagaaggtcggatacaaccctaagaacgttcctttcgttcctatctccggtttcaacggtgacaacatgcttgagccctcccccaactgcccctggtacaagggttgggagaaggagaccaaggccggtaaggtcactggtaagaccctcctcgaggccatcgacgccattgagccccctacccgtcccgccaacaaggttagtccctcctcgactactcaaaccctcctcataagttcagattactgactcgttcacagcccctccgtcttcccctccaggatgtctacaagatcggtggtattggaacggttcccgtcggtcgtgttgagactggtaccatcgttcctggtatggttgtcaccttgtaagtcactctcctcgcttatcctacctgaaatcatcatgtgctaacttgacactcagcgctcccgccaacgtcaccactgaagtcaagagtgttgaaatgcaccaccagcagctcactgccggtcagcccggtgacaacgttggtttcaacgtgaagaacgtctccgtcaaggaaatccgtcgtggtaacgttgctggtgacagcaagaacgacccccctgccggtgctgcctccttcaacgcccaggtcatcgtcctcaaccaccccggtcaggtcggtgctggttacgccccagtcctcgattgccacactgcccacattgcttgcaagttcgctgagctcctcgagaagattgaccgtcgtaccggaaagtctgttgaggaccaccccaagttcatcaagtccggtgacgctgccatcgtcaagatgattccttccaagcccatgtgtgttgaggctttcaccgagtaccctcctctcggtcgtttcgccgttcgcgagtaagttttatctccgttgtctattttccatccttcccttctcctccgtcttccatatatattttttcagttatatgtgactaaccacaaatcacgggaatagc

SEQ ID NO: 904 - DNA, 841 bp, Curvularia lunata
  ref <308>: DATABASE ACCESSION NUMBER: ATCC 26425
ctattatcgttgttgccgcttccgacggtcaaatgccccagactcgtgagcatctgctgctcgcccgccaggtcggtgtccagaagatcgttgtcttcgtcaacaaggtcgatgctgttgaggacaaggagatgttggagctcgtcgagatggagatgcgcgaattgctcagcagctacggcttcgagggcgacgagactcccatcatcatgggatctgccctctgcgccattgagggccgcgaacctgagattggtgtcaaccgaattgatgagctgctcgaggccgttgatacttggatccccacccctcagcgtgagaccgacaagcctttcctcatggccgtcgaggatgtcttctccattgctggtcgtggcactgtcgtctctggccgtgtcgagcgaggtatcctgaagcgcgatgctgaagttgagctcgtcggcaagggcaccgcccccatcaagaccaaggttaccgatatcgagaccttcaagaagtcctgcgaggagtctcgcgctggtgacaactccggtctccttcttcgtggtgtcaagcgtgatgaagtccgccgtggtatggtcgtttccgtccctggacaggtcaaggcgcacaagaagttccttgtctccatgtacgtgttgagcaaggaggaaggtggtcgtcacactggcttcggtgagaactacaggccgcaaatgttcatccgcactgccgacgagtcgtgtgccctgtactggccagaaggcaccgaggacgcccatgacaagcttgttatgcccggtgacaacgtcgagatggtttgcgagctccatgcaccacacgtcttggagcctggtcaacg

SEQ ID NO: 905 - DNA, 967 bp, Aspergillus niger
  ref <308>: DATABASE ACCESSION NUMBER: ATCC 9508
cggtgctatcattgtcgtcgccgcctccgacggtcagatgtacgttaaccttaaaagaataactctccttcagtatatatgcttacactggcgatcaacaggccccagactcgtgagcacttgctgcttgctcgtcaggtcggtgtccagaagatcgttgtcttcgtcaacaaggtcgatgctatcgatgaccccgagatgctggagctcgttgagctggaaatgcgcgagcttctcagcacctacggattcgagggtgaggagacccccatcgtcttcggctctgctctctgcgccattgaggaccgccgccccgacatcggtaccgagcgtatcgacgctctcctcgaggccgttgacacctggatccccactccccagcgtgaccttgacaagcctttcttgatgtccattgaggaagttttctccatccccggtcgtggtaccgtcgcctccggccgtgtcgagcgtggtctcctgaagcgtgatagcgaggttgagatcatcggtaccaccaacgaggtcatcaagaccaaggttaccgacattgagaccttcaagaagtcctgctccgagtcccgcgccggtgacaactccggtctcctgctccgtggtgtccgccgtgaggatctccgccgtggtatggtcattgccgctcctggcagcgccaaggccaacagcaagttcatggtctccatgtacgtcctgaccgaggctgarggtggtcgccgtaccggtttcggtgtccagtaccgtccccagctgttcatccgcactgccggtaagtaaaattgcattctattccgctactagggaaccatctctaattctatttgctacagatgaggctgctgagttcagcttccccgacggagaccagtcccgccgtatcatgcccggtgacaacgtcgagatgatcgtcaagacccaccgccccgtcgccgccgaggccggtcagcgcttcaac

SEQ ID NO: 906 - DNA, 852 bp, Bipolaris hawaiiensis
  ref <308>: DATABASE ACCESSION NUMBER: ATCC 26067
tggtgctattattgttgttgccgcttccgacggtcaaatgccccagactcgtgagcatctgctgctcgcccgtcaggtcggtgttcagaagatcgttgtcttcgttaacaaggtcgacgctgtcgaggacaaggagatgttggagcttgtcgagatggagatgcgcgaactgctcagcagctatggcttcgagggcgacgagacccctatcatcatgggttctgctctctgcgccattgaaggccgtcaacccgacattggtgtcgaacgaattgacgagctgctcgaggctgttgatacttggattcccacccctcagcgtgagaccgaaaagcctttcctcatggccgtcgaggatgtcttctccattgctggtcgtggtaccgtcgtctctggccgtgtcgaacgaggtatcctgaagcgcgatgctgaagttgagcttgtgggcaagggcagcgcacccatcaagaccaaggttaccgatatcgagaccttcaagaagtcttgcgaggagtcccgcgctggtgacaactccggtctccttcttcgtggtgttaagcgtgatgaagtccgccgtggtatggtcgtttccgtccctggacaggttaaggcgcacaagaagttccttgtctccatgtatgtgctgagcaaggaggaaggtggccgacacactggcttcggtgagaactacaggccgcaaatgttcatccgcactgccgacgagtcgtgtgccctgtactggccagaaggcaccgaggatgcccacgacaagcttgtcatgcccggtgacaacgtcgagatggtttgcgagctccatgcaccacacgtcttggagactggtcagcgcttcaa

SEQ ID NO: 907 - DNA, 966 bp, Aspergillus flavus
  ref <308>: DATABASE ACCESSION NUMBER: ATCC 26947
ggtgctattgttgtcgttgctgcttcggatggtcatgatgtatggacaggccctttgctactgaatggtttcaagatctcgcgcttacacgtattataataggccccagacccgggagcacttgctgcttgcccgtcaggtcggtgtccagaagatcgtcgtttttgtcaacaagattgatgccgttgaggaccctgagatgttggagcttgtcgagttggaaatgcgcgagctccttagcagctacggcttcgagggcgaagagactcccatcatcttcggttctgctctgtgtgctttggaggaccgtcgccccgacattggtgccgagcgtatcgacgagctcatgaaggccgttgacacctggatccctacccctcagcgtgatcttgacaagcctttcctcatgtctgtcgaggaagtcttctccatcgccggtcgtggtaccgttgcctccggccgtgtcgaacgtggtatcctgaagaaggacagcgaagtcgagatcatcggaggtagcttcgatgctaccaagaccaaggtcaccgacattgagaccttcaagaagtcttgtgacgagtcccgcgctggtgacaactctggcttgcttctccgtggtatccgtcgtgaagacgtccgccgcggaatgatcattgctgctcctggcagcaccaaggcccacgaccagttcttggtgtccatgtacgttctcactgaggctgagggtggtcgtcgtactggcttcggctccaactaccgcccccaggtgttcgttcgcactgctggtaagtcaagccttttgctcacttaacggtattgattaagttctaactgttgtatcctagatgaggctgctgacctcagcttccccgacggtgatgagtcccggagggtgatgcctggtgacaacgtcgagatggtcctcaagactcaccgccccattgctgctgaggctggccagcgcttcaa

SEQ ID NO: 908 - DNA, 845 bp, Alternaria alternata
  ref <308>: DATABASE ACCESSION NUMBER: ATCC 62099
ggtgctatcatcgtcgttgctgcttccgatggtcagatgccccagacccgtgagcacttgctgctcgcccgtcaggtcggtgttcagaagatcgttgtcttcgtcaacaaggtcgatgctgtcgaagacccggagatgttggaactcgtcgagatggagatgcgtgagttactcaccagctacggcttcgagggcgacgagacacccatcatcatgggttccgctctatgcgccatcgagggccgccagcccgagatcggtgttaccaaggtcgacgagctaatggacgctgtcgactcatggatccccacccctcagcgtgagaccgagaagcctttcctcatggctgttgaggatgtcttctcgattgctggacgtggtaccgtcgtttcgggccgtgtcgagcgcggtatcttgaagcgtgacgctgaagtcgagcttgtcggcaagggcaccgcgccaatcaagaccaaggtcactgatattgagaccttcaagaagtcgtgcgaggagtcgcgcgcgggtgataactccggtcttctcctccgtggtgtcaagcgtgatgacgttcgccgcggtatggttgtttccgttcccggacaagtcaaggctcacaagaagttccttgtctccatgtacgttctaagcaaagaggagggtggtcgtcacaccggcttcggcgagaactacaggccgcaaatgttcatccgaactgccgatgaatcctgcgcacttcacttcccagagggtaccgaggatgcgcacgacaagctagttatgcccggtgacaacgtcgagatggtctgcgaactccaccagccccacgttctagagaccggtcagcg

SEQ ID NO: 909 - DNA, 931 bp, Penicillium marneffei; identical to SEQ ID NO: 505
  ref <308>: DATABASE ACCESSION NUMBER: ATCC 64101

SEQ ID NO: 910 - DNA, 931 bp, Penicillium marneffei; identical to SEQ ID NO: 505
  ref <308>: DATABASE ACCESSION NUMBER: ATCC 58950

SEQ ID NO: 911 - DNA, 20 bp, Artificial Sequence
  Synthetic DNA Sequence
gacggmkkcatgccgcarac

SEQ ID NO: 912 - DNA, 20 bp, Artificial Sequence
  Synthetic DNA Sequence
gacggcgkcatgccgcarac

SEQ ID NO: 913 - DNA, 20 bp, Artificial Sequence
  Synthetic DNA Sequence
gacggysycatgcckcagac

SEQ ID NO: 914 - DNA, 21 bp, Artificial Sequence
  Synthetic DNA Sequence
gaaragctgcggrcgrtagtg

SEQ ID NO: 915 - DNA, 21 bp, Artificial Sequence
  Synthetic DNA Sequence
aaacgcctgaggrcggtagtt

SEQ ID NO: 916 - DNA, 20 bp, Artificial Sequence
  Synthetic DNA Sequence
gccgagctggccggcttcag

SEQ ID NO: 917 - DNA, 22 bp, Artificial Sequence
  Synthetic DNA Sequence
tcgtgctacccgtygccgccat

SEQ ID NO: 918 - DNA, 1391 bp, Escherichia coli
  strain J01672
agagaagcctgtcggcaccgtctggtttgcttttgccactgcccgcggtgaaggcattacccggcgggatgcttcagcggcgaccgtgatgcggtgcgtcgtcaggctactgcgtatgcattgcagaccttgtggcaacaatttctacaaaacacttgatactgtatgagcatacagtataattgcttcaacagaacatattgactatccggtattacccggcatgacaggagtaaaaatggctatcgacgaaaacaaacagaaagcgttggcggcagcactgggccagattgagaaacaatttggtaaaggctccatcatgcgcctgggtgaagaccgttccatggatgtggaaaccatctctaccggttcgctttcactggatatcgcgcttggggcaggtggtctgccgatgggccgtatcgtcgaaatctacggaccggaatcttccggtaaaaccacgctgacgctgcaggtgatcgccgcagcgcagcgtgaaggtaaaacctgtgcgtttatcgatgctgaacacgcgctggacccaatctacgcacgtaaactgggcgtcgatatcgacaacctgctgtgctcccagccggacaccggcgagcaggcactggaaatctgtgacgccctggcgcgttctggcgcagtagacgttatcgtcgttgactccgtggcggcactgacgccgaaagcggaaatcgaaggcgaaatcggcgactctcacatgggccttgcggcacgtatgatgagccaggcgatgcgtaagctggcgggtaacctgaagcagtccaacacgctgctgatcttcatcaaccagatccgtatgaaaattggtgtgatgttcggtaacccggaaaccactaccggtggtaacgcgctgaaattctacgcctctgttcgtctcgacatccgtcgtatcggcgcggtgaaagagggcgaaaacgtggtgggtagcgaaacccgcgtgaaagtggtgaagaacaaaatcgctgcgccgtttaaacaggctgaattccagatcctctacggcgaaggtatcaacttctacggcgaactggttgacctgggcgtaaaagagaagctgatcgagaaagcaggcgcgtggtacagctacaaaggtgagaagatcggtcagggtaaagcgaatgcgactgcctggctgaaagataacccggaaaccgcgaaagagatcgagaagaaagtacgtgagttgctgctgagcaacccgaactcaacgccggatttctctgtagatgatagcgaaggcgtagcagaaactaacgaagatttttaatcgtcttgtttgatacacaagggtcgcatctgcggcccttttgcttttttaagttgtaaggatatgccatgacagaatcaacatcccgtcg

SEQ ID NO: 919 - DNA, 23 bp, Artificial Sequence
  Synthetic DNA Sequence
  modified_base (3): i
  modified_base (6): i
  modified_base (12): i
  modified_base (15): i
  modified_base (18): i
ggnccngartcntmnggnaarac

SEQ ID NO: 920 - DNA, 23 bp, Artificial Sequence
  Synthetic DNA Sequence
  modified_base (3): i
  modified_base (9): i
  modified_base (12): i
  modified_base (15): i
  modified_base (18): i
  modified_base (20): i
tcnccvatntcnccntcnanytc

SEQ ID NO: 921 - DNA, 20 bp, Artificial Sequence
  Synthetic DNA Sequence
  modified_base (2): i
  modified_base (6): i
  modified_base (12): i
  modified_base (18): i
tnyrtngaygcngarcangc

SEQ ID NO: 922 - DNA, 23 bp, Artificial Sequence
  Synthetic DNA Sequence
  modified_base (9): i
  modified_base (12): i
  modified_base (15): i
  modified_base (18): i
  modified_base (21): i
taraayttnarngcnyknccncc

SEQ ID NO: 923 - DNA, 21 bp, Artificial Sequence
  Synthetic DNA Sequence
  modified_base (6): i
gacgcngccatcctgatgatc

SEQ ID NO: 924 - DNA, 21 bp, Artificial Sequence
  Synthetic DNA Sequence
acctcagtcgtcacgttggcg

SEQ ID NO: 925 - DNA, 20 bp, Artificial Sequence
  Synthetic DNA Sequence
aagcagatggttgtgtgctg

SEQ ID NO: 926 - DNA, 24 bp, Artificial Sequence
  Synthetic DNA Sequence
cagctgctcgtggtgcatctcgat

SEQ ID NO: 927 - DNA, 19 bp, Artificial Sequence
  Synthetic DNA Sequence
acgcggagaaggtgcgctt

SEQ ID NO: 928 - DNA, 22 bp, Artificial Sequence
  Synthetic DNA Sequence
ggtcgttcttcgagtcaccgca

SEQ ID NO: 929 - DNA, 448 bp, Bacteroides fragilis
  ref <308>: DATABASE ACCESSION NUMBER: ATCC 25285
ttcagcatgccatttcaaaacaggccgaagccgatatcgtgattatcgctgcttgtggggagcgtgcaaatgaagttgtggaaatctttaccgaatttccggaattggtggacccgcacacgggacgtaagctgatggagcgtaccattattatcgcaaatacatcgaacatgccggtagcagcgcgtgaagcttctgtgtatacggccatgacgattgccgaatactatcgtgccatgggattgaaagtcctgctgatggcagactccacttcccgttgggcgcaggcattgcgtgagatgtcgaaccgtatggaggagttgcccggaccggatgcattcccgatggacctgtcctcaatcatttctaacttctatggccgtgcaggctacgtgaaactgaataacggcgagagcggttctattacctttatcggtacagtatcacc

SEQ ID NO: 930 - DNA, 438 bp, Bacteroides distasonis
  ref <308>: DATABASE ACCESSION NUMBER: ATCC 8503
gctatctctaaacaagcggaagcggatatcgtgattatcgccgcctgcggtgagcgtgcgaatgaggtcgtagaggtatttacggagttcccggaattggtagacccgcatacgggacgtaaattgatggaacgtacgatcattatcgccaatacatccaacatgccggtagccgctcgtgaggcatccgtatatacggcgatgaccatcgccgagtattatcgcagcatgggtttgaaggttctgttgatggccgactctacttcccgctgggcacaggctttgcgtgagatgtccaaccgtttggaggagttgccgggaccggatgctttcccgatggacttgtccgctatcgtggcgaacttctacgctcgtgcgggattcgttcatttgaataacaacgctacaggctccgtcactttcatcggtacggtatcg

SEQ ID NO: 931 - DNA, 453 bp, Porphyromonas asaccharolytica
  ref <308>: DATABASE ACCESSION NUMBER: ATCC 25260
cctccagcacgctatctctaagcaggcggaggctgatatcgtcattatggcagcctgcggtgagcgtgctaatgaggtggtggagatctttgccgagttccctgagctcgaagacccacacacgggacgcaagctgatggagcgtacgatcatcatcgctaacacgagtaacatgccagtggctgctcgtgaggcttcggtctacaccgctatgaccatcgctgagtactaccgctcgatgggtctcaaagtactcctaatggctgactcgacctctcgctgggcacaggcactgcgtgagatgtctaaccgtctagaggagctgcctggaccagatgcattcccgatggacttgtcggctatcgtggcaaacttctacgctcgtgccggcttcgtctatctcaacaacggtgagacaggttctgtaaccttcatcggtacggtctctccagc

SEQ ID NO: 932 - DNA, 835 bp, Listeria monocytogenes
  ref <308>: DATABASE ACCESSION NUMBER: ATCC 15313
cggagctatcttagtagtatctgctgctgatggcccaatgccacaaactcgtgaacatatcttactttcacgtcaagttggtgttccatacatcgttgtattcatgaacaaatgtgacatggttgacgatgaagaattactagaattagttgaaatggaaattcgtgatctattaactgaatatgaattccctggcgatgacattcctgtaatcaaaggttcagctcttaaagcacttcaaggtgaagctgactgggaagctaaaattgacgagttaatggaagctgtagattcttacattccaactccwgaacgtgatactgacaaaccattcatgatgccagttgaggatgtattctcaatcactggtcgtggaacagttgcaactggacgtgttgaacgtggacaagttaaagttggtgacgaagtagaagttatcggtatcgaagaagaaagcaaaaaagtagtagtaactggagtagaaatgttccgtaaattactagactacgctgaagctggcgacaacattggcgcacttctacgtggtgttgctcgtgaagatatccaacrtggtcaagtattagctaaaccaggttcgattactccacacactaacttcaaagctgaaacttatgttttaactaaagaagaaggtggacgtcacactccattcttcaacaactaccgcccacaattctatttccgtactactgacgtaactggtattgttacacttccagaaggtactgaaatggtaaygcctggtgataacattgagcttgcagttgaactaattgcaccaatcgctatcgaagacggtactaaattctctatc

SEQ ID NO: 933 - DNA, 24 bp, Artificial Sequence
  Synthetic DNA Sequence
  modified_base (10): i
catcatcgtnttcmtgaacaartg

SEQ ID NO: 934 - DNA, 24 bp, Artificial Sequence
  Synthetic DNA Sequence
  modified_base (21): i
tcacgyttrrtaccacgcagnaga

SEQ ID NO: 935 - DNA, 23 bp, Artificial Sequence
  Synthetic DNA Sequence
  modified_base (3): i
  modified_base (9): i
  modified_base (15): i
ggnaarwsncarytntgycayac

SEQ ID NO: 936 - DNA, 20 bp, Artificial Sequence
  Synthetic DNA Sequence
  modified_base (3): i
  modified_base (5): i
  modified_base (9): i
  modified_base (12): i
  modified_base (18): i
tcnsnytcnggnarrcangg

SEQ ID NO: 937 - DNA, 23 bp, Artificial Sequence
  Synthetic DNA Sequence
  modified_base (3): i
  modified_base (6): i
  modified_base (12): i
  modified_base (18): i
atnacngargynttyggngartt

SEQ ID NO: 938 - DNA, 20 bp, Artificial Sequence
  Synthetic DNA Sequence
  modified_base (3): i
  modified_base (6): i
  modified_base (9): i
  modified_base (12): i
  modified_base (18): i
cyngtngynswngcrtgngc

SEQ ID NO: 939 - DNA, 1203 bp, Saccharomyces cerevisiae
atgtctcaagttcaagaacaacatatatcagagtcacagcttcagtacgggaacggttcgttgatgtccactgtaccagcagacctttcacagtcagtcgttgatggaaacggcaacggtagcagcgaagatattgaggccaccaacggctccggcgatggtggcggattgcaggagcaagcggaagcgcaaggtgaaatggaggatgaagcatacgatgaagctgccttaggttcgtttgtgccaatagaaaaactgcaagtgaacgggattactatggcggatgtgaaaaaactaagggagagtgggcttcacactgctgaagcggtagcatatgctcccagaaaggatttattggaaatcaaaggtatatcggaagctaaggcagataagttgctaaacgaagcggcaaggctagtgcctatgggatttgtcacggctgctgattttcatatgagaagatcggagctgatttgtttgacaacgggttctaagaatttggacactcttttgggtggtggtgtggaaactggttctattactgagcttttcggtgaattcaggacaggtaagtcccagctatgtcacactttggccgtgacatgccaaattccattggatattggtggcggtgaaggtaagtgtttgtatatcgataccgaaggtactttcaggccggtaagattggtatccatagctcagcggttcggattagacccggatgatgctttgaacaacgttgcgtatgcaagagcctataacgccgatcatcagttaagacttctggatgctgctgcccaaatgatgagcgagtctcggttttccttgattgtggtcgattctgttatggctctataccgtacggatttttctggtcgtggtgaactaagcgcaaggcaaatgcatttagccaaatttatgcgtgctttgcaaaggctggccgaccaatttggtgttgcagtcgtcgttactaaccaagtggtcgcccaagttgatggtggtatggcttttaatccagatccaaagaagcctatcggtggtaatattatggcacattcttccaccacgcgattaggtttcaaaaagggtaagggatgtcaaagattatgcaaagttgttgactcaccttgcttaccagaggctgaatgtgtgttcgcgatctatgaagatggtgttggtgaccccagagaagaagacgagtag

SEQ ID NO: 940 - DNA, 1800 bp, Saccharomyces cerevisiae
  strain GRF88
cgatccaattgctggtcttaagatgcatttgattgatctaggtattgccactgaagctgaagtcaaagcttacgacaagtccgctagaaaatacgttgacgaacaagttgaattagctgatgctgctcctcctccagaagccaaattatccatcttgtttgaagacgtctacgtgaaaggtacagaaactccaaccctaagaggtaggatccctgaagatacttgggacttcaaaaagcaaggttttgcctctagggattaattaaatcgtaaggaaaaataaaataatagtgctgtgatcgcatgatattcttccctggaagcgccattttatagcaagaaatgtaagtcaagtatattttaactgtatatacaacaatatgactcttttttatgccttgttgtttttcttcgggttttcccacacattgtgtggagagatagttattaacagaccgaaaatagccgcccaaggataaacttttatataaagggaagggtagttgacccaaaaatttggattctactttccagatttactttcacccttttatatttgctgtagtctgttatgccaatcaggaaagcatttgaacaaatatgtctgttacaggaactgagatcgatagtgatacagcaaaaaatattcttagtgtagatgaattacagaactatggtattaatgcctcagatcttcaaaaattgaagtctggtgggatatacacagtcaatgtatgttataataacatttttaaaacctctgctgtagaggttctttccccctttcttttactaactaataatttggaaaggaacttttatagaccgttttgtcaacaacaagaagacatctatgtaaaattaaagggttaagtgaggtgaaagtggaaaaaattaaagaagctgctggaaaaatcatacaggtgggatttatccccgctactgtacaattagatataagacagcgtgtgtactccttatcaactggatctaagcaactagattcaatcctaggtggtggaataatgacaatgagtatcactgaagtatttggtgaatttaggtgtggtaagacacagatgtctcatactttgtgtgttaccacgcagcttccgagggaaatgggtggtggtgaagggaaagtagcatatattgatacagaaggcactttcaggcccgagaggattaagcaaattgcagaaggttatgaattggatcccgagtcatgtttggcaaacgtttcatatgctagagccttgaatagtgaacatcaaatggaacttgttgaacaattgggtgaagaacttagttctggagattatcgccttatcgtggtagattctataatggcaaacttcagagtagactactgcggtagaggtgaactaagcgaaagacagcaaaagctaaatcaacatcttttcaaattgaatagattggcagaggaatttaatgttgcagtatttctgacaaaccaagttcaatcagacccaggtgcttctgcattatttgcctcggcagatggtaggaaaccaattggagggcacgttctggcacatgcgtcagcaacaaggattttgttgagaaaagggcgtggtgacgaaagagttgccaagttacaagattccccagatatgcctgaaaaagaatgtgtctacgtaattggtgaaaaaggtattaccgattcaagtgactagtttttgtatacttttttaatgaagatgacattgctcctttattaaacttttcttttactttgtgttactaatattattaatatcttgttatgattctttgttt

SEQ ID NO: 941 - DNA, 430 bp, Cryptococcus humicolus
  ref <308>: DATABASE ACCESSION NUMBER: ATCC 38294
cgtccttatccaggagctcattaacaacattgccaaggcccacggtggtttctccgtcttcaccggtgtcggtgagcgtacccgtgagggtaacgacctgtaccacgagatgcgtgagactggtgtcatcaacctcgagggcgactccaaggtcgctctcgtcttcggccagatgaacgagccccccggagcccgtgcccgtgtcgcccttaccggcctcaccatcgccgagtacttccgtgacgaggagggtcaggacgtgcttctcttcatcgacaacattttccgtttcacccaggccggttccgaggtgtctgcccttctcggtcgtatcccctcggccgtcggttaccagcccaccctcgctaccgacatgggttccatgcaggagcgtatcaccaccaccaagaagggttcgattacctccgtc

SEQ ID NO: 942 - DNA, 794 bp, Escherichia coli
  ref <308>: DATABASE ACCESSION NUMBER: ATCC 43895
cgtgtacgatgctcttgaggtgcaaaatggtaatgagcgtctggtgctggaagttcagcagcagctcggcggcggtatcgtgcgtaccatcgcaatgggttcctccgacggtctgcgtcgcggtctggatgtaaaagacctcgaacacccgatcgaagtcccggtaggtaaagcgactctgggccgtatcatgaacgtactgggtgaaccggtcgacatgaaaggcgagatcggtgaagaagagcgttgggcgattcaccgcgcagcaccttcctacgaagagctgtcaaactctcaggaactgctggaaaccggtatcaaagttatcgacctgatgtgtccgttcgctaagggcggtaaagttggtctgttcggtggtgcgggtgtaggtaaaaccgtaaacatgatggagctcattcgtaacatcgcgatcgagcactccggttactctgtgtttgcgggcgtaggtgaacgtactcgtgaggggaacgacttctaccacgaaatgaccgactccaacgttatcgataaagtatccctggtgtatggccagatgaacgagccgccgggaaaccgtctgcgcgtagctctgaccggtctgaccatggctgagaaattccgtgacgaaggtcgtgacgttctgctgttcgttgacaacatctatcgttacaccctggccggtacggaagtatccgcactgctgggccgtatgccttcagcggtaggttatcagccgaccctggcggaagagatgggcgttctgcaggaacgtatcacctccaccaaaaccggtt

SEQ ID NO: 943 - DNA, 814 bp, Escherichia coli
  ref <308>: DATABASE ACCESSION NUMBER: ATCC 35401
atgccgtaccgcgcgtgtacgatgctcttgaggtgcaaaatggtaatgagcgtctggtgctggaagttcagcagcagctcggcggcggtatcgtacgtaccatcgcaatgggttcctccgacggtctgcgtcgcggtctggatgtaaaagacctcgaacacccgattgaagtcccggtaggtaaagcgactctgggccgtatcatgaacgtactgggtgaaccggtcgacatgaaaggcgagatcggtgaagaagagcgttgggcgattcaccgcgcagcaccttcctacgaagagctgtcaaactctcaggaactgctggaaaccggtatcaaagttatcgacctgatgtgtccgttcgctaagggcggtaaagttggtctgttcggtggtgcgggtgtaggtaaaaccgtaaacatgatggagctcattcgtaacatcgcgatcgagcactccggttactctgtgtttgcgggcgtaggtgaacgtactcgtgagggtaacgacttctaccacgaaatgaccgactccaacgttatcgacaaagtatccctggtgtatggccagatgaacgagccgccgggaaaccgtctgcgcgttgctctgaccggtctgaccatggctgagaaattccgtgacgaaggtcgtgacgttctgctgttcgttgacaacatctatcgttacaccctggccggtacggaagtatccgcactgctgggccgtatgccttcagcggtaggttatcagccgaccctggcggaagagatgggcgttctgcaggaacgtatcacctccaccaaaactggttctatcac

SEQ ID NO: 944 - DNA, 798 bp, Escherichia coli
  ref <308>: DATABASE ACCESSION NUMBER: ATCC 11775
gtgtacgatgctcttgaggtgcaaaatggtaatgagcgtctggtgctggaagttcagcagcagctcggcggcggtatcgtgcgtaccatcgcaatgggttcctccgacggtctgcgtcgcggtctggatgtaaaagacctcgaacacccgatcgaagtcccggtaggtaaagcgactctgggccgtatcatgaacgtactgggtgaaccggtcgacatgaaaggcgagatcggtgaagaagagcgttgggcgattcaccgcgcagcaccttcctacgaagagctgtcaaactctcaggaactgctggaaaccggtatcaaagttatcgacctgatgtgtccgttcgctaagggcggtaaagttggtctgttcggtggtgcgggtgtaggtaaaaccgtaaacatgatggagcttattcgtaacatcgcgatcgagcactccggttactctgtgtttgcgggcgtaggtgaacgtactcgtgagggtaacgacttctaccacgaaatgaccgactccaacgttatcgacaaagtatccctggtgtatggccagatgaacgagccgccgggaaaccgtctgcgcgttgctctgaccggtctgaccatggctgagaaattccgtgacgaaggtcgtgacgttctgctgttcgttgacaacatctatcgttacaccctggccggtacggaagtatccgcactgctgggccgtatgccttcagcggtaggttatcagccgaccctggcggaagagatgggcgttctgcaggaacgtatcacctccaccaaaaccggttctatc

SEQ ID NO: 945 - DNA, 812 bp, Escherichia coli
  ref <308>: DATABASE ACCESSION NUMBER: ATCC 25922
atgccgtaccgcgcgtgtacgatgctcttgaggtgcaaaatggtaatgagcgtctggtgctggaagttcagcagcagctcggcggcggtatcgtgcgtaccatcgcaatgggttcctccgacggtctgcgtcgcggtctggatgtaaaagacctcgaacacccgatcgaagtcccggtaggtaaagcgactctgggccgtatcatgaacgtactgggtgaaccggtcgacatgaaaggcgagatcggtgaagaagagcgttgggcgattcaccgcgcagcaccttcctacgaagagctgtcaaactctcaggaactgctggaaaccggtatcaaagttatcgacctgatgtgtccgttcgctaagggcggtaaagttggtctgttcggtggtgcgggtgtaggtaaaaccgtaaacatgatggagcttattcgtaacatcgcgatcgagcactccggttactctgtgtttgcgggcgtaggtgaacgtactcgtgagggtaacgacttctaccacgaaatgaccgactccaacgttatcgacaaagtatccttggtgtatggccagatgaacgagccgccgggaaaccgtctgcgcgttgctctgaccggtctgaccatggctgagaaattccgtgacgaaggtcgtgacgtattgctgttcgtcgataacatctatcgttacaccctggccggtaccgaagtatccgcactgctgggccgtatgccttcagcggtaggttatcagccgaccctggcggaagagatgggcgttctgcaggaacgtatcacctccaccaaaaccggttctatc

SEQ ID NO: 946 - DNA, 832 bp, Neisseria polysaccharea
  ref <308>: DATABASE ACCESSION NUMBER: ATCC 43768
gcgacgctatcccgcatgtttacgatgccctgaaattggacgagaacggtctgactctggaagttcaacaacttctgggtgacggcgttgtccgtactattgcaatgggtagttcagacggcctgaaacgcggcatgtctgtaagcaatactggtgcgccaatcactgtgccggtaggtaaaggtactttgggtcgtattgtcgacgtattgggtacgcctgttgatgaagcaggtccgatcgataccgacaagagccgtgccattcaccaaactgctccgaaattcgacgagttgtctgcaactaccgaattgttggaaaccggtattaaagtgatcgacttgctgtgtccgtttgctaaaggcggtaaagtaggtctgttcggtggtgccggtgtaggcaaaaccgtgaacatgatggaattgatcaacaacatcgccaaagcgcacagcggtctgtccgtgttcgcaggtgtgggcgagcgtacccgtgaaggtaacgacttctaccacgagatgaaagattccaacgtattggataaagtggcaatggtttacggtcagatgaacgaacctccgggcaaccgtttgcgcgtcgcattgaccggtttgaccatggcggaatacttccgtgacgaaaaagacgaaaacggtaaaggtcgcgacgtattgttcttcgttgacaacatctaccgttacactctggccggtaccgaagtatctgcactgttgggccgtatgccttctgcagtgggttaccaaccgacattggctgaagaaatgggtcgtttgcaagagcgtattacctctacccaaaccggttccattacttc

SEQ ID NO: 947 - DNA, 840 bp, Neisseria sicca
  ref <308>: DATABASE ACCESSION NUMBER: ATCC 9913
tccgcgcgatgccattccgcatgtttacgacgccctgaaattggatgcaaacggcctgactttggaagtacaacagcttctgggcgacggcgtggttcgtactattgcaatgggtagttcggacggtctgaaacgcggcatgactgtaagcaatacagatgcgccgattactgtgccggtaggtaaaggtactttgggacgtattgtcgatgtgttgggtacacctgttgatgaagcaggtccgattgataccgacaaacaccgtgctatccatcagacagctccgaaattcgatgagttgtctgctactaccgagctgctggaaacaggcattaaagtgattgacttgctgtgtccgtttgccaaaggcggtaaagtaggtctgttcggtggtgccggtgtaggcaaaaccgtcaacatgatggaattgattaacaacatcgccaaagcgcatagtggtttgtccgtgttcgccggtgtgggggaacgtacccgtgaaggtaacgacttctaccacgagatgaaagattccaacgtattggacaaagtggcgatggtttacggtcagatgaacgaacctccgggtaaccgtctgcgtgtagccttgaccggtttgacgatggccgaatacttccgtgatgaaaaagacgaaagcggcaaaggtcgcgacgtattgttcttcgtggacaacatttaccgttacactctggccggtacagaagtatccgcattgctcggtcgtatgccttcagcagtaggttaccaaccgacattggctgaagaaatgggtcgtctgcaagagcgtattaccctctactcaaacaggctccattacttcta

SEQ ID NO: 948 - DNA, 843 bp, Streptococcus mitis
  ref <308>: DATABASE ACCESSION NUMBER: ATCC 903
gcagctggcgacaagctacctgagatcaataatgcacttgtagtctataaaaatgacgaaaaaaaatcaaaaatcgtccttgaagtagctcttgagcttggtgatggagtggttcggaccatcgctatggaatcaacggatgggttgactcgtggcatggaagtgctagatactggccgtccaatttctgtgccagtcggcaaagaaacacttggtcgcgtctttaacgttttgggagataccattgacttggatgctccttttgcggatgatgcagagcgccagccaatccataagaaagctccaacctttgatgagttgtctacttcttcagagatcttagagacaggtatcaaggttatcgacctgttagccccttatctgaaaggtggtaaagttggactcttcggtggtgccggagttggtaagaccgtcctgattcaagaattgatccacaacattgcccaagaacacggtggtatttctgtatttactggcgttggggaacgtacccgtgaagggaatgacctttattgggaaatgaaagagtctggtgttatcgagaaaacagccatggtcttcggtcagatgaatgagccgccaggagcgcgtatgcgggttgctttgactggtttgacgattgcagaatacttccgtgatgtggaaggtcaagatgtcttgctcttcattgacaacatcttccgtttcacgcaggcaggttctgaagtttctgcccttttgggtcggatgccgtcagccgttggttaccaaccaacacttgcgacagaaatggggcaattgcaagagcgtatcacatcgactaagaagggttctgtaacctct

SEQ ID NO: 949 - DNA, 841 bp, Streptococcus mitis
  ref <308>: DATABASE ACCESSION NUMBER: ATCC 49456
gcagcaggggaaaaacttcctgagattaacaatgcacttgtcgtctacaaaaatgacgaaagaaaaacaaaaatcgtccttgaagtagccttggagttgggagatggtatggtccgtactatcgccatggaatcaacagatggtttgactcgtggaatggaagtattggacacaggtcgtccaatctctgtaccagtaggtaaagaaactttgggacgtgtcttcaatgttttgggagataccattgacttggaagctccttttacagaagatgcagagcgtcagccaattcataaaaaagctccaacttttgatgaattgtctacctcttctgaaatccttgaaacagggattaaggttatcgaccttcttgccccttaccttaaaggtggtaaggttggacttttcggtggtgccggagttggtaaaaccgtcttaatccaagaattgattcacaacattgcccaagaacacggtggtatttcagtatttaccggtgttggggaacgtactcgtgagggtaatgacctttactgggaaatgaaagaatcaggtgttatcgagaaaacagccatggtatttggtcagatgaatgagccgccaggagcacgtatgcgtgttgccctaactggtttgacaatcgccgaatacttccgtgatgtggaaggccaagacgtgcttctctttatcgataatatcttccgtttcactcaggctggttcagaagtatctgcccttttgggtcgtatgccatcagccgttggttaccaaccaacacttgctacggaaatgggtcaattgcaagagcgtattacatcaactaaaaagggttctgtaacct

SEQ ID NO: 950 - DNA, 827 bp, Streptococcus mitis
  strain LSPQ 2583
gctacctgagatcaataatgcacttgtagtctataaaaatgacgaaaataaatcaaaaatcgtccttgaagtagctcttgagcttggtgatggagtggttcggaccatcgctatggaatcaacggatgggttgactcgtggcatggaagtgctagatactggtcgtccaatttctgtgccagtcggcaaagaaacacttggtcgcgtctttaacgttttgggagataccattgacttggatgctccttttgcggatgatgcagagcgccagccaatccataagaaagctccaacctttgatgagttgtctacttcatcagagatcttagagacaggtatcaaggttatcgacctgttagcaccttatctgaaaggtggtaaagtcggactcttcggtggtgccggagttggtaagaccgtcctgattcaggaattgatccacaacattgcccaagagcatggtggtatttccgtgtttaccggtgttggggaacgtacccgtgaagggaatgacctttactgggaaatgaaggagtctggcgttatcgagaaaacagccatggtcttcggtcagatgaatgagccaccaggagcgcgtatgcgggttgctttgactggtttgacgattgcagagtacttccgtgatgtagaaggtcaagatgtcttgctcttcattgacaacatcttccgtttcacgcaggcaggttctgaagtctctgcccttttgggtcggatgccatcagccgttggttaccaaccaacacttgcgactgaaatgggacaactccaagagcgtattacatcgactaagaaaggttctgtaactt

SEQ ID NO: 951 - DNA, 844 bp, Streptococcus oralis
  ref <308>: DATABASE ACCESSION NUMBER: ATCC 35037
gcagcaggggaaacacttcctgagattaataatgcacttgtcgtctacaaaaatgacgaaagaaaaacaaaaatcgtccttgaagtagccttggagttgggtgatggtatggtccgtacgatcgccatggaatcaacagatggtttgactcgtggaatggaagttttggacacaggccgtccaatctctgtaccagtaggtaaagaaactttgggacgtgtcttcaacgttttgggagatactattgacttggatgctcctttcgctgaagacgctgagcgtcagccaattcataagaaagctccaacttttgatgaattgtctacctcatctgaaatcttggaaacagggattaaggttatcgaccttcttgccccttaccttaaaggtgggaaagttggactcttcggtggtgccggagttggtaaaactgtcttgatccaagagttgattcacaacattgcccaagaacatggtggtatttcagtatttaccggtgttggagaacgtacccgtgaggggaacgacctttactgggaaatgaaagaatcaggcgttatcgagaaaacagccatggtatttggtcagatgaatgagccacctggagcacgtatgcgtgttgctcttactggtttgacaatcgccgaatacttccgtgatgtagaaggccaagatgtgcttctctttatcgacaatatcttccgtttcactcaagctggttcagaagtatctgcccttttgggtcggatgccttcagccgttggttaccaaccaacacttgctacggaaatgggtcaattgcaagaacgtatcacatcaactaagaagggttctgtaacctcta

SEQ ID NO: 952 - DNA, 830 bp, Streptococcus pneumoniae
  strain StrR-06
gcagcaggggaaaaacttcctgagattaacaatgcacttgtcgtctacaaaaatgacgaaagaaaaacaaaaatcgtccttgaagtagccttggagttaggagatggtatggttcgtactatcgccatggaatcaacagatgggttgactcgtggaatggaagtattggacacaggtcgtccaatctctgtaccagtaggtaaagaaactttgggacgtgtcttcaacgttttgggagataccattgatttggaagctccttttacagaagacgcagagcgtcagccaattcataaaaaagctccaacttttgatgagttgtctacctcttctgaaatccttgaaacagggatcaaggttattgaccttcttgccccttaccttaaaggtggtaaagttggacttttcggtggtgccggagttggtaaaaccgtcttaatccaagaattgattcacaacattgcccaagagcacggtggtatttcagtatttactggtgttggggaacgtactcgtgaggggaatgacctttactgggaaatgaaagaatcaggcgttatcgagaaaacagccatggtctttggtcagatgaatgagccaccaggagcacgtatgcgtgttgcccttactggtttgacaatcgctgaatacttccgtgatgtggaaggccaagacgtgcttctctttatcgataatatcttccgtttcactcaggctggttcagaagtatctgcccttttgggtcgtatgccatcagccgttggttaccaaccaacacttgctacggaaatgggtcaattgcaagaacgtatcacatcaaccaagaaggg

SEQ ID NO: 953 - DNA, 823 bp, Streptococcus pneumoniae
  strain StrR-11
aaaaacttcctgagattaacaatgcacttgtcgtctacaaaaatgacgaaagaaaaacaaaaatcgtccttgaagtagccttggagttaggagatggtatggttcgtactatcgccatggaatcaacagatgggttgactcgtggaatggaagtattggacacaggtcgtccaatctctgtaccagtaggtaaagaaactttgggacgtgtcttcaacgttttgggagataccattgatttggaagctccttttacagaagacgcagagcgtcagccaattcataaaaaagctccaacttttgatgagttgtctacctcttctgaaatccttgaaacagggatcaaggttattgaccttcttgccccttaccttaaaggtggtaaagttggacttttcggtggtgccggagttggtaaaaccgtcttaatccaagaattgattcacaacattgcccaagagcacggtggtatttcagtatttactggtgttggggaacgtactcgtgaggggaatgacctttactgggaaatgaaagaatcaggcgttatcgagaaaacagccatggtctttggtcagatgaatgagccaccaggagcacgtatgcgtgttgcccttactggtttgacaatcgctgaatacttccgtgatgtggaaggccaagacgtgcttctctttatcgataatatcttccgtttcactcaggctggttcagaagtatctgcccttttgggtcgtatgccatcagccgttggttaccaaccaacacttgctacggaaatgggtcaattgcaagaacgtatcacatcaactaagaagggttc

SEQ ID NO: 954 - DNA, 844 bp, Streptococcus pneumoniae
  strain StrR-55
gcagcaggggaaaaacttcctgagattaacaatgcacttgtcgtctacaaaaatgacgaaagaaaaacaaaaatcgtccttgaagtagccttggagttaggagatggtatggttcgtactatcgccatggaatcaacagatgggttgactcgtggaatggaagtattggacacaggtcgtccaatctctgtaccagtaggtaaagaaactttgggacgtgtcttcaacgttttgggagataccattgacttggaagctccttttacagaagacgcagagcgtcagccaattcataaaaaagctccaacttttgatgagttgtctacctcttctgaaatccttgaaacagggatcaaggttattgaccttcttgccccttaccttaaaggtggtaaagttggacttttcggtggtgccggagttggtaaaactgtcttaatccaagaattgattcacaacattgcccaagagcacggtggtatttcagtatttgctggtgttggggaacgtactcgtgaggggaatgacctttactgggaaatgaaagaatcaggcgttatcgagaaaacagccatggtctttggtcagatgaatgagccaccaggagcacgtatgcgtgttgcccttactggtttgacaatcgctgaatacttccgtgatgtggaaggccaagacgtgcttctctttatcgataatatcttccgtttcactcaggctggttcagaagtatctgcccttttgggtcgtatgccatcagccgttggttaccaaccaacacttgctacggaaatgggtcaattgcaagaacgtatcacatcaaccaagaagggttctgtaacctcta

SEQ ID NO: 955 - DNA, 834 bp, Streptococcus pneumoniae
  strain StrR-05
aaaaacttcctgagattaacaatgcacttgtcgtctacaaaaatgacgaaagaaaaacaaaaatcgtccttgaagtagccttggagttaggagatggtatggttcgtactatcgccatggaatcaacagatgggttgactcgtggaatggaagtattggacacaggtcgtccaatctctgtaccagtaggtaaagaaactttgggacgtgtcttcaacgttttgggagataccattgatttggaagctccttttacagaagacgcagagcgtcagccaattcataaaaaagctccaacttttgatgagttgtctacctcttctgaaatccttgaaacagggatcaaggttattgaccttcttgccccttaccttaaaggtggtaaagttggacttttcggtggtgccggagttggtaaaaccgtcttaatccaagaattgattcacaacattgcccaagagcacggtggtatttcagtatttactggtgttggggaacgtactcgtgaggggaatgacctttactgggaaatgaaagaatcaggcgttatcgagaaaacagccatggtctttggtcagatgaatgagccaccaggagcacgtatgcgtgttgcccttactggtttgacaatcgctgaatacttccgtgatgtggaaggccaagacgtgcttctctttatcgataatatcttccgtttcactcaggctggttcagaagtatctgcccttttgggtcgtatgccatcagccgttggttaccaaccaacacttgctacggaaatgggtcaattgcaagaacgtatcacatcaaccaagaagggttctgtaacctcta

SEQ ID NO: 956 - DNA, 495 bp, Babesia microtti
  strain Persing-1
ttgtatatcacaggcactcagcaaatattccgatactgacgtaattatatacgtgggttgtggtgaacgtgggaatgaaatggctgagattctatgcgaattccctgaactatctactgtagttaatgatgaaaaggtggccattatggaacgtacatgcttagttgccaatacttctaatatgccagtggccgctagagaagctagtatatacactggtattacaattgctgaatatttccgtgatatgggttacaactgcactcttatggccgattccactagccgatgggcagaggctctaagggaaatttctggtagattggctgaaatgcctgcagattctggctatccggcctatttatcgtcaaggttgtcagctttttatgaacgtgcaggtgggataactgtctaattaatttaggcttgattaagtgcttaggttcaccaacacgaaccggatctattacggttgtaggagcagtttctccacca

SEQ ID NO: 957 - DNA, 469 bp, Entamoeba histolytica
  strain HM1-1MSS
agttatttcacaagcattaagtaaatatagtaattcagatgttattatttatgtaggatgtggtgaacgaggaaatgaaatggcagaagttcttcgagattttccagctctttctattaaagtaggagataaagaagaatctattatgacaagaacagcacttgttgctaatacatctaatatgcctgttgcagcacgtgaagcatcaatttatactggaattacattatcagaatattatagagatatgggatataatgttgctatgatggcagattcaacatcaagatgggctgaagcacttagagaaatttcaggacgtcttgcagaaatgccagctgattctggatatccagcatatcttgcagcacgtttagcatcattttatgaacgtgcaggtatggttgaatgtttaggatcaccaaaaagaatagggtcagtttctattgtaggagctgtttcaccacct

SEQ ID NO: 958 - DNA, 452 bp, Fusobacterium nucleatum subsp. polymorphum
  ref <308>: DATABASE ACCESSION NUMBER: ATCC 10953
tacaacaccaacttgctaaatgggcagatgcagaagtagttgtttatgttggttgtggggaacgtggaaatgaaatgaccgatgtacttatggaattcccagaaattattgaccctaagacaggacaatctttaatgaagagaacagttcttatagctaatacttctaatatgccagttgctgctcgtgaggcttcaatctatactggtataactattgcagaatattttagagatatgggatattcagtggcacttatggcagattcaacaagtcgttgggcagaagcacttcgtgaaatgtcaggacgtttggaagaaatgccaggtgatgaaggatatccagcatatctatcaagtagaatagcagagttttatgaaagagcagggcttgttgaatgtctaggtaatggagaagaaggagcattaactgtaattggagcagtatctcca

SEQ ID NO: 959 - DNA, 469 bp, Leishmania aethiopica
  ref <308>: DATABASE ACCESSION NUMBER: ATCC 50119
tgtaattagtcaggccctctccaagtactccaactccgactgcgtcatctatgtcggctgcggcgagcgcggtaatgagatggccgaggtgctcatggagttcccgaccctgacgaccgtgatcaatggtcgcgaggagtcgatcatgaagcgcacctgcctcgtggcgaacacttcgaacatgccagtcgcagcccgtgaggcctctatttacaccggcatcaccctggccgagtactaccgtgatatgggcaagcatatcgccatgatggccgactcgacgtctcgctgggccgaggcgcttcgtgagatttcgggtcgtctggcggagatgccggccgatggtggctaccctgcctatctcagcgctcgtctcgcctccttctacgagcgcgccggcctcgtcacctgcatcggcgggccgaagcgccagggctccgtcacgattgtcggtgccgtgtctccgccg

SEQ ID NO: 960 - DNA, 469 bp, Leishmania tropica
  ref <308>: DATABASE ACCESSION NUMBER: ATCC 30815
tgtaattagtcaggccctctccaagtactccaactccgactgcgtcatctatgtcggctgcggcgagcgcggtaatgagatggccgaggtgctcatggagttcccgaccctgacgaccgtgatcgatggtcgcgaggagtcgatcatgaagcgcacctgcctcgtggcgaacacttcgaacatgccagtcgcagcccgtgaggcctctatttacaccggcatcaccctggccgagtactaccgtgatatgggcaagcatatcgccatgatggccgactcgacgtctcgctgggccgaggcgcttcgtgagatttcgggtcgtttggcggagatgccggccgatggtggctaccctgcctatctcagcgctcgtctcgcctccttctacgagcgcgccggcctcgtcacctgcatcggcgggccgaagcgccagggctccgtcacgattgtcggtgccgtgtctccgccg

SEQ ID NO: 961 - DNA, 469 bp, Leishmania guyanensis
  ref <308>: DATABASE ACCESSION NUMBER: ATCC 50126
tgtcatcagtcaggccctctccaagtactccaactcggactgtgtcatctatgtcggctgcggtgaacgcggtaacgagatggccgaggtgctcatggagttcccgaccctgacgactgtgatcgatggtcgcgaagagtccatcatgaagcgcacctgcctcgtggcgaacacctcgaacatgcccgtcgcagcccgtgaggcctctatttataccggcatcacccttgctgagtactaccgtgatatgggcaagcacattgccatgatggccgactcgacgtctcgctgggccgaggcgctgcgtgagatttcgggtcgattggcggagatgccggctgatggtggctaccctgcctacctcagcgcccgcctcgcctccttctacgagcgcgccggtctcgtcacctgcatcggcgggccgaagcgccagggctccgtcacgatcgtcggtgcagtgtctccaccg

SEQ ID NO: 962 - DNA, 469 bp, Leishmania donovani
  ref <308>: DATABASE ACCESSION NUMBER: ATCC 50212
tgtcattagtcaggccctctccaagtactccaactccgattgcgtcatctatgtcggctgcggcgagcgcggtaatgagatggccgaggtgctcatggagttcccgaccctgacgaccgtgatcgatggccgcgaggagtcgatcatgaagcgcacctgcctcgtggcgaacacctcgaacatgccagtcgcagcccgtgaggcctctatttacaccggcatcaccctggccgagtactaccgtgatatgggcaagcatatcgccatgatggctgactcgacgtctcgctgggccgaggcgcttcgtgagatttcgggtcgtctggcggagatgccggccgatggtggctaccccgcctacctcagcgctcgtctcgcctccttctacgagcgcgccggcctcgtcacctgcatcggcgggccgaagcgccagggctccgtcacgatcgtcggtgccgtgtctccaccg

SEQ ID NO: 963 - DNA, 469 bp, Leishmania hertigi
  ref <308>: DATABASE ACCESSION NUMBER: ATCC 50125
tgtgatcagtcaggccctttccaagtactccaactcggactgcgtcatctacgtcggctgtggtgagcgcgggaacgagatggccgaggtgctcatggatttcccgactttgacgactgtgatcgatggtcgcgaggagtccatcatgaagcgcacctgcctcgtggcgaacacctccaacatgccagttgcagcccgtgaggcttctatctataccggcatcacactggctgagtactatcgtgatatgggcaagcacattgccatgatggccgactcgacgtctcgctgggccgaggcgttgcgtgagatttccggtcggctggcggagatgccggccgatggtggttaccccgcctacctcagtgcccgtctcgcctccttctacgagcgcgctggcctcgtgacctgtatcggcgggccgaagcgccagggctccgtcacaattgttggtgcggtgtctccaccg

SEQ ID NO: 964 - DNA, 469 bp, Leishmania mexicana
  ref <308>: DATABASE ACCESSION NUMBER: ATCC 50156
ggtcattagtcaggccctttccaagtactccaactctgactgcgtcatctacgtcggctgcggcgagcgcggtaatgagatggccgaggtgctcatggagttcccgaccctgacgaccatgatcgatggtcgggaggagtcgatcatgaagcgcacctgcctcgtggcgaacacctcgaacatgcccgtcgcagcccgtgaggcctctatctacaccggcatcaccctcgccgagtactaccgtgatatgggcaagcatatcgccatgatggccgactcgacgtctcgctgggctgaggcgcttcgtgagatttcgggtcgtctggcggagatgccggccgatggtggctaccccgcctacctcagcgctcgtctcgcctccttctacgagcgcgccggcctcgtcacctgcatcggcgggccgaagcgccagggctccgtcacgatcgtcggtgccgtgtctccgccg

SEQ ID NO: 965 - DNA, 469 bp, Leishmania tropica; identical to SEQ ID NO: 960
  ref <308>: DATABASE ACCESSION NUMBER: ATCC 50129

SEQ ID NO: 966 - DNA, 449 bp, Peptostreptococcus anaerobius
  ref <308>: DATABASE ACCESSION NUMBER: ATCC 27337
caccagttcgccaagtgggcagatgctcagatagttgtatacgttggttgtggagaacgtggtaacgagatgacagacgttctaaatgaattcccagaactgattgaccctcatacaggcgaatctctaatgaagagaacagttcttatagctaatacgtcaaatatgccagttgcagccagagaggcaagtatatatacaggtattacaatagctgaatattttagagacatgggatattcagtagcggtaatggccgactctacatcaagatgggcagaggccctaagagagatgtcaggtcgtctagaagaaatgcctggtgatgaaggttatccagcctatctaggttctagagctgcagagttctatgaaagagcaggtaaggtaatatgtaagggtagcgataatagagagggagcccttacaataataggtgccgtgtcacc

SEQ ID NO: 967 - DNA, 826 bp, Bordetella pertussis
  ref <308>: DATABASE ACCESSION NUMBER: ATCC 9797
ctggtggtgtcggccgcagacggcccgatgccgcagacgcgcgagcacattttgctgtcgcgccaggttggcgtgccgtacatcatcgtgttcctgaacaaggcggacatggttgatgacgcggagctgctcgagctggtgaagatggaagtccgcgaactgctgagcaagtacgatttcccgggcgatgacacgccgatcgtgaagggttcggccaagctggcgctggaaggcgacaagggcgaactgggcgagcaggcgattctgtcgctggcgcaagcgctggacacgtacattccgacgccggagcgcgcggtcgacggtgcgttcctgatgccggtggaagacgtgttctcgatctcgggccgtggcacggtggtgactggccgtatcgagcgcggcgtggtgaaggttggcgaggaaatcgaaatcgtgggcatcaagccgacggtgaagacgacctgcacgggcgtggagatgttccgcaagctgctggaccagggccaggcgggcgacaacgtgggtatcttgctgcgcggcaccaagcgtgaagacgtcgagcgtggccaggtgctggccaagccgggttcgatcaacccgcacacggacttcacggccgaggtgtacattctgtccaaggaagagggtggccgtcacacgccgttcttcaacggctatcgtccgcagttctacttccgcacgacggacgtgaccggcacgatcgacctgccggcggacaaggaaatggtgctgccgggcgacaacgtgtcgatgaccgtcaagctgctggccccgatcgccatggaagaaggtctgcgtttcgcca

SEQ ID NO: 968 - DNA, 817 bp, Bordetella pertussis
  strain BD180
cgatcctggtggtgtcggccgcagacggcccgatgccgcagacgcgcgagcacattttgctgtcgcgccaggttggcgtgccgtacatcatcgtgttcctgaacaaggcggacatggttgatgacgcggagctgctcgagctggtggagatggaagtccgcgaactgctgagcaagtacgatttcccgggcgatgacacgccgatcgtgaagggttcggccaagctggcgctggaaggcgacaagggcgaactgggcgagcaggcgattctgtcgctggcgcaagcgctggacacgtacattccgacgccggagcgcgcggtcgacggtgcgttcctgatgccggtggaagacgtgttctcgatctcgggccgtggcacggtggtgactggccgtatcgagcgcggcgtggtgaaggttggcgaggaaatcgaaatcgtgggcatcaagccgacggtgaagacgacctgcacgggcgtggagatgttccgcaagctgctggaccagggccaggcgggcgacaacgtgggtatcttgctgcgcggcaccaagcgtgaagacgtcgagcgtggccaggtgctggccaagccgggttcgatcaacccgcacacggacttcacggccgaggtgtacattctgtccaaggaagagggtggccgtcacacgccgttcttcaacggctatcgtccgcagttctacttccgcacgacggacgtgaccggcacgatcgacctgccggcggacaaggaaatggtgctgccgggcgacaacgtgtcgatgaccgtcaagctgctggccccgatcgccatggaagaagg

SEQ ID NO: 969 - DNA, 637 bp, Enterococcus columbae
  ref <308>: DATABASE ACCESSION NUMBER: ATCC 51263
cctatgccacaaactcgtgaacacattcttttatcacgtaacgttggtgtgccatacatcgttgttttcttaaacaaagttgatatggttgacgacgaagaattattagaattagttgaaatggaagttcgtgacttattaactgaatatgacttcccaggagacgatgttcctgtaatcgctggttctgcattaaaagctttagaaggcgaccctgcttacgaagaaaaaatcttagaattaatggctgcagttgacgaatacatcccaactccagaacgtgacaacgacaaaccattcatgatgccagttgaagacgtgttctcaattactggtcgtggtactgttgctacaggtcgtgttgaacgtggacaagttcgtgttggtgacgaagttgaaatcgttggtatcgctgacgaaacttctaaaacaacagttactggtgttgaaatgttccgtaaattattagattacgctgaagctggagacaacatcggtgcattattacgtggtgtggctcgtgaagacatccaacgtggtcaagtattagctaaaccaggttcaatcactccacatacaaaattcactgctgaagtgtacgttttaactaaagaagaaggtggacgtcatactccat

SEQ ID NO: 970 - DNA, 634 bp, Enterococcus flavescens
  ref <308>: DATABASE ACCESSION NUMBER: ATCC 49997
tatgcctcaaacacgtgaacacatcttgttatcacgtaacgttggtgtaccatacatcgttgttttcttaaacaaaatggatatggttgatgacgaagaattactagaattagttgaaatggaagttcgtgacttattgtcagaatatgacttcccaggcgacgatgttcctgtaatcgctggttctgctttgaaagctcttgaaggcgatgcttcatacgaagaaaaaatcatggaattaatggctgcagttgacgaatacgttccaactccagaacgtgacactgacaaaccattcatgatgccagtcgaagacgtattctcaatcactggacgtggtactgttgctacaggccgtgttgaacgtggacaagttcgcgttggtgacgaagttgaaatcgttggtattgctgaagaaactgctaaaacaactgtaactggtgttgaaatgttccgtaaattgttagactatgctgaagcaggggataacattggtgcattgctacgtggggttgctcgtgaagacatccaacgtggacaagtattagctaaagctggtacaatcacacctcatacaaaatttaaagctgaagtttacgttttaacaaaagaagaaggtggacgtcacactcca

SEQ ID NO: 971 - DNA, 787 bp, Streptococcus pneumoniae
  strain StrR-55
ggaccaatgccacaaactcgtgagcacatccttctttcacgtcaggttggtgttaaacaccttatcgtcttcatgaacaaagttgacttggttgacgacgaagaattgcttgaattggttgaaatggaaatccgtgacctattgtcagaatacgacttcccaggtgacgatcttccagttatccaaggttcagcacttaaagctcttgaaggtgactctaaatacgaagacatcgttatggaattgatgaacacagttgatgagtatatcccagaaccagaacgtgacactgacaaaccattgcttcttccagtcgaggacgtattctcaatcactggacgtggtacagttgcttcaggacgtatcgaccgtggtatcgttaaagtcaacgacgaaatcgaaatcgttggtatcaaagaagaaactcaaaaagcagttgttactggtgttgaaatgttccgtaaacaacttgacgaaggtcttgctggagataacgtaggtgtccttcttcgtggtgttcaacgtgatgaaatcgaacgtggacaagttatcgctaaaccaggttcaatcaacccacacactaaattcaaaggtgaagtctacatccttactaaagaagaaggtggacgtcacactccattcttcaacaactaccgtccacaattctacttccgtactactgacgttacaggttcaatcgaacttccagcaggtactgaaatggtaatgcctggtgataacgtgacaatcgacgttgagttgattcacccaatcgccgtagaacaag

SEQ ID NO: 972 - DNA, 803 bp, Escherichia coli
  ref <308>: DATABASE ACCESSION NUMBER: ATCC 35401
tagttgctgcgactgacggcccgatgccgcagactcgtgagcacatcctgctgggtcgtcaggtaggcgttccgtacatcatcgtgttcctgaacaaatgcgacatggttgatgacgaagagctgctggaactggttgaaatggaagttcgtgaacttctgtctcagtacgacttcccgggcgacgacactccgatcgttcgtggttctgctctgaaagcgctggaaggcgacgcagagtgggaagcgaaaatcctggaactggctggcttcctggattcttacattccggaaccagagcgtgcgattgacaagccgttcctgctgccgatcgaagacgtattctccatctccggtcgtggtaccgttgttaccggtcgtgtagaacgcggtatcatcaaagttggtgaagaagttgaaatcgttggtatcaaagagactcagaagtctacctgtactggcgttgaaatgttccgcaaactgctggacgaaggccgtgctggtgagaacgtaggtgttctgctgcgtggtatcaaacgtgaagaaatcgaacgtggtcaggtactggctaagccgggcaccatcaagccgcacaccaagttcgaatctgaagtgtacattctgtccaaagatgaaggcggccgtcatactccgttcttcaaaggctaccgtccgcagttctacttccgtactactgacgtgactggtaccatcgaactgccggaaggcgtagagatggtaatgccgggcgacaacatcaaaatggttgttaccctgatccacccgatcgcgatggacgacggt

SEQ ID NO: 973 - DNA, 762 bp, Escherichia coli
  ref <308>: DATABASE ACCESSION NUMBER: ATCC 43895
actgacggcccgatgccgcagactcgtgagcacatcctgctgggtcgtcaggtaggcgttccgtacatcatcgtgttcctgaacaaatgcgacatggttgatgacgaagagctgctggaactggttgaaatggaagttcgtgaacttctgtctcagtacgacttcccgggcgacgacactccgatcgttcgtggttctgctctgaaagcgctggaaggcgacgcagagtgggaagcgaaaatcctggaactggctggcttcctggattcctacattccggaaccagagcgtgcrattgacaagccgttcctgctgccgatcgaagacgtattctccatctccggtcgtggtaccgttgttaccggtcgtgtagaacgcggtatcatcaaagttggtgaagaagttgaaatcgttggtatcaaagagactcagaagtctacctgtactggcgttgaaatgttccgcaaactgctggacgaaggccgtgctggtgagaacgtaggtgttctgctgcgtggtatcaaacgtgaagaaatcgaacgtggtcaggtactggctaagccgggcaccatcaagccgcacaccaagttcgaatctgaagtgtacattctgtccaaagatgaaggcggccgtcatactccgttcttcaaaggctaccgtccgcagttctacttccgtactactgacgtgactggtaccattgaactgccggaaggcgtagagatggtaatgccgggcgacaacatcaaaatggttgttacc

SEQ ID NO: 974 - DNA, 804 bp, Escherichia coli
  ref <308>: DATABASE ACCESSION NUMBER: ATCC 11775
cctggtagttgctgcgactgacggcccgatgccgcagactcgtgagcacatcctgctgggtcgtcaggtaggcgttccgtacatcatcgtgttcctgaacaaatgcgacatggttgatgacgaagagctgctggaactggttgaaatggaagttcgtgaacttctgtctcagtacgacttcccgggcgacgacactccgatcgttcgtggttctgctctgaaagcgctggaaggcgacgcagagtgggaagcgaaaatcctggaactggctggcttcctggattcctacattccggaaccagagcgtgcgattgacaagccgttcctgctgccgatcgaagacgtattctccatctccggtcgtggtaccgttgttaccggtcgtgtagaacgcggtatcatcaaagttggtgaagaagttgaaatcgttggtatcaaagagactcagaagtctacctgtactggcgttgaaatgttccgcaaactgctggacgaaggccgtgctggtgagaacgtaggtgttctgctgcgcggtatcaaacgtgaagaaatcgaacgtggtcaggtactggctaagccgggcaccatcaagccgcacaccaagttcgaatctgaagtgtacattctgtccaaagatgaaggcggtcgtcatactccgttcttcaaaggctaccgtccgcagttctacttccgtactactgacgtgactggtaccatcgaactgccggaaggcgtagagatggtaatgccgggcgacaacatcaaaatggttgttaccctgatccacccgatcgcgatggacga

SEQ ID NO: 975 - DNA, 804 bp, Escherichia coli
  ref <308>: DATABASE ACCESSION NUMBER: ATCC 25922
gcgatcctggtagttgctgcgactgacggcccgatgccgcagactcgtgagcacatcctgctgggtcgtcaggtaggcgttccgtacatcatcgtgttcctgaacaaatgcgacatggttgatgacgaagagctgctggaactggttgaaatggaagttcgtgaacttctgtctcagtacgacttcccgggcgacgacactccgatcgttcgtggttctgctctgaaagcgctggaaggcgacgcagagtgggaagcgaaaatcctggaactggctggcttcctggattcytacattccggaaccagagcgtgcgattgacaagccgttcctgctgccgatcgaagacgtattctccatctccggtcgtggtaccgttgttaccggtcgtgtagaacgcggtatcatcaaagttggtgaagaagttgaaatcgttggtatcaaagagactcagaagtctacctgtactggcgttgaaatgttccgcaaactgctggacgaaggccgtgctggtgagaacgtaggtgttctgctgcgtggtatcaaacgtgaagaaatcgaacgtggtcaggtactggctaagccgggcaccatcaagccgcacaccaagttcgaatctgaagtgtacattctgtccaaagatgaaggcggtcgtcatactccgttcttcaaaggctaccgtccgcagttctacttccgtactactgacgtgactggtaccatcgaactgccggaaggtgtagagatggtaatgccgggcgacaacatcaaaatggttgttaccctgatccacccgatcgcgatg

SEQ ID NO: 976 - DNA, 825 bp, Mycobacterium avium
  strain Mavi-1
ggcgcgatcctggtggtcgccgccaccgacggcccgatgccgcagacccgtgagcacgtgctgctcgcccgtcaggtcggtgtgccctacatcctggtcgccctgaacaaggccgacatggtcgacgacgaggagctcctcgagctcgtcgagatggaggtccgcgagctgctggccgcccaggagttcgacgaggacgccccggtggtgcgggtctcggcgctcaaggcgctcgagggcgacgccaagtgggtcgagtccgtcgagcagctgatggaggccgtcgacgagtcgatcccggacccggtccgcgagacggagaagccgttcctgatgccggtggaggacgtcttcaccatcaccgggcgtggcaccgtggtcaccggtcgtgtcgagcgcggtgtgatcaacgtgaacgaggaagtcgagatcgtcggcatccgcccgaccagcaccaagaccacggtcaccggtgtggaratgttccgcaagctgctcgaccagggccaggccggtgacaacgtcggtctgctgctgcgtggtatcaagcgtgaggacgtcgagcgcggccaggtcgtgaccaagcccggcaccaccacgccgcacaccgagttcgagggccaggtctacatcctgtccaaggacgagggcggccggcacacgccgttcttcaacaactaccgtccgcagttctacttccgcaccaccgacgtgaccggtgtggtgacgctgccggagggcaccgagatggtgatgcccggtgacaacaccaacatctcggtgaagctgatccagcccgtcgccatggacgacggtstgcggttc

SEQ ID NO: 977 - DNA, 820 bp, Streptococcus pneumoniae
  strain StrR-06
tatccttgtagtagcttcaactgacggaccaatgccacaaactcgtgagcacatccttctttcacgtcaggttggtgttaaacaccttatcgtcttcatgaacaaagttgacttggttgacgacgaagaattgcttgaattggttgaaatggaaatccgtgacctattgtcagaatacgacttcccaggtgacgatcttccagttatccaaggttcagcacttaaagctcttgaaggtgactctaaatacgaagacatcgttatggaattgatgaacacagttgatgagtatatcccagaaccagaacgtgacactgacaaaccattgcttcttccagtcgaggacgtattctcaatcactggacgtggtacagttgcttcaggacgtatcgaccgtggtatcgttaaagtcaacgacgaaatcgaaattgttggtatcaaagaagaaactcaaaaagcagttgttactggtgttgaaatgttccgtaaacaacttgacgaaggtcttgctggagataacgtaggtgtccttcttcgtggtgttcaacgtgatgaaatcgaacgtggacaagttatcgctaaaccaggttcaatcaacccacacactaaattcaaaggtgaagtctacatccttactaaagaagaaggtggacgtcacactccattcttcaacaactaccgtccacaattctacttccgtactactgacgttacaggttcaatcgaacttccagcaggtactgaaatggtaatgcctggtgataacgtgacaatcgacgttgagttgattcacccaatcgccgtagaacaaggtactaca

SEQ ID NO: 978 - DNA, 822 bp, Mycobacterium gordonae
  strain M-Gor-1
ggcgcgatcctggtggtcgccgccaccgatggcccgatgccgcagacccgtgagcacgtgctgctcgcccgtcaggtgggcgtgccctacatcctggtggcgctgaacaagtccgacgcggtcgacgacgaggagctgctcgagctcgtcgagctggaggtccgcgagttgctggccgcccaggacttcgacgaggaagctccggtggtccgggtctcggcgctgaaggcgctcgagggcgacgccacctgggtgaagtcggtagaggacttgatggacgcggtcgacgagtcgattccggacccggtccgcgacaccgacaagccgttcctgatgcccgtcgaggacgtcttcaccatcaccggtcgtggcaccgtcgtcaccggccgtgtggagcgcggcgtggtgaacgtgaacgaggaagtcgagatcgtcggcatcaagccgaccagcaccaagaccacggtcaccggtgtggagatgttccgcaagctgctcgaccagggtcaggccggtgacaacgtcggtctgctgctgcgtggtgtcaagcgtgaggacgtcgagcgcggccaggtcgtcatcaagcccggcaccaccactccgcacaccgagttcgagggtcaggtctacatcctgtccaaggacgagggcggccggcacacgccgttcttcaacaactaccgtccgcagttctacttccgcaccaccgacgtgaccggtgtggtgacgctgccggagggcaccgaaatggtgatgcccggtgacaacaccaacatctcggtgaagctgatccagcccgtcgccatggacgacggtctgcgg

SEQ ID NO: 979 - DNA, 821 bp, Streptococcus pneumoniae
  strain StrR-11
ctatccttgtagtagcttcaactgacggaccaatgccacaaactcgtgagcacatccttctttcacgtcaggttggtgttaaacaccttatcgtcttcatgaacaaagttgacttggttgacgacgaagaattgcttgaattggttgaaatggaaatccgtgacctattgtcagaatacgacttcccaggtgacgatcttccagttatccaaggttcagcacttaaagctcttgaaggtgactctaaatacgaagacatcgttatggaattgatgaacacagttgatgagtatatcccagaaccagaacgtgacactgacaaaccattgcttcttccagtcgaggacgtattctcaatcactggacgtggtacagttgcttcaggacgtatcgaccgtggtatcgttaaagtcaacgacgaaatcgaaatcgttggtatcaaagaagaaactcaaaaagcagttgttactggtgttgaaatgttccgtaaacaacttgacgaaggtcttgctggagataacgtaggtgtccttcttcgtggtgttcaacgtgatgaaatcgaacgtggacaagttatcgctaaaccaggttcaatcaacccacacactaaattcaaaggtgaagtctacatccttactaaagaagaaggtggacgtcacactccattcttcaacaactaccgtccacaattctacttccgtactactgacgttacaggttcaatcgaacttccagcaggtactgaaatggtaatgcctggtgataacgtgacaatcgacgttgagttgattcacccaatcgccgtagaacaaggtactaca

SEQ ID NO: 980 - DNA, 828 bp, Mycobacterium tuberculosis
  misc_feature (1)...(828): n=a,t,c or g
  ref <308>: DATABASE ACCESSION NUMBER: ATCC 25177
ggtgcgatcctggtggtcgccgccaccgacggcccgatgccccagacccgcgagcacgttctgctggcgcgtcaagtgggtgtgccctacatcctggtagcgctgaacaaggccgacgcagtggacgacgaggagctgctcgaactcgtcgagatggaggtccgcgagctgctggctgcccaggaattcgacgaggacgccccggttgtgcgggtctcggcgctcaaggcgctcgagggtgacgcgaagtgggttgcctctgtcgaggaactgatgaacgcggtcgacgagtcgattccggacccggtccgcgagaccgacaagccgttcctgatgccggtcgaggacgtcttcaccattaccggccgcggaaccgtggtcaccggacgtgtggagcgcggcgtgatcaacgtgaacgaggaagttgagatcgtcggcattcgcccatcgaccaccaagaccaccgtcaccggtgtggagatgttccgcaagctgctcgaccagggccaggcgggcgacaacgttggtttgctgctgcggggcgtcaagcgcgaggacgtcgagcgtggccaggttgtcaccaagcccggcaccaccacgccgcacaccgagttcgaaggccaggtctacatcctgtccaaggacgagggcggccggcacacgccgttcttcaacaactaccgtccgcagttctacttccgcaccaccgacgtgaccggtgtggtgacactgccggagggcaccgagatggtgatgcccggtgacaacaccaacatctcggtgaagttgatccagcccgtcgccatggacgaaggtntgcgtttcgcg

SEQ ID NO: 981 - DNA, 819 bp, Staphylococcus warneri
  strain CSG 144
cggcggtatcttagtagtatctgctgcagatggcccaatgccacaaactcgtgaacacatcttattatcacgtaacgttggtgtaccagctttagttgtattcttaaacaaagctgacatggttgacgacgaagaattattagaattagttgaaatggaagttcgtgacttattatctgaatacgacttccctggtgacgatgtaccagttatcgttggttctgcattaaaagctttagaaggcgacccagaatacgaacaaaaaatcttagacttaatgcaagctgtagatgactacatcccaactccagaacgtgactctgataaaccattcatgatgccagttgaggacgtattctcaatcactggtcgtggtactgtagcaacaggccgtgttgaacgtggtcaaatcaaagtcggtgaagaagttgaaatcatcggtatcactgaagaaagcaagaaaacaacagttacaggtgtagaaatgttccgtaaattattagactacgctgaagctggtgacaacatcggtgctttattacgtggtgttgcacgtgaagacgtacaacgtggacaagtattagcagctcctggctctattactccacacacaaaattcaaagctgatgtttacgttttatctaaagaagaaggtggacgtcatactccattcttcactaactaccgcccacaattctacttccgtactactgacgtaactggcgttgttcacttaccagaaggtactgaaatggttatgcctggcgataacgtagaaatgactgttgaattaatcgctccaatcgcgattgaagacgg

SEQ ID NO: 982 - DNA, 814 bp, Streptococcus mitis
  strain LSPQ 2583
ctatccttgtagtagcttcaactgacggaccaatgccacaaactcgtgagcacatccttctttcacgtcaggttggtgttaaacaccttatcgtcttcatgaacaagatcgacttggttgatgacgaagaattgcttgaattggttgaaatggaaatccgtgacctcttgtcagaatacgacttcccaggtgacgatcttccagttatccaaggttcagctcttaaagctcttgaaggtgatactaagtacgaagacatcatcatggaattgatgaacactgttgatgagtacatcccagaaccagaacgtgatactgacaaacctcttcttcttccagtcgaagacgtattctcaatcactggtcgtggtacagttgcttcaggacgtatcgaccgtggtactgttcgtgtcaacgatgaaatcgaaatcgttggtatcaaagaagaaatccaaaaagcagttgttactggtgttgaaatgttccgtaaacagcttgacgaaggtcttgcaggggacaacgtaggtgtacttcttcgtggtatccaacgtgatgaaatcgaacgtggtcaagttatcgctaaaccaggttcaatcaacccacacactaaattcaagggtgaagtttacatccttactaaagaagaaggtggacgtcacactccattcttcaacaactaccgtccacagttctacttccgtacaactgacgttacaggttcaatcgaacttccagcaggtactgaaatggtaatgcctggtgataacgtaactatcgacgttgagttgatccacccaatcgccgttgaacaagg

SEQ ID NO: 983 - DNA, 810 bp, Streptococcus mitis
  ref <308>: DATABASE ACCESSION NUMBER: ATCC 49456
ctatccttgtagtagcttcaactgacggaccaatgccacaaactcgtgagcacatccttctttcacgtcaggttggtgttaaacaccttatcgtcttcatgaacaaagttgacttggttgacgacgaagaattgcttgaattggttgaaatggaaatccgtgacctattgtcagaatacgacttcccaggtgacgatcttccagttatccaaggttcagctcttaaagcccttgaaggtgacactaaatacgaagacatcgttatggaattgatgaacacagttgatgagtacatcccagaaccagaacgtgacactgacaaaccattgcttcttccagtcgaagacgtattctcaatcactggtcgtggtacagttgcttcaggacgtatcgaccgtggtatcgttaaagtcaacgacgaaatcgaaatcgttggtatcaaagaagaaactcaaaaagcagttgttactggtgttgaaatgttccgtaaacaacttgacgaaggtcttgccggagataatgtaggtgtccttcttcgtggtgttcaacgtgatgaaatcgaacgtggacaagttattgctaaaccaggttcaatcaacccacacactaaattcaaaggtgaagtttacatccttactaaagaagaaggtggacgtcacactccattcttcaacaactaccgtccacaattctacttccgtactactgacgttacaggttcaatcgaacttccagcaggtactgaaatggtaatgcctggtgataacgtgacaatcgacgttgagttgatccacccaatcgccgtagaac

SEQ ID NO: 984 - DNA, 817 bp, Streptococcus mitis
  ref <308>: DATABASE ACCESSION NUMBER: ATCC 903
tccttgtagtagcttcaactgacggaccaatgccacaaactcgtgagcacatccttctttcacgtcaggttggtgttaaacaccttatcgtcttcatgaacaagatcgacttggttgatgacgaagaattgcttgaattggttgaaatggaaatccgtgacctcttgtcagaatacgacttcccaggtgacgatcttccagttatccaaggttcagctcttaaagctcttgaaggtgatactaagtacgaagacatcatcatggaattgatgaacactgttgatgagtacatcccagaaccagaacgtgatactgacaaacctcttcttcttccagtcgaagacgtattctcaatcactggtcgtggtacagttgcttcaggacgtatcgaccgtggtactgttcgtgtcaacgatgaaatcgaaatcgttggtatcaaagaagaaatccaaaaagcagttgttactggtgttgaaatgttccgtaaacagcttgacgaaggtcttgcaggggacaacgtaggtgtacttcttcgtggtatccaacgtgatgaaatcgaacgtggtcaagttatcgctaaaccaggttcaatcaacccacacactaaattcaagggtgaagtttacatccttactaaagaagaaggtggacgtcacactccattcttcaacaactaccgtccacagttctacttccgtacaactgacgttacaggttcaatcgaacttccagcaggtactgaaatggtaatgcctggtgataacgtaactatcgacgttgagttgatccacccaatcgccgttgaacaaggtactac

SEQ ID NO: 985 - DNA, 798 bp, Streptococcus oralis
  ref <308>: DATABASE ACCESSION NUMBER: ATCC 35037
gacggaccaatgccacaaactcgtgagcacatccttctttcacgtcaggttggtgttaaacaccttattgtcttcatgaacaaaattgacttggtagacgacgaagaattgcttgaattggttgaaatggaaatccgtgacctcttgtcagaatacgacttcccaggtgacgatcttccagttatccaaggttcagctcttaaagctcttgaaggtgactctaaatacgaagacatcattatggaattgatgaacactgttgatgagtacatcccagaaccagaacgtgacactgaaaaaccattgcttcttccagtcgaagacgtattctcaatcactggacgtggtacagttgcttcaggacgtatcgaccgtggtactgttcgtgtcaacgacgaaatcgaaatcgttggtatcaaagaagaaactcaaaaagcagttgttactggtgttgaaatgttccgtaaacaacttgacgaaggtcttgccggagataacgtaggtgtccttcttcgtggtgttcaacgtgacgaaatcgaacgtggacaagttatcgctaaaccaggttcaatcaacccacacactaaatttaaaggtgaagtctacatccttactaaagaagaaggtggacgtcacactccattcttcaacaactaccgtccacaattctacttccgtactactgacgttacaggttcaatcgaacttcctgcaggtactgaaatggtaatgcctggtgataacgtgactatcgacgttgagttgatccacccaatcgccgtagaacaaggtactaca

SEQ ID NO: 986 - DNA, 815 bp, Streptococcus pneumoniae
  strain StrR-05
ttgtagtagcttcaactgacggaccaatgccacaaactcgtgagcacatccttctttcacgtcaggttggtgttaaacaccttatcgtcttcatgaacaaagttgacttggttgacgacgaagaattgcttgaattggttgaaatggaaatccgtgacctattgtcagaatacgacttcccaggtgacgatcttccagttatccaaggttcagcacttaaagctcttgaaggtgactctaaatacgaagacatcgttatggaattgatgaacacagttgatgagtatattccagaaccagaacgtgacactgacaaaccattgcttcttccagtcgaggacgtattctcaatcactggacgtggtacagttgcttcaggacgtatcgaccgtggtatcgttaaagtcaacgacgaaatcgaaatcgttggtatcaaagaagaaactcaaaaagcagttgttactggtgttgaaatgttccgtaaacaacttgacgaaggtcttgctggagataacgtaggtgtccttcttcgtggtgttcaacgtgatgaaatcgaacgtggacaagttatcgctaaaccaggttcaatcaacccacacactaaattcaaaggtgaagtctacatccttactaaagaagaaggtggacgtcacactccattcttcaacaactaccgtccacaattctacttccgtactactgacgttacaggttcaatcgaacttccagcaggtactgaaatggtaatgcctggtgataacgtgacaatcgacgttgagttgattcacccaatcgccgtagaacaaggtactaca

SEQ ID NO: 987 - DNA, 832 bp, Enterococcus hirae
  ref <308>: DATABASE ACCESSION NUMBER: ATCC 8043
cggacaatcttggttgtttctgctacggatggcccaatgcctcaaactcgtgaacacattttactttctcgccaagtaggcgtgaaatatttgattgttttcttgaacaaaacagatttagtcgatgatgaagaattaattgatctagtagaaatggaagttcgtgaactattaagcgaatatggatttccaggtgatgatacacctgttatcaaaggatcagcattaaaagcattacaaggtgatcctgatgcagaagcagctatcatggaattgatggacacagtcgatgaatacatcccaacaccagaacgtgatacggacaaaccattattgttacccgccgaagatgtattttcaattactggacgtggaacagtagcatctggtcggattgaccgtggggctgttagagtcggtgacgaaatcgaaatcgtagggatcaaaccagaaacgcaaagagccgtagtaacaggagttgaaatgttccgcaaaacgcttgattacggtgaagcaggggataacgtaggtgtgttattacgtgggattcaaagagaagacatcgaacgtggccaagtgattgccaaacctggttcaattacacctcatactaaattcaaagcagaagtttaggttttgactaaagaagaaggcggacgtcatacaccattcttcaataattatcgaccacaattttatttccgcacaactgacgtaacaggaacaattgttttgccagaaggaacggaaatggtcatgcctggcgacaacgtaacgatcgatgtagaattgattcatcctgttgctattgaaaacgggacgactttctcca

SEQ ID NO: 988 - DNA, 835 bp, Enterococcus mundtii
  ref <308>: DATABASE ACCESSION NUMBER: ATCC 43186
tggtgcgatcttagttgtttctgcgacagatggaccaatgcctcaaactcgcgagcatatccttttatcacgtcaagttggtgtaaaatatttgattgtatttttgaataaagttgatttggtcgatgatgaagaattgatcgatcttgtagaaatggaagttcgtgaattactgaatgaatatggtttcccaggtgatgacacacctgtcatcaaaggctctgcattgaaagcattgcaaggtgacccagaagcagaagctgcgatcaatgaattgatggaaacagtggatgactatatcccaacaccagaacgtgataccgacaaaccattgcttttaccagttgaagatgttttctcaatcactggtcgcggaacggtagcatctggtcgtatcgaccgtggagccgttcgtgtcggtgatgaaatcgagatcatcggaatcaaacctgaaacgaaaaaagcggttgtgacaggggtagagatgttccgtaaaacgttagattatggcgaagctggagataacgtaggaatcttgttacgtggtatccaaagagaagatattgaacgtggacaagtaattgcgaaacctggttcaatcacaccacatacaaaattcaaagcggaagtttatgtattgacgaaagaagaaggcggacgtcatacaccattcttcaataactaccgcccacaattttatttccgcacaacagatgtaacaggtacgatcgtgttgccagaaggaacagaaatggtcatgcctggagacaacgtaaccatcgaggtagagttgatccatccagtggcaatcgaacaaggaacgactttctctatt

SEQ ID NO: 989 - DNA, 832 bp, Enterococcus raffinosus
  ref <308>: DATABASE ACCESSION NUMBER: ATCC 49427
tgcgatcttagtagtatctactactgatggaccaatgcctcaaacacgtgagcacattttgttatcacgccaagtaggtgttaaatacttgatcgtcttcttgaacaaagttgatttagtcgacgatgaagaattgattgatttagttgaaatggaagtacgtgagttactttcagaatatggtttcccaggcgatgatattcctgttcttaaaggttcagctctgaaagctttagaaggcgatcctgaacaagaacaagtaatcatggacctaatggatacggttgacgaatatatcccaacaccagaacgtgacactgacaaaccattcttgttaccagtggaagatgttttctcaatcacaggacgtgggactgttgcatctggtcgtattgatcgtggggaagttaaagtcggtgacgaagttgaaattatcgggatcaaacctgaagttcaaaaggctgtcgtaactggacttgaaatgttccgtaaaacattggattatggtgaagctggagataacgttggggttctattacgtggtattacacgtgatgaaatcgaacgtggtcaagtattagctaaaccaggttcaattacaccacatacgaaattcagtgcagaagtttatgtgttgacgaaagaagaaggtggacgtcatacaccattctttaacaactatcgtcctcaattctacttccgtacaacagacgttaccggtaatatcgtgttgccagaaggtactgaaatggtcatgcctggcgataacgtaacaatcgacgttgaattaatccatccaatcgccgtagaaaaaggaacaactttctctatt

SEQ ID NO: 990 - DNA, 154 bp, Bacillus anthracis
  strain CIP 9440
ggatcctgtatatgcacaaaaactaggtgttaacatcgatgaattactattatcacaacctgatacaggggagcaaggtttagaaatcgcagaagcacttgtacgaagtggtgcggttgatattatcgtaattgactctgtagcagctcttgta

SEQ ID NO: 991 - DNA, 384 bp, Prevotella melaninogenica
  ref <308>: DATABASE ACCESSION NUMBER: ATCC 25845
gccattgcagaggcacagaagcagggcggtattgcagccttcattgatgctgagcacgccttcgaccgtttctatgcagagaagttaggtgtggatgttgataacctttgggtttcacagccagacaatggtgagcaggctttagagattgccgaccagctgattcgctcttccgctattgacattctcgttgtcgactcagttgcagccttgactccaaagaaggagattgagggtgacatgggtgactctgcagtaggtttacaagcacgactgatgagtcaggcattgcgtaaacttacctcaacaatcgcaaaaactaatacttgctgcatcttcatcaaccagttgcgtgagaagattggtgtgatgtttggtaatcca

SEQ ID NO: 992 - DNA, 624 bp, Enterococcus casseliflavus
  strain R760
acacgtgaacacatcttgttatcacgtaacgttggtgtaccatacatcgttgttttcttaaacaaaatggatatggttgatgacgaagaattactagaattagttgaaatggaagttcgtgacttattgtcagaatatgacttcccaggcgacgatgttcctgtaatcgctggttctgctttgaaagctcttgaaggcgatgcttcatacgaagaaaaaatcatggaattaatggctgcagttgacgaatacgttccaactccagaacgtgacactgacaaaccattcatgatgccagtcgaagacgtattctcaatcactggacgtggtactgttgctacaggccgtgttgaacgtggacaagttcgcgttggtgacgaagttgaaatcgttggtattgctgaagaaactgctaaaacaactgtaactggtgttgaaatgttccgtaaattgttagactatgctgaagcaggggataacattggtgcattgctacgtggtgttgctcgtgaagacatccaacgtggacaagtattggctaaagctggtacaatcacacctcatacaaaatttaaagctgaagtttacgttttaacaaaagaagaaggtggacgtcatacacca

SEQ ID NO: 993 - DNA, 756 bp, Streptococcus pyogenes
atggaaaacaataaaaaagtattgaagaaaatggtattttttgttttagtgacatttcttggactaacaatctcgcaagaggtatttgctcaacaagaccccgatccaagccaacttcacagatctagtttagttaaaaaccttcaaaatatatattttctttatgagggtgaccctgttactcacgagaatgtgaaatctgttgatcaacttttatctcacgatttaatatataatgtttcagggccaaattatgataaattaaaaactgaacttaagaaccaagagatggcaactttatttaaggataaaaacgttgatatttatggtgtagaatattaccatctctgttatttatgtgaaaatgcagaaaggagtgcatgtatctacggaggggtaacaaatcatgaagggaatcatttagaaattcctaaaaagatagtcgttaaagtatcaatcgatggtatccaaagcctatcatttgatattgaaacaaataaaaaaatggtaactgctcaagaattagactataaagttagaaaatatcttacagataataagcaactatatactaatggaccttctaaatatgaaactggatatataaagttcatacctaagaataaagaaagtttttggtttgattttttccctgaaccagaatttactcaatctaaatatcttatgatatataaagataatgaaacgcttgactcaaacacaagccaaattgaagtctacctaacaaccaagtaa

SEQ ID NO: 994 - DNA, 23 bp, Artificial Sequence
  Synthetic DNA Sequence
tggactaacaatctcgcaagagg

SEQ ID NO: 995 - DNA, 22 bp, Artificial Sequence
  Synthetic DNA Sequence
acattctcgtgagtaacagggt

SEQ ID NO: 996 - DNA, 25 bp, Artificial Sequence
  Synthetic DNA Sequence
acaaatcatgaagggaatcatttag

SEQ ID NO: 997 - DNA, 23 bp, Artificial Sequence
  Synthetic DNA Sequence
ctaattcttgagcagttaccatt

SEQ ID NO: 998 - DNA, 23 bp, Artificial Sequence
  Synthetic DNA Sequence
ggaggggtaacaaatcatgaagg

SEQ ID NO: 999 - DNA, 23 bp, Artificial Sequence
  Synthetic DNA Sequence
ttgaccttgttgatgacgaagag

SEQ ID NO: 1000 - DNA, 23 bp, Artificial Sequence
  Synthetic DNA Sequence
ttagtgtgtgggttgattgaact

SEQ ID NO: 1001 - DNA, 23 bp, Artificial Sequence
  Synthetic DNA Sequence
aagagttgcttgaattagttgag

SEQ ID NO: 1002 - DNA, 894 bp, Streptococcus pyogenes
  ref <308>: DATABASE ACCESSION NUMBER: ATCC 700294
aacatgatcactggtgccgctcaaatggacggagctatccttgtagttgcttcaactgatggaccaatgccacaaactcgtgagcacatccttctttcacgtcaggttggtgttaaacaccttatcgtgttcatgaacaaagttgaccttgttgatgacgaagagttgcttgaattagttgagatggaaattcgtgaccttctttcagaatacgatttcccaggtgatgaccttccagttatccaaggttcagctcttaaagctcttgaaggcgacactaaatttgaagacatcatcatggaattgatggatactgttgattcatacattccagaaccagaacgcgacactgacaaaccattgcttcttccagtcgaagacgtattctcaattacaggtcgtggtacagttgcttcaggacgtatcgaccgtggtactgttcgtgtcaacgacgaaatcgaaatcgttggtatcaaagaagaaactaaaaaagctgttgttactggtgttgaaatgttccgtaaacaacttgacgaaggtcttgcaggagacaacgtaggtatccttcttcgtggtgttcaacgtgacgaaatcgaacgtggtcaagttattgctaaaccaagttcaatcaacccacacactaaattcaaaggtgaagtatatatcctttctaaagacgaaggtggacgtcacactccattcttcaacaactaccgtccacaattctacttccgtacaactgacgtaacaggttcaatcgaacttccagcaggtacagaaatggttatgcctggtgataacgtgacaatcaacgttgagttgatccacccaatcgccgtagaacaaggtactactttctcaatccgtgaaggtggacgtactgttggttcaggt

SEQ ID NO: 1003 - DNA, 332 bp, Bacillus cereus
  ref <308>: DATABASE ACCESSION NUMBER: ATCC 14579
aatggatcctgtatatgcacaaaaattaggcgttaacatagatgaattactattatcacagcctgatacaggggagcaaggattagaaatcgcggaagcacttgtacgaagtggtgcggttgacattatcgtaattgactctgtagcagctcttgtaccgaaagcagagattgaaggcgacatgggtgactcacacgtaggtttacaagcacgtttaatgtcacaagcacttcgtaagctttcaggagcaatcaacaaatcaaaaacaattgcaatctttattaaccaaattcgtgaaaaagttggggttatgttcggaaacccagaaacaa

SEQ ID NO: 1004 - DNA, 1212 bp, Streptococcus pneumoniae
  strain StrR-01
accaagaagctcaaaaacatctgtgggatatctacaactccgatcaatacgtctcttaccctgacgatgatttgcaagtcgcatctacggtcgtagatgtttcaaatggtaaagtcatcgcccaacttggagctcgtcaccaagcaagtaacgtttcatttggtaccaaccaagctgtggaaaccaatcgtgactggggttctgctatgaaaccaatcaccgattatgcacctgccatagaatacggtgtttatgattccactgcaactatggttaatgatattccttataactatccgggaacaagcacacctgtctacaactgggatagagcatatttcggtaatattactctgcaatatgctcttcaacaatcacgaaatgtcacagccgttgagactttgaataaggtcggtctagatagagctaaaaccttccttaatggtcttggtatcgactatccaagcatgcattatgcaaacgccatttcaagtaatacaacagaatctaataaacaatacggagcaagtagtgaaaaaatggctgctgcttatgctgcctttgcaaatggtggcacttactataaaccaatgtatatccataaagtcgtcttcagtgatggaagtaaaaaagagttctctaatgtcggaactcgtgccatgaaggaaacgacagcctatatgatgaccgacatgatgaaaacagtcttgacttatggaactgggcgtggagcctatcttccttggcttcctcaagctggtaaaacaggaacctctaactatacagatgaggaagttgaaaaccacatcaagaacactggctatgtagctccagatgaaatgtttgttggttatactcgtaagtattctatggctgtatggacaggttattcgaatcgtttaactcctatcgttggagatggtttcctagttgcagctaaagtttatcgctcaatgataacgtatctatcagaagatactcatccagaagactggacgatgccagacggacttttcagaaacggggaatttgtattcaaaaatggagctcgcccaatatggactgaaccctctactcaacaatcctcaacagctgaaagttcaagctcatcatcagatagttcaacttcacagtctagctcaaccactccaagcacaaataatagtacgactaccaatcctaacaataatacgcaacaatcaaatacaaccc

SEQ ID NO: 1005 - DNA, 1212 bp, Streptococcus pneumoniae
  strain StrR-02
aagctcaaaaacatctgtgggatatctacaactccgatcaatacgtctcttaccctgacgatgatttgcaagtcgcatctacggtcgtagatgtttcaaatggtaaagtcatcgcccaacttggagctcgtcaccaagcaagtaacgtttcatttggtaccaaccaagctgtggaaaccaatcgtgactggggttctgctatgaaaccaatcaccgattatgcacctgccatagaatacggtgtttatgattccactgcaactatggttaatgatattccttataactatccgggaacaagcacacctgtctacaactgggatagagcatatttcggtaatattactctgcaatatgctcttcaacaatcacgaaatgtcacagccgttgagactttgaataaggtcggtctagatagagctaaaaccttccttaatggtcttggtatcgactatccaagcatgcattatgcaaacgccatttcaagtaatacaacagaatctaataaacaatacggagcaagtagtgaaaaaatggctgctgcttatgctgcctttgccaacggtggaatttaccacaaacccatgtatatcaataaggtcgtcttcagtgacggtagtaaaaaagaattttcagatgtaggtacacgagctatgaaagaaacaactgcttacatgatgaccgaaatgatgaaaactgtcttggcatacggaactggtcgtggagcctatctcccatggttagcgcaagctggtaagacaggtacttctaactacacagatgatgaaattgaaaaacacatcaagaacactggctatgtagctccagatgaaatgtttgttggttatactcgtaagtattctatggctgtatggacaggttattcgaatcgtttaactcctatcgttggagatggtttcctagttgcagctaaagtttatcgctcaatgataacgtatctgtctgaaggaagcaatccagaggattggaatataccagaggggctctacagaaatggagaattcgtatttaaaaatggtgctcgttctacgtggagctcacctgctccacaacaacccccatcaactgaaagttcaagctcatcatcagatagttcaacttcacagtctaactcaaccactccaagcacaaataatagtacgactaccaatcctaacaataatacgcaacaatcaaatacaacccctgatc

SEQ ID NO: 1006 - DNA, 1213 bp, Streptococcus pneumoniae
  strain StrR-03
accaagaagctcaaaaacatctgtgggatatctacaactccgatcaatacgtctcttaccctgacgatgatttgcaagtcgcatctacggtcgtagatgtttcaaatggtaaagtcatcgcccaacttggagctcgtcaccaagcaagtaacgtttcatttggtaccaaccaagctgtggaaaccaatcgtgactggggttctgctatgaaaccaatcaccgattatgcacctgccatagaatacggtgtttatgattccactgcaactatggttaatgatattccttataactatccgggaacaagcacacctgtctacaactgggatagagcatatttcggtaatattactctgcaatatgctcttcaacaatcacgaaatgtcacagccgttgagactttgaataaggtcggtctagatagagctaaaaccttccttaatggtcttggtatcgactatccaagcatgcattatgcaaacgccatttcaagtaatacaacagaatctaataaacaatacggagcaagtagtgaaaaaatggctgctgcttatgctgcctttgccaacggtggaatttaccacaaacccatgtatatcaataaggtcgtcttcagtgacggtagtaaaaaagaattttcagatgtaggtacacgagctatgaaagaaacaactgcttacatgatgaccgaaatgatgaaaactgtcttggcatacggaactggtcgtggagcctatctcccatggttagcgcaagctggtaagacaggtacttctaactacacagatgatgaaattgaaaaacacatcaagaacactggctatgtagctccagatgaaatgtttgttggttatactcgtaagtattctatggctgtatggacaggttattcgaatcgtttaactcctatcgttggagatggtttcctagttgcagctaaagtttatcgctcaatgataacgtatctgtctgaaggaagcaatccagaggattggaatataccagaggggctctacagaaatggagaattcgtatttaaaaatggtgctcgttctacgtggagctcacctgctccacaacaacccccatcaactgaaagttcaagctcatcatcagatagttcaacttcacagtctaactcaaccactccaagcacaaataatagtacgactaccaatcctaacaataatacgcaacaatcaaatacaacccc

SEQ ID NO: 1007 - DNA, 1218 bp, Streptococcus pneumoniae
  strain StrR-04
accaagaagctcaaaaacatctgtgggatatctacaactccgatcaatacgtctcttaccctgacgatgatttgcaagtcgcatctacggtcgtagatgtttcaaatggtaaagtcatcgcccaacttggagctcgtcaccaagcaagtaacgtttcatttggtaccaaccaagctgtggaaaccaatcgtgactggggttctgctatgaaaccaatcaccgattatgcacctgccatagaatacggtgtttatgattccactgcaactatggttaatgatattccttataactatccgggaacaagcacacctgtctacaactgggatagagcatatttcggtaatattactctgcaatatgctcttcaacaatcacgaaatgtcacagccgttgagactttgaataaggtcggtctagatagagctaaaaccttccttaatggtcttggtatcgactatccaagcatgcattatgcaaacgccatttcaagtaatacaacagaatctaataaacaatacggagcaagtagtgaaaaaatggctgctgcttatgctgcctttgcaaatggtggcacttactataaaccaatgtatatccataaagtcgtcttcagtgatggaagtaaaaaagagttctctaatgtcggaactcgtgccatgaaggaaacgacagcctatatgatgaccgacatgatgaaaacagtcttgacttatggaactgggcgtggagcctatcttccttggcttcctcaagctggtaaaacaggaacctctaactatacagatgaggaagttgaaaaccacatcaagaacactggctatgtagctccagatgaaatgtttgttggttatactcgtaagtattctatggctgtatggacaggttattcgaatcgtttaactcctatcgttggagatggtttcctagttgcagctaaagtttatcgctcaatgataacgtatctatcagaagatactcatccagaagactggacgatgccagacggacttttcagaaacggggaatttgtattcaaaaatggagctcgcccaatatggactgaaccctctactcaacaatcctcaacagctgaaagttcaagctcatcatcagatagttcaacttcacagtctagctcaaccactccaagcacaaataatagtacgactaccaatcctaacaataatacgcaacaatcaaatacaacccctgatc

SEQ ID NO: 1008 - DNA, 1223 bp, Streptococcus pneumoniae
  strain StrR-05
gtagaccaagaagctcaaaaacatctgtgggatatctacaactccgatcaatacgtctcttaccctgacgatgatttgcaagtcgcatctacggtcgtagatgtttcaaatggtaaagtcatcgcccaacttggagctcgtcaccaagcaagtaacgtttcatttggtaccaaccaagctgtggaaaccaatcgtgactggggttctgctatgaaaccaatcaccgattatgcacctgccatagaatacggtgtttatgattccactgcaactatggttaatgatattccttataactatccgggaacaagcacacctgtctacaactgggatagagcatatttcggtaatattactctgcaatatgctcttcaacaatcacgaaatgtcacagccgttgagactttgaataaggtcggtctagatagagctaaaaccttccttaatggtcttggtatcgactatccaagcatgcattatgcaaacgccatttcaagtaatacaacagaatctaataaacaatacggagcaagtagtgaaaaaatggctgctgcttatgctgcctttgcaaatggtggcacttactataaaccaatgtatatccataaagtcgtcttcagtgatggaagtaaaaaagagttctctaatgtcggaactcgtgccatgaaggaaacgacagcctatatgatgaccgacatgatgaaaacagtcttgacttatggaactgggcgtggagcctatcttccttggcttcctcaagctggtaaaacaggaacctctaactatacagatgaggaagttgaaaaccacatcaagaacactggctatgtagctccagatgaaatgtttgttggttatactcgtaagtattctatggctgtatggacaggttattcgaatcgtttaactcctatcgttggagatggtttcctagttgcagctaaagtttatcgctcaatgataacgtatctatcagaagatactcatccagaagactggacgatgccagacggacttttcagaaacggggaatttgtattcaaaaatggagctcgcccaatatggactgaaccctctactcaacaatcctcaacagctgaaagttcaagctcatcatcagatagttcaacttcacagtctagctcaaccactccaagcacaaataatagtacgactaccaatcctaacaataatacgcaacaatcaaatacaacccctgatca

SEQ ID NO: 1009 - DNA, 1214 bp, Streptococcus pneumoniae
  strain StrR-06
accaagaagctcaaaaacatctgtgggatatctacaactccgatcaatacgtctcttaccctgacgatgatttgcaagtcgcatctacggtcgtagatgtttcaaatggtaaagtcatcgcccaacttggagctcgtcaccaagcaagtaacgtttcatttggtaccaaccaagctgtggaaaccaatcgtgactggggttctgctatgaaaccaatcaccgattatgcacctgccatagaatacggtgtttatgattccactgcaactatggttaatgatattccttataactatccgggaacaagcacacctgtctacaactgggatagagcatatttcggtaatattactctgcaatatgctcttcaacaatcacgaaatgtcacagccgttgagactttgaataaggtcggtctagatagagctaaaaccttccttaatggtcttggtatcgactatccaagcatgcattatgcaaacgccatttcaagtaatacaacagaatctaataaacaatacggagcaagtagtgaaaaaatggctgctgcttatgctgcctttgcaaatggtggcacttactataaaccaatgtatatccataaagtcgtcttcagtgatggaagtaaaaaagagttctctaatgtcggaactcgtgccatgaaggaaacgacagcctatatgatgaccgacatgatgaaaacagtcttgacttatggaactgggcgtggagcctatcttccttggcttcctcaagctggtaaaacaggaacctctaactatacagatgaggaagttgaaaaccacatcaagaacactggctatgtagctccagatgaaatgtttgttggttatactcgtaagtattctatggctgtatggacaggttattcgaatcgtttaactcctatcgttggagatggtttcctagttgcagctaaagtttatcgctcaatgataacgtatctatcagaagatactcatccagaagactggacgatgccagacggacttttcagaaacggggaatttgtattcaaaaatggagctcgcccaatatggactgaaccctctactcaacaatcctcaacagctgaaagttcaagctcatcatcagatagttcaacttcacagtctagctcaaccactccaagcacaaataatagtacgactaccaatcctaacaataatacgcaacaatcaaatacaacccct

SEQ ID NO: 1010 - DNA, 1223 bp, Streptococcus pneumoniae
  strain StrR-07
ccaagaagctcaaaaacatctgtgggatatctacaactccgatcaatacgtctcttaccctgacgatgatttgcaagtcgcatctacggtcgtagatgtttcaaatggtaaagtcatcgcacaacttggtgctcgtcatcaagcaagtaatgtttcattcggtaccaaccaggccgtagaaaccaatcgtgactggggatcatcaatgaaaccaatcactgactatgctcccgctttagaatatggagtctatgactctactgcttctattgtacatgatgtcccttataactatcctggcactgatactccactctacaactgggatcatgtctactttggaaacattacaatccagtatgctcttcaacaatcacgaaatgtcacagccgttgagactttgaataaggtcggtctagatagagctaaaaccttccttaatggtcttggtatcgactatccaagcatgcattatgcaaacgccatttcaagtaacacaactgaatccaacaaaaaatatggtgcaagtagtgaaaaaatggctgctgcctacgctgcttttgctaatggtggtatttatcacaaaccaatgtatatcaataaaatcgtctttagtgatggtagcgaaaaagaattttctgatgctggtacacgagctatgaaagagactactgcctatatgatgactgaaatgatgaaaactgttttaacttacggaacaggacgtggagcctacctaccatggcttccacaagcaggtaagacaggtacttctaactatactgacgaagaaattgaaaagtatatcaagaacactggttacgtagctccagatgaaatgtttgtagggtatacccgtaaatatgcaatggctgtttggacaggatactcaaatcgtctaactccaatcatcggagatggtttccttgttgctggtaaagtctatcgttcaatgataacttacctttctgaagatgaccaacctggagattggacaatgccagatggcttgtatagaaatggagaattcgtatttaaaaatggtgctcgttctacgtggagctcacctgctccacaacaacccccatcaactgaaagttcaagctcatcatcagatagttcaacttcacagtctaactcaaccactccaagcacaaataatagtacgactaccaatcctaacaataatacgcaacaatcaaatacaacccctgatcaacaaa

SEQ ID NO: 1011 - DNA, 1207 bp, Streptococcus pneumoniae
  strain StrR-08
aagctcaaaaacatctgtgggatatctacaactccgatcaatacgtctcttaccctgacgatgatttgcaagtcgcatctacggtcgtagatgtttcaaatggtaaagtcatcgcccaacttggagctcgtcaccaagcaagtaacgtttcatttggtaccaaccaagctgtggaaaccaatcgtgactggggttctgctatgaaaccaatcaccgattatgcacctgccatagaatacggtgtttatgattccactgcaactatggttaatgatattccttataactatccgggaacaagcacacctgtctacaactgggatagagcatatttcggtaatattactctgcaatatgctcttcaacaatcacgaaatgtcacagccgttgagactttgaataaggtcggtctagatagagctaaaaccttccttaatggtcttggtatcgactatccaagcatgcattatgcaaacgccatttcaagtaatacaacagaatctaataaacaatacggagcaagtagtgaaaaaatggctgctgcttatgctgcctttgcaaatggtggcacttactataaaccaatgtatatccataaagtcgtcttcagtgatggaagtaaaaaagagttctctaatgtcggaactcgtgccatgaaggaaacgacagcctatatgatgaccgacatgatgaaaacagtcttgacttatggaactgggcgtggagcctatcttccttggcttcctcaagctggtaaaacaggaacctctaactatacagatgaggaagttgaaaaccacatcaagaacactggctatgtagctccagatgaaatgtttgttggttatactcgtaagtattctatggctgtatggacaggttattcgaatcgtttaactcctatcgttggagatggtttcctagttgcagctaaagtttatcgctcaatgataacgtatctatcagaagatactcatccagaagactggacgatgccagacggacttttcagaaacggggaatttgtattcaaaaatggagctcgcccaatatggactgaaccctctactcaacaatcctcaacagctgaaagttcaagctcatcatcagatagttcaacttcacagtctagctcaaccactccaagcacaaataatagtacgactaccaatcctaacaataatacgcaacaatcaaatacaacccc

SEQ ID NO: 1012 - DNA, 1201 bp, Streptococcus pneumoniae
  strain StrR-09
aagctcaaaaacatctgtgggatatctacaactccgatcaatacgtctcttaccctgacgatgatttgcaagtcgcatctacggtcgtagatgtttcaaatggtaaagtcatcgcccaacttggagctcgtcaccaagcaagtaacgtttcatttggtaccaaccaagctgtggaaaccaatcgtgactggggttctgctatgaaaccaatcaccgattatgcacctgccatagaatacggtgtttatgattccactgcaactatggttaatgatattccttataactatccgggaacaagcacacctgtctacaactgggatagagcatatttcggtaatattactctgcaatatgctcttcaacaatcacgaaatgtcacagccgttgagactttgaataaggtcggtctagatagagctaaaaccttccttaatggtcttggtatcgactatccaagcatgcattatgcaaacgccatttcaagtaatacaacagaatctaataaacaatacggagcaagtagtgaaaaaatggctgctgcttatgctgcctttgccaacggtggaatttaccacaaacccatgtatatcaataaggtcgtcttcagtgacggtagtaaaaaagaattttcagatgtaggtacacgagctatgaaagaaacaactgcttacatgatgaccgaaatgatgaaaactgtcttggcatacggaactggtcgtggagcctatctcccatggttagcgcaagctggtaagacaggtacttctaactacacagatgatgaaattgaaaaacacatcaagaacactggctatgtagctccagatgaaatgtttgttggttatactcgtaagtattctatggctgtatggacaggttattcgaatcgtttaactcctatcgttggagatggtttcctagttgcagctaaagtttatcgctcaatgataacgtatctatcagaagatactcatccagaagactggacgatgccagacggacttttcagaaacggggaatttgtattcaaaaatggagctcgttctacgtggaactcacctgctccacaacaacccccatcaactgaaagttcaagctcatcatcagatagttcaacttcacagtctagctcaaccactccaagcacaaataatagtacgactaccgatcctaacaataatacgcaacaatcaaatac

SEQ ID NO: 1013 - DNA, 1220 bp, Streptococcus pneumoniae
  strain StrR-10
tgtagaccaagaagctcaaaaacatctgtgggatatctacaactccgatcaatacgtctcttaccctgacgatgatttgcaagtcgcatctacggtcgtagatgtttcaaatggtaaagtcatcgcacaacttggtgctcgtcatcaagcaagtaatgtttcattcggtaccaaccaggccgtagaaaccaatcgtgactggggatcatcaatgaaaccaatcactgactatgctcccgctttagaatatggagtctatgactctactgcttctattgtacatgatgtcccttataactatcctggcactgatactccactctacaactgggatcatgtctactttggaaacattacaatccagtatgctcttcaacaatcacgaaatgtcacagccgttgagactttgaataaggtcggtctagatagagctaaaaccttccttaatggtcttggtatcgactatccaagcatgcattatgcaaacgccatttcaagtaacacaactgaatccaacaaaaaatatggtgcaagtagtgaaaaaatggctgctgcctacgctgcttttgctaatggtggtatttatcacaaaccaatgtatatcaataaaatcgtctttagtgatggtagcgaaaaagaattttctgatgctggtacacgagctatgaaagagactactgcctatatgatgactgaaatgatgaaaactgttttaacttacggaacaggacgtggagcctacctaccatggcttccacaagcaggtaagacaggtacttctaactatactgacgaagaaattgaaaagtatatcaagaacactggctacgtagctccagatgaaatgtttgtgggttatactcgtaagtattctatggctgtatggacaggttattcgaatcgtttaactcctatcgttggagatggtttcctagttgcagctaaagtttatcgctctatgatgacctacctgtctgaaggaagcaatccagaggattggaatataccagaggggctctacagaaatggagaattcgtatttaaaaatggtgctcgttctacgtggagctcacctgctccacaacaacccccatcaactgaaagttcaagctcatcatcagatagttcaacttcacagtctagctcaaccactccaagcacaaataatagtacgactaccaatcctaacaataatacgcaacaatcaaatacaacccctg

SEQ ID NO: 1014 - DNA, 1199 bp, Streptococcus pneumoniae
  strain StrR-11
caaaaacatctgtgggatatttacaatacagacgaatacgttgcctatccagacgatgaattgcaagtcgcttctaccattgttgatgtttctaacggtaaagtcattgcccagctaggagcacgccatcagtcaagtaatgtttccttcggaattaaccaagcagtagaaacaaaccgcgactggggatcaactatgaaaccgatcacagactatgctcctgccttggagtacggtgtctacgattcaactgctactatcgttcacgatgagccctataactaccctgggacaaatacccctgtttataactgggataggggctactttggcaacatcaccttgcaatacgccctgcaacaatcgcgaaacgtcccagccgtggaaactctaaacaaggtcggactcaaccgcgccaagactttcctaaatggtctcggaatcgactacccaagtattcactactcaaatgccatttcaagtaacacaaccgaatcagacaaaaaatatggagcaagtagtgaaaagatggctgctgcttacgctgcctttgcaaatggtggaacttactataaaccaatgtatatccataaagtcgtctttagtgatgggagtgaaaaagagttctctaatgtcggaactcgtgccatgaaggaaacgacagcctatatgatgaccgacatgatgaaaactgtcttagtatacggaatcggacgtggagcctacctaccttggcttccacaagcaggtaaaacaggtacttctaactatactgacgaagaaattgaaaagtatatcaagaacactggttacgtagctccagatgaaatgtttgtagggtatacccgcaaatatgcaatggctgtatggacaggctattctaaccgtctgacaccacttgtaggcgatggccttacggtcgctgctaaagtttaccgctctatgatgacctacctgtctgaaggaagcaatccagaggattggaatataccagaggggctctacagaaatggagaattcgtatttaaaaatggtgctcgttctacgtggaactcacctgctccacaacaacccccatcaactgaaagttcaagctcatcatcagatagttcaacttcacagtctagctcaaccactccaagcacaaataatagtacgactaccaatcctaacaataatacgcaacaatcaaatacaac

SEQ ID NO: 1015 - DNA, 1211 bp, Streptococcus pneumoniae
  strain StrR-12
aagctcaaaaacatctgtgggatatctacaactccgatcaatacgtctcttaccctgacgatgatttgcaagtcgcatctacggtcgtagatgtttcaaatggtaaagtcatcgcccaacttggagctcgtcaccaagcaagtaacgtttcatttggtaccaaccaagctgtggaaaccaatcgtgactggggttctgctatgaaaccaatcaccgattatgcacctgccatagaatacggtgtttatgattccactgcaactatggttaatgatattccttataactatccgggaacaagcacacctgtctacaactgggatagagcatatttcggtaatattactctgcaatatgctcttcaacaatcacgaaatgtcacagccgttgagactttgaataaggtcggtctagatagagctaaaaccttccttaatggtcttggtatcgactatccaagcatgcattatgcaaacgccatttcaagtaatacaacagaatctaataaacaatacggagcaagtagtgaaaaaatggctgctgcttatgctgcctttgccaacggtggaatttaccacaaacccatgtatatcaataaggtcgtcttcagtgacggtagtaaaaaagaattttcagatgtaggtacacgagctatgaaagaaacaactgcttacatgatgaccgaaatgatgaaaactgtcttggcatacggaactggtcgtggagcctatctcccatggttagcgcaagctggtaagacaggtacttctaactacacagatgatgaaattgaaaaacacatcaagaacactggctatgtagctccagatgaaatgtttgttggttatactcgtaagtattctatggctgtatggacaggttattcgaatcgtttaactcctatcgttggagatggtttcctagttgcagctaaagtttatcgctcaatgataacgtatctgtctgaaggaagcaatccagaggattggaatataccagaggggctctacagaaatggagaattcgtatttaaaaatggtgctcgttctacgtggagctcacctgctccacaacaacccccatcaactgaaagttcaagctcatcatcagatagttcaacttcacagtctaactcaaccactccaagcacaaataatagtacgactaccaatcctaacaataatacgcaacaatcaaatacaacccctgat

SEQ ID NO: 1016 - DNA, 1222 bp, Streptococcus pneumoniae
  strain StrR-13
gtagaccaagaagctcaaaaacatctgtgggatatctacaactccgatcaatacgtctcttaccctgacgatgatttgcaagtcgcatctacggtcgtagatgtttcaaatggtaaagtcatcgcacaacttggtgctcgtcatcaagcaagtaatgtttcattcggtaccaaccaggccgtagaaaccaatcgtgactggggatcatcaatgaaaccaatcactgactatgctcccgctttagaatatggagtctatgactctactgcttctattgtacatgatgtcccttataactatcctggcactgatactccactctacaactgggatcatgtctactttggaaacattacaatccagtatgctcttcaacaatcacgaaatgtcacagccgttgagactttgaataaggtcggtctagatagagctaaaaccttccttaatggtcttggtatcgactatccaagcatgcattatgcaaacgccatttcaagtaacacaactgaatccaacaaaaaatatggtgcaagtagtgaaaaaatggctgctgcctacgctgcttttgctaatggtggtatttatcacaaaccaatgtatatcaataaaatcgtctttagtgatggtagcgaaaaagaattttctgatgctggtacacgagctatgaaagagactactgcctatatgatgactgaaatgatgaaaactgttttaacttacggaacaggacgtggagcctacctaccatggcttccacaagcaggtaagacaggtacttctaactatactgacgaagaaattgaaaagtatatcaagaacactggctacgtagctccagatgaaatgtttgtgggttatactcgtaagtattctatggctgtatggacaggttattcgaatcgtttaactcctatcgttggagatggtttcctagttgcagctaaagtttatcgctctatgatgacctacctgtctgaaggaagcaatccagaggattggaatataccagaggggctctacagaaatggagaattcgtatttaaaaatggtgctcgttctacgtggagctcacctgctccacaacaacccccatcaactgaaagttcaagctcatcatcagatagttcaacttcacagtctagctcaaccactccaagcacaaataatagtacgactaccaatcctaacaataatacgcaacaatcaaatacaacccctgatc

SEQ ID NO: 1017 - DNA, 1229 bp, Streptococcus pneumoniae
  strain StrR-14
tgtagaccaagaagctcaaaaacatctgtgggatatttacaatacagacgaatacgttgcctatccagacgatgaattgcaagtcgcttctaccattgttgatgtttctaacggtaaagtcattgcccagctaggagcacgccatcagtcaagtaatgtttccttcggaattaaccaagcagtagaaacaaaccgcgactggggatcaactatgaaaccgatcacagactatgctcctgccttggagtacggtgtctacgattcaactgctactatcgttcacgatgagccctataactaccctgggacaaatacccctgtttataactgggataggggctactttggcaacatcaccttgcaatacgccctgcaacaatcgcgaaacgtcccagccgtggaaactctaaacaaggtcggactcaaccgcgccaagactttcctaaatggtctcggaatcgactacccaagtattcactactcaaatgccatttcaagtaacacaaccgaatcagacaaaaaatatggagcaagtagtgaaaagatggctgctgcttacgctgcctttgcaaatggtggaacttactataaaccaatgtatatccataaagtcgtctttagtgatgggagtgaaaaagagttctctaatgtcggaactcgtgccatgaaagaaacaactgcttacatgatgaccgaaatgatgaaaactgtcctggcatacggaagtggtcgtggagcctatctcccatggttagcgcaagctggtaagacaggtacttctaactacacagatgatgaaattgaaaaacacatcaagaacactggctatgtagctccagatgaaatgtttgttggttatactcgtaagtattctatggctgtatggacaggttattcgaatcgtttaactcctatcgttggagatggtttcctagttgcagctaaagtttatcgctcaatgataacgtatctatcaaaagatactcatccagaagactggacgatgccagacggacttttcagaaacggggaatttgtattcaaaaatggagctcgttctacgtggaactcacctgctccacaacaacccccatcaactgaaagttcaagctcatcatcagatagttcaacttcacagtctaactcaaccactccaagcacaaataatagtacgactaccaatcctaacaataatacgcaacaatcaaatacaacccctgatcaacaaa

SEQ ID NO: 1018 - DNA, 1225 bp, Streptococcus pneumoniae
  strain StrR-15
atgtagaccaagaggctcaaaaacgtctgtgggatatctacaactccgatcaatacgtctcttaccctgacgatgatttgcaagtcgcatctacggtcgtagatgtttcaaatggtaaagtcatcgcccaacttggagctcgtcaccaagcaagtaacgtttcatttggtaccaaccaagctgtggaaaccaaccgtgactggggatcaagcatgaaaccaatcactgattatgccccagccttagaatatggtgtatatgattccactgcaactatggttaatgatattccttataactatccgggcacaagcacacctgtctacaactgggatcgagcatattttggtaatattagcctgcaatatgcccttcaacaatctcgtaacgtgcctgccgttgaaacactaaacaaggttggtttagatagagccaaaactttcctaaatggtttgggaattgactatccaagtattcactactcaaatgctatttcaagtaatacaactgaatctagtaaacagtacggggcaagcagtgagaaaatggctgcggcttacgctgcattcgctaatggcggtatttaccacaaaccaatgtacatcaataaagttgtctttagtgatggtagcgaaaaagaattttctgatgctggtacacgagctatgaaagagactactgcctatatgatgactgaaatgatgaaaactgttttaacttacggaacaggacgtggagcctacctaccatggcttccacaagcaggtaagacaggtacttctaactatactgacgacgaaattgaaaagtatatcaagaacactggctacgtagctccagatgaaatgtttgtgggttatactcgtaagtattctatggctgtatggactggatactcaaatcgtttaactccaatcattggagatggtttcctagttgctgccaaagtttatcgctcaatgatatcgtatctatcagaagatgaccatcctggagattggacaatgcctgagggagtatacagaagtggagaattcgtatttaaaaatggtgctcgttctacgtggagctcccctgctccacaacaacccccatcaactgaaagttcaagctcatcatcagatagttcaacttcacagtctagcttaaccactccaagcacaaataatagtacgactaccaatcctaacaacaatacgcaacaatcaaatacaacccctgatca

SEQ ID NO: 1019 - DNA, 1439 bp, Streptococcus pneumoniae
  strain StrR-01
gcctctatttcaaaggagatgcctggcattagtatttctacttcttgggatcgaaaggttttggaaacttccctttcttctatagtagggagtgtatccagtgaaaaagctggtctcccagcggaagaagcagaatcctatcttaaaaaaggctattctctaaatgaccgtgttggaacctcctatttggaaaagcaatatgaagagaccttacaaggaaaacgctcggtaaaagaaatccatctggataaatatggcaatatggaaagcgtggacacaattgaggaaggtagtaagggaaacaatatcaaactgaccattgatttggccttccaagatagcgtggatgctttgctgaaaagttatttcaattccgagctaggaaatggtggagctaaatattctgaaggtgtctatgcagtcgcccttaacccaaaaacaggtgctgttttatccatgtcagggatcaaacatgacctgaaaacgggagagttgactcctgattccttgggaacggtaaccaatgtctttgtcccaggttcggttgtcaaggctgcgaccatcagctcaggttgggaaaatggtgttttatcaggaaaccaaaccttaacagatcagcctattgttttccaaggttcagctccaatttattcttggtataaattggcatatggatcttttcctattacagctgtggaagccttggagtattcatccaatgcttacatggttcaaaccgctcttggaatcatgggccagacctatcaaccaaatatgtttgttggaaccagcaatttggaaacagctatgggaaaacttcgtgcgacctttggcgaatatggcttgggggctgcgaccggaattgacctaccagatgaatctactggatttgttcccaaagagtatagctttgctaattacatcaccaattcctttgggcagtttgataactatacgcccatgcagttggctcagtatgtagcaactattgcaaataatggtgttcgtgtggctcctcgtattgttgaaggcatttatggtaataatgataagggaggactgggtgacttgattcagcaactgcaaccgacagagatgaataaggtcaatatatccgactccgatatgagcatcttgcaccaaggtttttatcaggttgcccatggtactagtggattgacaactggacgtgccttttcaaatggtgccttggtatccattagcggaaaaacaggtacagccgaaagctatgtggcagatggtcagcaagcaaccaataccaatgcggtggcctatgccccatctgataatccccaaatcgctgtcgcagtggtctttcctcataataccaatctaacaaatggtgtaggaccttccattgcgcgtgacattatcaatctgtatcaaaaataccatccaatgaactagaaaggaaatta

SEQ ID NO: 1020 - DNA, 1441 bp, Streptococcus pneumoniae
  strain StrR-02
gcctctatttcaaaggagatgcctggcattagtatttctacttcttgggatcgaaaggttttggaaacttccctttcttctatagtagggagtgtatccagtgaaaaagctggtctcccagcggaagaagcagaatcctatcttaaaaaaggctattctctaaatgaccgtgttggaacctcctatttggaaaagcaatatgaagagaccttacaaggaaaacgctcggtaaaagaaatccatctggataaatatggcaatatggaaagcgtggacacaattgaggaaggtagtaagggaaacaatatcaaactgaccattgatttggccttccaagatagcgtggatgctttgctgaaaagttatttcaattccgagctaggaaatggtggagctaaatattctgaaggtgtctatgcagtcgcccttaacccaaaaacaggtgctgttttatccatgtcagggatcaaacatgacctgaaaacgggagagttgactcctgattccttgggaacggtaaccaatgtctttgtcccaggttcggttgtcaaggctgcgaccatcagctcaggttgggaaaatggtgttttatcaggaaaccaaaccttaacagatcagcctattgttttccaaggttcagctccaatttattcttggtataaattggcatatggatcttttcctattacagctgtggaagccttggagtattcatccaatgcttacatggttcaaaccgctcttggaatcatgggccagacctatcaaccaaatatgtttgttggaaccagcaatttggaaacagctatgggaaaacttcgtgcgacctttggcgaatatggcttgggggctgcgaccggaattgacctaccagatgaatctactggatttgttcccaaagagtatagctttgctaattacatcaccaattcctttgggcagtttgataactatacgcccatgcagttggctcagtatgtagcaactattgcaaataatggtgttcgtgtggctcctcgtattgttgaaggcatttatggtaataatgataagggaggactgggtgacttgattcagcaactgcaaccgacagagatgaataaggtcaatatatccgactccgatatgagcatcttgcaccaaggtttttatcaggttgcccatggtactagtggattgacaactggacgtgccttttcaaatggtgccttggtatccattagcggaaaaacaggtacagccgaaagctatgtggcagatggtcagcaagcaaccaataccaatgcggtggcctatgccccatctgataatccccaaatcgctgtcgcagtggtctttcctcataataccaatctaacaaatggtgtaggaccttccattgcgcgtgacattatcaatctgtatcaaaaataccatccaatgaactagaaaggaaattatg

SEQ ID NO: 1021 - DNA, 1396 bp, Streptococcus pneumoniae
  strain StrR-03
tattgcctctatttcaaaggagatgcctggcattagtatttctacttcttgggatcgaaaggttttggaaacttccctttcttctatagtagggagtgtatccagtgaaaaagctggtctcccagcggaagaagcagaatcctatcttaaaaaaggctattctctaaatgaccgtgttggaacctcctatttggaaaagcaatatgaagagaccttacaaggaaaacgctcggtaaaagaaatccatctggataaatatggcaatatggaaagcgtggacacaattgaggaaggtagtaagggaaacaatatcaaactgaccattgatttggccttccaagatagcgtggatgctttgctgaaaagttatttcaattccgagctaggaaatggtggagctaaatattctgaaggtgtctatgcagtcgcccttaacccaaaaacaggtgctgttttatccatgtcagggatcaaacatgacctgaaaacgggagagttgactcctgattccttgggaacggtaaccaatgtctttgtcccaggttcggttgtcaaggctgcgaccatcagctcaggttgggaaaatggtgttttatcaggaaaccaaaccttaacagatcagcctattgttttccaaggttcagctccaatttattcttggtataaattggcatatggatcttttcctattacagctgtggaagccttggagtattcatccaatgcttacatggttcaaaccgctcttggaatcatgggccagacctatcaaccaaatatgtttgttggaaccagcaatttggaaacagctatgggaaaacttcgtgcgacctttggcgaatatggcttgggggctgcgaccggaattgacctaccagatgaatctactggatttgttcccaaagagtatagctttgctaattacatcaccaattcctttgggcagtttgataactatacgcccatgcagttggctcagtatgtagcaactattgcaaataatggtgttcgtgtggctcctcgtattgttgaaggcatttatggtaataatgataagggaggactgggtgacttgattcagcaactgcaaccgacagagatgaataaggtcaatatatccgactccgatatgagcatcttgcaccaaggtttttatcaggttgcccatggtactagtggattgacaactggacgtgccttttcaaatggtgccttggtatccattagcggaaaaacaggtacagccgaaagctatgtggcagatggtcagcaagcaaccaataccaatgcggtggcctatgccccatctgataatccccaaatcgctgtcgcagtggtctttcctcataataccaatctaacaaatggtgtaggaccttccattgcgcgtgacatt

SEQ ID NO: 1022 - DNA, 1428 bp, Streptococcus pneumoniae
  strain StrR-04
aaaggagatgcctggcattagtatttctacttcttgggatcgaaaggttttggaaacttccctttcttctatagtagggagtgtatccagtgaaaaagctggtctcccagcggaagaagcagaatcctatcttaaaaaaggctattctctaaatgaccgtgttggaacctcctatttggaaaagcaatatgaagagaccttacaaggaaaacgctcggtaaaagaaatccatctggataaatatggcaatatggaaagcgtggacacaattgaggaaggtagtaagggaaacaatatcaaactgaccattgatttggccttccaagatagcgtggatgctttgctgaaaagttatttcaattccgagctaggaaatggtggagctaaatattctgaaggtgtctatgcagtcgcccttaacccaaaaacaggtgctgttttatccatgtcagggatcaaacatgacctgaaaacgggagagttgactcctgattccttgggaacggtaaccaatgtctttgtcccaggttcggttgtcaaggctgcgaccatcagctcaggttgggaaaatggtgttttatcaggaaaccaaaccttaacagatcagcctattgttttccaaggttcagctccaatttattcttggtataaattggcatatggatcttttcctattacagctgtggaagccttggagtattcatccaatgcttacatggttcaaaccgctcttggaatcatgggccagacctatcaaccaaatatgtttgttggaaccagcaatttggaaacagctatgggaaaacttcgtgcgacctttggcgaatatggcttgggggctgcgaccggaattgacctaccagatgaatctactggatttgttcccaaagagtatagctttgctaattacatcaccaattcctttgggcagtttgataactatacgcccatgcagttggctcagtatgtagcaactattgcaaataatggtgttcgtgtggctcctcgtattgttgaaggcatttatggtaataatgataagggaggactgggtgacttgattcagcaactgcaaccgacagagatgaataaggtcaatatatccgactccgatatgagcatcttgcaccaaggtttttatcaggttgcccatggtactagtggattgacaactggacgtgccttttcaaatggtgccttggtatccattagcggaaaaacaggtacagccgaaagctatgtggcagatggtcagcaagcaaccaataccaatgcggtggcctatgccccatctgataatccccaaatcgctgtcgcagtggtctttcctcataataccaatctaacaaatggtgtaggaccttccattgcgcgtgacattatcaatctgtatcaaaaataccatccaatgaactagaaaggaaatta

SEQ ID NO: 1023 - DNA, 1442 bp, Streptococcus pneumoniae
  strain StrR-05
tgcctctatttcaaaggagatgcctggcattagtatttctacttcttgggatcgaaaggttttggaaacttccctttcttctatagtagggagtgtatccagtgaaaaagctggtctcccagcggaagaagcagaatcctatcttaaaaaaggctattctctaaatgaccgtgttggaacctcctatttggaaaagcaatatgaagagaccttacaaggaaaacgctcggtaaaagaaatccatctggataaatatggcaatatggaaagcgtggacacaattgaggaaggtagtaagggaaacaatatcaaactgaccattgatttggccttccaagatagcgtggatgctttgctgaaaagttatttcaattccgagctaggaaatggtggagctaaatattctgaaggtgtctatgcagtcgcccttaacccaaaaacaggtgctgttttatccatgtcagggatcaaacatgacctgaaaacgggagagttgactcctgattccttgggaacggtaaccaatgtctttgtcccaggttcggttgtcaaggctgcgaccatcagctcaggttgggaaaatggtgttttatcaggaaaccaaaccttaacagatcagcctattgttttccaaggttcagctccaatttattcttggtataaattggcatatggatcttttcctattacagctgtggaagccttggagtattcatccaatgcttacatggttcaaaccgctcttggaatcatgggccagacctatcaaccaaatatgtttgttggaaccagcaatttggaaacagctatgggaaaacttcgtgcgacctttggcgaatatggcttgggggctgcgaccggaattgacctaccagatgaatctactggatttgttcccaaagagtatagctttgctaattacatcaccaattcctttgggcagtttgataactatacgcccatgcagttggctcagtatgtagcaactattgcaaataatggtgttcgtgtggctcctcgtattgttgaaggcatttatggtaataatgataagggaggactgggtgacttgattcagcaactgcaaccgacagagatgaataaggtcaatatatccgactccgatatgagcatcttgcaccaaggtttttatcaggttgcccatggtactagtggattgacaactggacgtgccttttcaaatggtgccttggtatccattagcggaaaaacaggtacagccgaaagctatgtggcagatggtcagcaagcaaccaataccaatgcggtggcctatgccccatctgataatccccaaatcgctgtcgcagtggtctttcctcataataccaatctaacaaatggtgtaggaccttccattgcgcgtgacattatcaatctgtatcaaaaataccatccaatgaactagaaaggaaattatg

SEQ ID NO: 1024 - DNA, 1445 bp, Streptococcus pneumoniae
  strain StrR-06
ttgcctctatttcaaaggagatgcctggcattagtatttctacttcttgggatcgaaaggttttggaaacttccctttcttctatagtagggagtgtatccagtgaaaaagctggtctcccagcggaagaagcagaatcctatcttaaaaaaggctattctctaaatgaccgtgttggaacctcctatttggaaaagcaatatgaagagaccttacaaggaaaacgctcggtaaaagaaatccatctggataaatatggcaatatggaaagcgtggacacaattgaggaaggtagtaagggaaacaatatcaaactgaccattgatttggccttccaagatagcgtggatgctttgctgaaaagttatttcaattccgagctaggaaatggtggagctaaatattctgaaggtgtctatgcagtcgcccttaacccaaaaacaggtgctgttttatccatgtcagggatcaaacatgacctgaaaacgggagagttgactcctgattccttgggaacggtaaccaatgtctttgtcccaggttcggttgtcaaggctgcgaccatcagctcaggttgggaaaatggtgttttatcaggaaaccaaaccttaacagatcagcctattgttttccaaggttcagctccaatttattcttggtataaattggcatatggatcttttcctattacagctgtggaagccttggagtattcatccaatgcttacatggttcaaaccgctcttggaatcatgggccagacctatcaaccaaatatgtttgttggaaccagcaatttggaaacagctatgggaaaacttcgtgcgacctttggcgaatatggcttgggggctgcgaccggaattgacctaccagatgaatctactggatttgttcccaaagagtatagctttgctaattacatcaccaattcctttgggcagtttgataactatacacccatgcagttggctcagtatgtagcaactattgcaaataatggtgttcgtgtggctcctcgtattgttgaaggcatttatggtaataatgataagggaggactgggtgacttgattcagcaactgcaaccgacagagatgaataaggtcaatatatccgactccgatatgagcatcttgcaccaaggtttttatcaggttgcccatggtactagtggattgacaactggacgtgccttttcaaatggtgccttggtatccattagcggaaaaacaggtacagccgaaagctatgtggcagatggtcagcaagcaaccaataccaatgcggtggcctatgccccatctgataatccccaaatcgctgtcgcagtggtctttcctcataataccaatctaacaaatggtgtaggaccttccattgcgcgtgacattatcaatctgtatcaaaaataccatccaatgaactagaaaggaaattatgct

SEQ ID NO: 1025 - DNA, 1441 bp, Streptococcus pneumoniae
  strain StrR-07
ttgcctctatttcaaaggagatgcctggcattagtatttctacttcttgggatcgaaagattttggaaacttccctttcttctatagtagggagtgtatccagtgaaaaagctggtctcccagcggaagaagcagaatcctatcttaaaaaaggctattctctaaatgaccgtgttggaacctcgtatttggaaaagcaatatgaagagaccttacaaggaaaacgctcggtaaaagaaatccatctggataaatatggcaatatggaaagcgtggacacaattgaggaaggtagtaagggaaacaatatcaaactgaccattgatttggccttccaagatagcgtggatgctttgctgaaaagttatttcaattccgagctaggaaatggtggagccaagtattctgagggtgtgtatgcagtcgcccttaaccccaaaacaggtgctgttttgtctatgtcaggactcaaacatgacctgaaaacgggagagttgactcctgattccttgggaacggtaaccaatgtctttgtcccaggttcggttgtcaaggctgcgaccatcagctctggctgggaaaatggtgttttatcaggaaaccaaaccttaacagatcagcctattgttttccaaggttcagctccaatttattcttggtataaattggcatatggatcttttcctattacagctgtggaagccttggagtattcatccaatgcttacatggttcaaaccgctcttggaatcatgggccagacctatcaaccaaatatgtttgttggaaccagcaatttggaaacagctatgggaaaacttcgtgcgacctttggcgaatatggcttgggggctgcgaccggaattgacctaccagatgaatctactggatttgttcccaaagactatagctttgctaattacatcaccaatgcctttgggcagtttgataactatacgcccatgcagttggctcagtatgtagcaactattgcaaatgatggtgttcgtgtggctcctcgtattgttgaaggcatttatggtaataatgataagggaggactgggtgacttgattcagcaactgcaaccgacagagatgaataaggtcaatatatccgactccgatatgagtatcttgcaccaaggattttaccaagtatcgcatggaactagtccccttacgacaggacgggcgttttcagatggcgccactgtttctatcagtggtaagaccggtacaggtgaaagctatgtagctggtggtcaagaagctaataataccaatgccgtggcctatgctccaacagaaaatcctcaaattgcagttgcagtagtctttcctcataataccaatttaaccaaaaatgttgggccagcaattgctcgcgacattatcaatttatataaccaacaccatccaatgaattagaaaggaagcca

SEQ ID NO: 1026 - DNA, 1443 bp, Streptococcus pneumoniae
  strain StrR-08
tattgcctctatttcaaaggagatgcctggcattagtatttctacttcttgggatcgaaaggttttggaaacttccctttcttctatagtagggagtgtatccagtgaaaaagctggtctcccagcggaagaagcagaatcctatcttaaaaaaggctattctctaaatgaccgtgttggaacctcctatttggaaaagcaatatgaagagaccttacaaggaaaacgctcggtaaaagaaatccatctggataaatatggcaatatggaaagcgtggacacaattgaggaaggtagtaagggaaacaatatcaaactgaccattgatttggccttccaagatagcgtggatgctttgctgaaaagttatttcaattccgagctaggaaatggtggagctaaatattctgaaggtgtctatgcagtcgcccttaacccaaaaacaggtgctgttttatccatgtcagggatcaaacatgacctgaaaacgggagagttgactcctgattccttgggaacggtaaccaatgtctttgtcccaggttcggttgtcaaggctgcgaccatcagctcaggttgggaaaatggtgttttatcaggaaaccaaaccttaacagatcagcctattgttttccaaggttcagctccaatttattcttggtataaattggcatatggatcttttcctattacagctgtggaagccttggagtattcatccaatgcttacatggttcaaaccgctcttggaatcatgggccagacctatcaaccaaatatgtttgttggaaccagcaatttggaaacagctatgggaaaacttcgtgcgacctttggcgaatatggcttgggggctgcgaccggaattgacctaccagatgaatctactggatttgttcccaaagagtatagctttgctaattacatcaccaattcctttgggcagtttgataactatacgcccatgcagttggctcagtatgtagcaactattgcaaataatggtgttcgtgtggctcctcgtattgttgaaggcatttatggtaataatgataagggaggactgggtgacttgattcagcaactgcaaccgacagagatgaataaggtcaatatatccgactccgatatgagcatcttgcaccaaggtttttatcaggttgcccatggtactagtggattgacaactggacgtgccttttcaaatggtgccttggtatccattagcggaaaaacaggtacagccgaaagctatgtggcagatggtcagcaagcaaccaataccaatgcggtggcctatgccccatctgataatccccaaatcgctgtcgcagtggtctttcctcataataccaatctaacaaatggtgtaggaccttccattgcgcgtgacattatcaatctgtatcaaaaataccatccaatgaactagaaaggaaatta

SEQ ID NO: 1027 - DNA, 1443 bp, Streptococcus pneumoniae
  strain StrR-09
tattgcctctatttcaaaggagatgcctggcattagtatttctacttcttgggatagaaaggttttggaaacttccctttcttctatagttgggagtgtatccagtgaaaaagctggtctcccagcggaagaagcagaagcctatcttaaaaaaggctattctctaaatgatcgtgtaggaacctcctatttggaaaagcaatatgaagagaccttacaaggaaaacgctcggtaaaagaaatccatctggataaatatggcaatatggaaagcgtggatacaattgaggaaggtagtaagggaaacaatatcaaactgaccattgatttggctttccaagatagcgtggatgctttactgaaaagttatttcaattccgagctagaaaatggtggagccaagtattctgaaggtgtctatgcagtcgcccttaacccaaaaacaggtgctgttttgtctatgtcagggattaaacatgacttgaaaacgggagatttaacacctgattccttgggaacagtaaccaatgtctttgtcccgggttctgttgtcaaggcggcgaccatcagctctggttgggagaatggagtcttatcaggaaatcagaccttgacagaccaaccgattgtcttccaaggttcagctccgattaattcttggtacactcaggcttacgattcatttccgattacagcggtggaagccttggagtattcttctaatgcctatatggtccaaacagctctaggtcttatggggcagacctaccaacccaatatgtttgtcggcaccagcaatctagagtctgctatggggaaattgcgttcaacctttggtgaatatggcttgggctctgcgactgggattgacctaccagatgaatctactggatttgttcccaaagagtatagctttgctaattacattactaatgcctttgggcagtttgataactatacgccgatgcagttggctcagtatgtagcaactattgcaaatgatggtgttcgtgtggctcctcgtattgtggaaggcatttatggcaataatgataagggaggactgggtgacttgattcagcaactgcaaccgacagagatgaataaggtcaatatatccgactccgatatgagtatcttgcaccaaggtttttatcaggttgctcatgggactagcggattgacaacaggtcgtgccttttccaatggtgcagctgtatccattagtggaaaaacaggtaccgccgaaagttatgtagcaggtggccaagaagccaacaatactaatgctgtagcctatgcaccatcagataatcctcaaatagctgttgctgttgtcttccctcataacaccaatctaacaaatggtgtaggaccttccattgcgcgtgatattatcaatctgtatcaaaaataccatccaatgaactagaaaggaattta

SEQ ID NO: 1028 - DNA, 1446 bp, Streptococcus pneumoniae
  strain StrR-10
tattgcctctatttcaaaggagatgcctggcattagtatttctacctcttgggatagaaaggttttggaaacttctctttcttctatagtagggagtgtatccagtgaaaaagctggtctcccagcggaagaagcagaagcctatcttaaaaaaggctattctctaaatgaccgtgttgggacttcttacctggaaaaacaatacgaggaaaccttacaaggaaaacgctcggtaaaagaaatccatctggataaatatggcaatatggaaagcgtggatacaattgaggaaggtagtaagggaaacaatatcaaactgaccattgatttggccttccaagatagcgtggatgctttgctgaaaagttatttcaattccgagctaggaaatggtggagctaagtattctgaaggcgtgtatgcagtcgcccttaaccccaaaacaggtgctgttttgtctatgtcaggactcaaacatgacctgaaaacgggagacttgacgcctgattccttgggaacggtaaccaatgtctttgtcccagggtcagtagttaaggccgctaccatcagctcaggttgggaaaatggtgttttatcaggaaaccaaaccttaacagatcagcctattgttttccaaggttcagctccaatttattcttggtataaattggcatatggatcttttcctattacagctgtggaagccttggagtattcatctaatgcttacatggttcaaaccgctcttggaatcatgggccagacctatcaaccaaatatgtttgttggaaccagcaatttggaaacagctatgggaaaacttcgtgcgacctttggcgaatatggcttgggggctgcgaccggaattgacctaccagatgaatctactggatttgttcccaaagagtatagctttgctaattacattactaatgcctttgggcagtttgataactatacgccgatgcagttggctcagtatgtagcaactattgcaaatgatggtgttcgtgtggctcctcgtattgttgaaggcatttatggtaataatgataagggaggactgggtgacttgattcagcaactgcaaccgacagagatgaataaggtcaatatatccgactccgatatgagcatcttgcaccaaggtttttatcaggttgcccatggtactagtggattgacaactggacgtgccttttcaaatggcgccttggtatccattagcggaaaaacaggtacagccgaaagctatgtggcagatggtcagcaagcaaccaataccaatgcggtggcctatgccccatctgataatccccaaatcgctgttgcagtggtctttcctcataataccaatctaacaaatggtgtaggaccttccattgcgcgtgacattatcaatctgtatcaaaaataccatccaatgaactagaaaggaaattatgc

SEQ ID NO: 1029 - DNA, 1423 bp, Streptococcus pneumoniae
  strain StrR-11
ttgcctctatttcaaaggagatgcctggcattagtatttctacttcttgggatagaaaggttttggaaacttccctttcttctatagttgggagtgtatccagtgaaaaagctggtctcccagcggaagaagcagaagcctatcttaaaaaaggctattctctaaatgaccgtgtaggaacctcctatttggaaaagcaatatgaagagaccttacaaggaaaacgctcggtaaaagaaatccatctggataaatatggcaatatggaaagcgtggatacaattgaggaaggtagtaagggaaacaatatcaaactgaccattgatttggccttccaagatagcgtggatgctttactgaaaagttatttcaattctgagctagaaaatggtggagccaagtattctgaaggtgtctatgcagtcgcccttaacccaaaaacaggtgcggttttgtctatgtcagggattaaacatgacttgaaaacgggagagttgacgcctgattccttgggaacggtaaccaatgtctttgttccaggttcggttgtcaaggcggcgaccatcagctcaggttgggaaaatggagtcttgtcaggaaaccagaccttgacagaccagtccattgtcttccaaggttcagctcccatcaattcttggtatactcaggcttacggttcattccctatcacagcggtccaagctctggagtattcatccaatgcttatatggtccaaacagccttaggtcttatggggcagacctatcaacccaatatgtttgtcggcaccagcaatctagagtctgctatgggtaaattgcgttcaacctttggcgaatatggcttgggggctgcgactgggattgatctaccagatgaatctactggatttgttcccaaagactataactttgccaatttcattaccaatgcctttgggcagtttgataactataccccaatgcaattggctcagtatgtagcaactattgcaaatgatggtgttcgtgtggctcctcgtattgttgaaggcatttatggtaataatgataagggaggactgggtgacttgattcagcaactgcaaccgacagagatgaataaggtcaatatatccgactccgatatgagtgtcttgcaccaaggtttttatcaggttgctcatgggactagtgggttgacaactggccgtgccttttcaaatggtgccttggtatccattagcggaaaaacgggtacagccgaaagctatgtggcagatggtcaggaagcaaccaataccaatgcggtggcctatgccccatctgataatccccaaatcgctgtcgcagtggtctttcctcataataccaatctaacaaatggtgtaggaccttccattgcgcgtgacattatcaatctgtatcaaaaataccatccaat

SEQ ID NO: 1030 - DNA, 1447 bp, Streptococcus pneumoniae
  strain StrR-12
tattgcctctatttcaaaggagatgcctggcattagtatttctacttcttgggatcgaaaggttttggaaacttccctttcttctatagtagggagtgtatccagtgaaaaagctggtctcccagcggaagaagcagaatcctatcttaaaaaaggctattctctaaatgaccgtgttggaacctcctatttggaaaagcaatatgaagagaccttacaaggaaaacgctcggtaaaagaaatccatctggataaatatggcaatatggaaagcgtggacacaattgaggaaggtagtaagggaaacaatatcaaactgaccattgatttggccttccaagatagcgtggatgctttgctgaaaagttatttcaattccgagctaggaaatggtggagctaaatattctgaaggtgtctatgcagtcgcccttaacccaaaaacaggtgctgttttatccatgtcagggatcaaacatgacctgaaaacgggagagttgactcctgattccttgggaacggtaaccaatgtctttgtcccaggttcggttgtcaaggctgcgaccatcagctcaggttgggaaaatggtgttttatcaggaaaccaaaccttaacagatcagcctattgttttccaaggttcagctccaatttattcttggtataaattggcatatggatcttttcctattacagctgtggaagccttggagtattcatccaatgcttacatggttcaaaccgctcttggaatcatgggccagacctatcaaccaaatatgtttgttggaaccagcaatttggaaacagctatgggaaaacttcgtgcgacctttggcgaatatggcttgggggctgcgaccggaattgacctaccagatgaatctactggatttgttcccaaagagtatagctttgctaattacatcaccaattcctttgggcagtttgataactatacgcccatgcagttggctcagtatgtagcaactattgcaaataatggtgttcgtgtggctcctcgtattgttgaaggcatttatggtaataatgataagggaggactgggtgacttgattcagcaactgcaaccgacagagatgaataaggtcaatatatccgactccgatatgagcatcttgcaccaaggtttttatcaggttgcccatggtactagtggattgacaactggacgtgccttttcaaatggtgccttggtatccattagcggaaaaacaggtacagccgaaagctatgtggcagatggtcagcaagcaaccaataccaatgcggtggcctatgccccatctgataatccccaaatcgctgtcgcagtggtctttcctcataataccaatctaacaaatggtgtaggaccttccattgcgcgtgacattatcaatctgtatcaaaaataccatccaatgaactagaaaggaaattatgct

SEQ ID NO: 1031 - DNA, 1446 bp, Streptococcus pneumoniae
  strain StrR-13
attgcctctatttcaaaggagatgcctggcattagtatttctacctcttgggatagaaaggttttggaaacttctctttcttctatagtagggagtgtatccagtgaaaaagctggtctcccagcggaagaagcagaagcctatcttaaaaaaggctattctctaaatgaccgtgttgggacttcttacctggaaaaacaatacgaggaaaccttacaaggaaaacgctcggtaaaagaaatccatctggataaatatggcaatatggaaagcgtggatacaattgaggaaggtagtaagggaaacaatatcaaactgaccattgatttggccttccaagatagcgtggatgctttgctgaaaagttatttcaattccgagctaggaaatggtggagctaagtattctgaaggcgtgtatgcagtcgcccttaaccccaaaacaggtgctgttttgtctatgtcaggactcaaacatgacctgaaaacgggagacttgacgcctgattccttgggaacggtaaccaatgtctttgtcccagggtcagtagttaaggccgctaccatcagctcaggttgggaaaatggtgttttatcaggaaaccaaaccttaacagatcagcctattgttttccaaggttcagctccaatttattcttggtataaattggcatatggatcttttcctattacagctgtggaagccttggagtattcatctaatgcttacatggttcaaaccgctcttggaatcatgggccagacctatcaaccaaatatgtttgttggaaccagcaatttggaaacagctatgggaaaacttcgtgcgacctttggcgaatatggcttgggggctgcgaccggaattgacctaccagatgaatctactggatttgttcccaaagagtatagctttgctaattacattactaatgcctttgggcagtttgataactatacgccgatgcagttggctcagtatgtagcaactattgcaaatgatggtgttcgtgtggctcctcgtattgttgaaggcatttatggtaataatgataagggaggactgggtgacttgattcagcaactgcaaccgacagagatgaataaggtcaatatatccgactccgatatgagcatcttgcaccaaggtttttatcaggttgcccatggtactagtggattgacaactggacgtgccttttcaaatggcgccttggtatccattagcggaaaaacaggtacagccgaaagctatgtggcagatggtcagcaagcaaccaataccaatgcggtggcctatgccccatctgataatccccaaatcgctgttgcagtggtctttcctcataataccaatctaacaaatggtgtaggaccttccattgcgcgtgacattatcaatctgtatcaaaaataccatccaatgaactagaaaggaaattatgct

SEQ ID NO: 1032 - DNA, 1446 bp, Streptococcus pneumoniae
  strain StrR-14
attgcctctatttcaaaggagatgcctggcattagtatttctacttcttgggatagaaaggttttggaaacttccctttcttctatagttgggagtgtatccagtgaaaaagctggtctcccagcggaagaagcagaagcctatcttaaaaaaggctattctctaaatgatcgtgttggaacctcctatttggaaaagcaatatgaagagaccttacaagggaaacgctcggtaaaagaaatccatctggataaatatggcaatatggaaagtgtggatacaattgaggaaggtagtaagggaaacaatatcaagctgaccattgatttggccttccaagatagcgtggatgctttgctgaaaagttatttcaattccgagctaggaaatggtggagccaagtattctgagggtgtgtatgcagtcgcccttaaccccaaaacaggtgctgttttgtctatgtcaggactcaaacatgacctgaaaacgggagagttgactcctgattccttgggaacggtaaccaatgtctttgtcccaggttcggttgtcaaggctgcgaccatcagctctggctgggaaaatggagtcttatcaggaaaccagaccttgacagaccagtccattgtctttcaaggttcagctcccatcaattcttggtatactcaggcttacggttcattccctatcacagcagtccaagctctggagtattcatctaatgcctatatggtccaaacagctttaggtcttatggggcagacctaccaacctaatatgtttgtcggcaccagcaacctagagtctgctatggggaaattgcgttcaacctttggtgaatatggtttgggttctgcgaccgggattgacctaccagatgaatctactggatttgttcccaaagactatagctttgctaattacatcaccaatgcctttgggcagtttgataactatacgccgatgcagttggctcagtatgtagcaactattgcaaatgatggtgttcgtgtggctcctcgtattgttgaaggcatttatggaaataatgataagggaggcctaggcgacttgattcagcaactgcaaccgacagagatgaataaggtcaatatatccgactctgatatgagtattttgcaccaaggtttttatcaggttgctcatgggactagtggattgacaactggacgtgccttttcaaatggcgcagcggtatccattagtggaaaaacaggtactgccgaaagttatgttgagggtggtcaagaagctaacaatactaatgctgtggcctatgcaccatcagataatcctcaaatcgctgtagctgttgtcttccctcataacaccaaccttacaaatggtgtcggaccttccattgcgcgcgatattatcaacctctataaccaacatcatccaatgaattagaaaggaacatatgct

SEQ ID NO: 1033 - DNA, 1446 bp, Streptococcus pneumoniae
  strain StrR-15
tattgcctctatttcaaaggagatgcctggcattagtatttctacttcttgggatagaaaggttttggaaacttccctttcttctatagttgggagtgtatccagtgaaaaagctggtctcccagcggaagaagcagaagcctatcttaaaaaaggctattctctaaatgaccgtgttggaacctcgtatttggaaaagcaatatgaagagaccttacaaggaaaacgctcggtaaaagaaatccatctggataaatatggcaatatggaaagcgtggatacaattgaggaaggtagtaagggaaacaatatcaagctgaccattgatttggccttccaagatagcgtggatgctttgctgaaaagttatttcaattccgagctaggaaatggtggagccaagtattctgagggtgtgtatgcagtcgcccttaaccccaaaacaggtgctgttttgtctatgtcaggactcaaacatgacctgaaaacgggagagttgactcctgattccttgggaacggtaaccaatgtctttgtcccaggttcggttgttaaggccgctaccatcagctcaggttgggaaaatggtgttttatcaggaaaccaaaccttaacagatcagcctattgttttccaaggttcagctccaatttattcttggtataaattggcatatggatcttttcctattacagctgtggaagccttggagtattcatccaatgcttacatggttcaaaccgctcttggaatcatgggccagacctatcaaccaaatatgtttgttggaaccagcaatttggaaacagctatgggaaaacttcgtgcgacctttggcgaatatggcttgggggctgcgaccggaattgacctaccagatgaatctactggatttgttcccaaagagtatagctttgctaattacatcaccaatgcctttgggcagtttgataactatacgcccatgcagttggctcagtatgtagcaactattgcaaatgatggtgttcgtgtggctcctcgtattgttgaaggcatttatggtaataatgataagggaggactgggtgacttgattcagcaactgcaaccgacagagatgaataaggtcaatatatccgactccgatatgagtatcttgcaccaaggtttttatcaggttgctcatgggactagtggattgacaactggacgtgctttttcaaatggtgccttggtatccattagtgggaaaacaggtactgccgaaagttatgttgcaggtggtcaagaagccaacaataccaacgcggtggcctatgccccatcagataatcctcaaatcgctgttgccgttgtcttccctcataacaccaatctaacaaatggtgttggaccttctattgcacgcgatattatcaacctctataaccaacaccatccaatgaattagaaaggaacttatgc

SEQ ID NO: 1034 - DNA, 1670 bp, Streptococcus pneumoniae
  strain StrR-01
ggaaactgcagaggtcaaggggattgattttacaaccagtcccaatcgtagttatccaaacggacaatttgcttctagttttatcggactagctcagctccatgaaaatgaagatggcagcaagagcttactgggaacctctggaatggagagttccttgaacagtattcttgcagggacagacggtattattacctatgaaaaagaccgtgtaggaaatatcgtaccaggtacagaactggtatcgcaacaaactgtggatggcaaggatgtttatacaacattgtctagtccgctacaatctttcatggaaactcagatggatgcctttctagaaaaagtaaaaggtaagtatatgaccgcgaccttggtcagtgcaaagaccggtgaaatcctcgctaccacccaacgacctacctttaatgcagatactaaagaaggaatcactgaggactttgtttggcgtgatattctttatcaaagtaactatgaaccaggatcagccatgaaggttatgacgttagcttcttctattgataataataccttcccaagtggagaatacttcaatagcagtgaattcaaaatagcggatgcgacgactcgagattgggatgttaatgatggtttgactactggtgggatgatgactttcttacaaggtttcgctcactccagtaatgttggaatgagtctacttgaacaaaaaatgggagatgctacttggttggattatctaaaacgctttaaatttggggttccaactcgctttggcttgacagatgaatacgctggtcaacttccagctgataatattgttagtattgctcaaagctcatttgggcaaggaatttcagtgacacaaacacaaatgcttcgtgcctttacagctattgctaatgatggagttatgctggagccaaaatttataagtgctatttatgatactaacaatcagtctgtacgtaagtcacaaaaagaaatagtaggaaatcctgtttccaaagaggcagcaagcacaactcgaaatcacatgatcttagttgggacggaccctctatatggaactatgtataatcactacacaggaaagccaattataacagttcctggacaaaatgtagcagttaaatccggtacggctcaaatcgctgatgagaaaaatggaggatacttggttggttctaccaattatattttctcagttgtgactatgaatcctgctgaaaatcctgattttatcttgtatgtaacggttcaacagcctgagcattattcaggtatccagttgggagaatttgccaccccaatcttggagcgggcttcagctatgaaagaatctctcaatcttcaatctccagccaaaaatttagataaagttacgacagaatcttcttatgcaatgcctagcatcaaggatatttcacctggtgagttggcggaagccttacgccgaaatattgtgcaaccaatcgttgtaggtactggaacaaagattaaagagacttctgtagaagaagggaccaatcttgcaccaaaccaacaagttctccttttatcggataaggtagaagaaattccagacatgtatggctggaaaaaagagactgccgagacctttgctaaatggttggatattgaactggaatttgaaggttcaggttccgttg

SEQ ID NO: 1035 - DNA, 1683 bp, Streptococcus pneumoniae
  strain StrR-02
aaagaattggaaactgcagaggtcaaggggattgattttacaaccagtcccaatcgtagttacccaaatggacaatttgcttctagttttatcggtctagctcagctccatgaaaatgaagatggaagcaagagtttgctgggaacctctggaatggagagttccttgaacagtattcttgcagggacagacggcattattacctatgaaaaggatcgtctgggcaatattgtacccggaacagaacaagtttcccaacaaacggtggatggcaaggatgtttacacaaccatttccagccccctccagtccttcatggaaactcagatggatgcctttctagaaaaagtaaaaggtaagtatatgaccgcgaccttggtcagtgcaaagaccggtgaaatcctcgctaccacccaacgacctacctttaatgcagatactaaagaaggaatcactgaggactttgtttggcgtgatattctttatcaaagtaactatgaaccaggatcagccatgaaggttatgacgttagcttcttctattgataataataccttcccaagtggagaatacttcaatagcagtgaattcaaaatagcggatgcgacgactcgagattgggatgttaatgatggtttgactactggtgggatgatgactttcttacaaggtttcgctcactccagtaatgttggaatgagtctacttgaacaaaaaatgggagatgctacttggttggattatctaaaacgctttaaatttggggttccaactcgctttggcttgacagatgaatacgctggtcaacttccagctgataatattgttagtattgctcaaagctcatttgggcaaggaatttcagtgacacaaacacaaatgcttcgtgcctttacagctattgctaatgatggagttatgctggagccaaaatttataagtgctatttatgatactaacaatcagtctgtacgtaagtcacaaaaagaaatagtaggaaatcctgtttccaaagaggcagcaagcacaactcgaaatcacatgatcttagttgggacggaccctctatatggaactatgtataatcactacacaggaaagccaattataacagttcctggacaaaatgtagcagttaaatccggtacggctcaaatcgctgatgagaaaaatggaggatacttggttggttctaccaattatattttctcagttgtgactatgaatcctgctgaaaatcctgattttatcttgtatgtaacggttcaacagcctgagcattattcaggtatccagttgggagaatttgccaccccaatcttggagcgggcttcagctatgaaagaatctctcaatcttcaatctccagccaaaaatttagataaagttacgacagaatcttcttatgcaatgcctagcatcaaggatatttcacctggtgagttggcggaagccttacgccgaaatattgtgcaaccaatcgttgtaggtactggaacaaagattaaagagacttctgtagaagaagggaccaatcttgcaccaaaccaacaagttctccttttatcggataaggtagaagaaattccagacatgtatggctggaaaaaagagactgccgagacctttgctaaatggttggatattgaactggaatttgaaggttcaggttccgttgttcag

SEQ ID NO: 1036 - DNA, 1682 bp, Streptococcus pneumoniae
  strain StrR-03
tcaaaaaagaattggaaactgcagaggtcaaggggattgattttacaaccagtcccaatcgtagttacccaaatggacaatttgcttctagttttatcggtctagctcagctccatgaaaatgaagatggaagcaagagtttgctgggaacctctggaatggagagttccttgaacagtattcttgcagggacagacggcattattacctatgaaaaggatcgtctgggcaatattgtacccggaacagaacaagtttcccaacaaacggtggatggcaaggatgtttacacaaccatttccagccccctccagtccttcatggaaactcagatggatgcctttctagaaaaagtaaaaggtaagtatatgaccgcgaccttggtcagtgcaaagaccggtgaaatcctcgctaccacccaacgacctacctttaatgcagatactaaagaaggaatcactgaggactttgtttggcgtgatattctttatcaaagtaactatgaaccaggatcagccatgaaggttatgacgttagcttcttctattgataataataccttcccaagtggagaatacttcaatagcagtgaattcaaaatagcggatgcgacgactcgagattgggatgttaatgatggtttgactactggtgggatgatgactttcttacaaggtttcgctcactccagtaatgttggaatgagtctacttgaacaaaaaatgggagatgctacttggttggattatctaaaacgctttaaatttggggttccaactcgctttggcttgacagatgaatacgctggtcaacttccagctgataatattgttagtattgctcaaagctcatttgggcaaggaatttcagtgacacaaacacaaatgcttcgtgcctttacagctattgctaatgatggagttatgctggagccaaaatttataagtgctatttatgatactaacaatcagtctgtacgtaagtcacaaaaagaaatagtaggaaatcctgtttccaaagaggcagcaagcacaactcgaaatcacatgatcttagttgggacggaccctctatatggaactatgtataatcactacacaggaaagccaattataacagttcctggacaaaatgtagcagttaaatccggtacggctcaaatcgctgatgagaaaaatggaggatacttggttggttctaccaattatattttctcagttgtgactatgaatcctgctgaaaatcctgattttatcttgtatgtaacggttcaacagcctgagcattattcaggtatccagttgggagaatttgccaccccaatcttggagcgggcttcagctatgaaagaatctctcaatcttcaatctccagccaaaaatttagataaagttacgacagaatcttcttatgcaatgcctagcatcaaggatatttcacctggtgagttggcggaagccttacgccgaaatattgtgcaaccaatcgttgtaggtactggaacaaagattaaagagacttctgtagaagaagggaccaatcttgcaccaaaccaacaagttctccttttatcggataaggtagaagaaattccagacatgtatggctggaaaaaagagactgccgagacctttgctaaatggttggatattgaactggaatttgaaggttcaggttccgtt

SEQ ID NO: 1037 - DNA, 1681 bp, Streptococcus pneumoniae
  strain StrR-04
caaaaaagaattggaaactgcagaggtcaaggggattgattttacaaccagtcccaatcgtagttatccaaacggacaatttgcttctagttttatcggactagctcagctccatgaaaatgaagatggcagcaagagcttactgggaacctctggaatggagagttccttgaacagtattcttgcagggacagacggtattattacctatgaaaaagaccgtgtaggaaatatcgtaccaggtacagaactggtatcgcaacaaactgtggatggcaaggatgtttatacaacattgtctagtccgctacaatctttcatggaaactcagatggatgcctttctagaaaaagtaaaaggtaagtatatgaccgcgaccttggtcagtgcaaagaccggtgaaatcctcgctaccacccaacgacctacctttaatgcagatactaaagaaggaatcactgaggactttgtttggcgtgatattctttatcaaagtaactatgaaccaggatcagccatgaaggttatgacgttagcttcttctattgataataataccttcccaagtggagaatacttcaatagcagtgaattcaaaatagcggatgcgacgactcgagattgggatgttaatgatggtttgactactggtgggatgatgactttcttacaaggtttcgctcactccagtaatgttggaatgagtctacttgaacaaaaaatgggagatgctacttggttggattatctaaaacgctttaaatttggggttccaactcgctttggcttgacagatgaatacgctggtcaacttccagctgataatattgttagtattgctcaaagctcatttgggcaaggaatttcagtgacacaaacacaaatgcttcgtgcctttacagctattgctaatgatggagttatgctggagccaaaatttataagtgctatttatgatactaacaatcagtctgtacgtaagtcacaaaaagaaatagtaggaaatcctgtttccaaagaggcagcaagcacaactcgaaatcacatgatcttagttgggacggaccctctatatggaactatgtataatcactacacaggaaagccaattataacagttcctggacaaaatgtagcagttaaatccggtacggctcaaatcgctgatgagaaaaatggaggatacttggttggttctaccaattatattttctcagttgtgactatgaatcctgctgaaaatcctgattttatcttgtatgtaacggttcaacagcctgagcattattcaggtatccagttgggagaatttgccaccccaatcttggagcgggcttcagctatgaaagaatctctcaatcttcaatctccagccaaaaatttagataaagttacgacagaatcttcttatgcaatgcctagcatcaaggatatttcacctggtgagttggcggaagccttacgccgaaatattgtgcaaccaatcgttgtaggtactggaacaaagattaaagagacttctgtagaagaagggaccaatcttgcaccaaaccaacaagttctccttttatcggataaggtagaagaaattccagacatgtatggctggaaaaaagagactgccgagacctttgctaaatggttggatattgaactggaatttgaaggttcaggttccgtt

SEQ ID NO: 1038 - DNA, 1685 bp, Streptococcus pneumoniae
  strain StrR-05
aaaaaagaattggaaactgcagaggtcaaggggattgattttacaaccagtcccaatcgtagttatccaaacggacaatttgcttctagttttatcggactagctcagctccatgaaaatgaagatggcagcaagagcttactgggaacctctggaatggagagttccttgaacagtattcttgcagggacagacggtattattacctatgaaaaagaccgtgtaggaaatatcgtaccaggtacagaactggtatcgcaacaaactgtggatggcaaggatgtttatacaacattgtctagtccgctacaatctttcatggaaactcagatggatgcctttctagaaaaagtaaaaggtaagtatatgaccgcgaccttggtcagtgcaaagaccggtgaaatcctcgctaccacccaacgacctacctttaatgcagatactaaagaaggaatcactgaggactttgtttggcgtgatattctttatcaaagtaactatgaaccaggatcagccatgaaggttatgacgttagcttcttctattgataataataccttcccaagtggagaatacttcaatagcagtgaattcaaaatagcggatgcgacgactcgagattgggatgttaatgatggtttgactactggtgggatgatgactttcttacaaggtttcgctcactccagtaatgttggaatgagtctacttgaacaaaaaatgggagatgctacttggttggattatctaaaacgctttaaatttggggttccaactcgctttggcttgacagatgaatacgctggtcaacttccagctgataatattgttagtattgctcaaagctcatttgggcaaggaatttcagtgacacaaacacaaatgcttcgtgcctttacagctattgctaatgatggagttatgctggagccaaaatttataagtgctatttatgatactaacaatcagtctgtacgtaagtcacaaaaagaaatagtaggaaatcctgtttccaaagaggcagcaagcacaactcgaaatcacatgatcttagttgggacggaccctctatatggaactatgtataatcactacacaggaaagccaattataacagttcctggacaaaatgtagcagttaaatccggtacggctcaaatcgctgatgagaaaaatggaggatacttggttggttctaccaattatattttctcagttgtgactatgaatcctgctgaaaatcctgattttatcttgtatgtaacggttcaacagcctgagcattattcaggtatccagttgggagaatttgccaccccaatcttggagcgggcttcagctatgaaagaatctctcaatcttcaatctccagccaaaaatttagataaagttacgacagaatcttcttatgcaatgcctagcatcaaggatatttcacctggtgagttggcggaagccttacgccgaaatattgtgcaaccaatcgttgtaggtactggaacaaagattaaagagacttctgtagaagaagggaccaatcttgcaccaaaccaacaagttctccttttatcggataaggtagaagaaattccagacatgtatggctggaaaaaagagactgccgagacctttgctaaatggttggatattgaactggaatttgaaggttcaggttccgttgttca

SEQ ID NO: 1039 - DNA, 1679 bp, Streptococcus pneumoniae
  strain StrR-06
aaaagaattggaaactgcagaggtcaaggggattgattttacaaccagtcccaatcgtagttatccaaacggacaatttgcttctagttttatcggactagctcagctccatgaaaatgaagatggcagcaagagcttactgggaacctctggaatggagagttccttgaacagtattcttgcagggacagacggtattattacctatgaaaaagaccgtgtaggaaatatcgtaccaggtacagaactggtatcgcaacaaactgtggatggcaaggatgtttatacaacattgtctagtccgctacaatctttcatggaaactcagatggatgcctttctagaaaaagtaaaaggtaagtatatgaccgcgaccttggtcagtgcaaagaccggtgaaatcctcgctaccacccaacgacctacctttaatgcagatactaaagaaggaatcactgaggactttgtttggcgtgatattctttatcaaagtaactatgaaccaggatcagccatgaaggttatgacgttagcttcttctattgataataataccttcccaagtggagaatacttcaatagcagtgaattcaaaatagcggatgcgacgactcgagattgggatgttaatgatggtttgactactggtgggatgatgactttcttacaaggtttcgctcactccagtaatgttggaatgagtctacttgaacaaaaaatgggagatgctacttggttggattatctaaaacgctttaaatttggggttccaactcgctttggcttgacagatgaatacgctggtcaacttccagctgataatattgttagtattgctcaaagctcatttgggcaaggaatttcagtgacacaaacacaaatgcttcgtgcctttacagctattgctaatgatggagttatgctggagccaaaatttataagtgctatttatgatactaacaatcagtctgtacgtaagtcacaaaaagaaatagtaggaaatcctgtttccaaagaggcagcaagcacaactcgaaatcacatgatcttagttgggacggaccctctatatggaactatgtataatcactacacaggaaagccaattataacagttcctggacaaaatgtagcagttaaatccggtacggctcaaatcgctgatgagaaaaatggaggatacttggttggttctaccaattatattttctcagttgtgactatgaatcctgctgaaaatcctgattttatcttgtatgtaacggttcaacagcctgagcattattcaggtatccagttgggagaatttgccaccccaatcttggagcgggcttcagctatgaaagaatctctcaatcttcaatctccagccaaaaatttagataaagttacgacagaatcttcttatgcaatgcctagcatcaaggatatttcacctggtgagttggcggaagccttacgccgaaatattgtgcaaccaatcgttgtaggtactggaacaaagattaaagagacttctgtagaagaagggaccaatcttgcaccaaaccaacaagttctccttttatcggataaggtagaagaaattccagacatgtatggctggaaaaaagagactgccgagacctttgctaaatggttggatattgaactggaatttgaaggttcaggttccgttg

SEQ ID NO: 1040 - DNA, 1685 bp, Streptococcus pneumoniae
  strain StrR-07
taaaaaggatctaaaagacgctagtgttgaaggaattgacttcacaactagccctaatagaagctatccaaatggacaattcgcttctagttttattggtttggcccaactccatgaaaatgaggatggtagcaagagtttgctgggaacttctgggatggagagttccttgaacagtattcttgcagggaaagacggtattattacctatgaaaaagatcgtctgggtaatattgtccctggaacagaacaagtttcccaacaaacggtagatggcaaggatgtttatacaacattgtctagtccgctacaatctttcatggaaactcagatggatgcctttctagaaaaagtaaaaggtaagtatatgaccgcgaccttggtcagtgcaaagaccggtgaaatcctcgctaccacccaacgacctacctttaatgcagatactaaagaaggaatcactgaggactttgtttggcgtgatattctttatcaaagtaactatgaaccaggatcagccatgaaggttatgacgttagcttcttctattgataataataccttcccaagtggagaatacttcaatagcagtgaattcaaaatagcggatgcgacgactcgagattgggatgttaatgaaggtttgactactggtgggatgatgactttcttacaaggtttcgctcactccagtaatgttggaatgagtctacttgaacaaaaaatgggagatgctacttggttggattatctaaaacgctttaaatttggggttccaactcgctttggcttgacagatgaatacgctggtcaacttccagctgataatattgttagtattgctcaaagctcatttgggcaaggaatttcagtgacacaaacacaaatgcttcgtgcctttacagctattgctaatgatggagttatgctggagccaaaatttataagtgctatttatgatactaacaatcagtctgtacgtaagtcacaaaaagaaatagtaggaaatcctgtttccaaagaggcagcaagcacaactcgaaatcacatgatcttagttgggacggaccctctatatggaactatgtataatcactacacaggaaagccaattataacagttcctggacaaaatgtagcagttaaatccggtacggctcaaatcgctgatgagaaaaatggaggatacttggttggttctaccaattatattttctcagctgtgactatgaatcctgctgaaaatcctgattttatcttgtatgtaacggttcaacagcctgagcattattcaggtatccagttgggagaatttgccaccccaatcttggagcgggcttcagctatgaaagaatctctcaatcttcaatctccagccaaaaatttagataaagttacgacagaatcttcttatgcaatgcctagcatcaaggatatttcacctggtgagttggcggaagccttacgccgaaatattgtgcaaccaatcgttgtaggtactggaacaaagattaaagagacttctgtagaagaagggaccaatcttgcaccaaaccaacaagttctccttttatcggataaggtagaagaaattccagacatgtatggctggaaaaaagagactgccgagacctttgctaaatggttggatattgaactggaatttgaaggttcaggttccgtcgttc

SEQ ID NO: 1041 - DNA, 1696 bp, Streptococcus pneumoniae
  strain StrR-08
gtctatcaaaaaagaattggaaactgcagaggtcaaggggattgattttacaaccagtcccaatcgtagttatccaaacggacaatttgcttctagttttatcggactagctcagctccatgaaaatgaagatggcagcaagagcttactgggaacctctggaatggagagttccttgaacagtattcttgcagggacagacggtattattacctatgaaaaagaccgtgtaggaaatatcgtaccaggtacagaactggtatcgcaacaaactgtggatggcaaggatgtttatacaacattgtctagtccgctacaatctttcatggaaactcagatggatgcctttctagaaaaagtaaaaggtaagtatatgaccgcgaccttggtcagtgcaaagaccggtgaaatcctcgctaccacccaacgacctacctttaatgcagatactaaagaaggaatcactgaggactttgtttggcgtgatattctttatcaaagtaactatgaaccaggatcagccatgaaggttatgacgttagcttcttctattgataataataccttcccaagtggagaatacttcaatagcagtgaattcaaaatagcggatgcgacgactcgagattgggatgttaatgatggtttgactactggtgggatgatgactttcttacaaggtttcgctcactccagtaatgttggaatgagtctacttgaacaaaaaatgggagatgctacttggttggattatctaaaacgctttaaatttggggttccaactcgctttggcttgacagatgaatacgctggtcaacttccagctgataatattgttagtattgctcaaagctcatttgggcaaggaatttcagtgacacaaacacaaatgcttcgtgcctttacagctattgctaatgatggagttatgctggagccaaaatttataagtgctatttatgatactaacaatcagtctgtacgtaagtcacaaaaagaaatagtaggaaatcctgtttccaaagaggcagcaagcacaactcgaaatcacatgatcttagttgggacggaccctctatatggaactatgtataatcactacacaggaaagccaattataacagttcctggacaaaatgtagcagttaaatccggtacggctcaaatcgctgatgagaaaaatggaggatacttggttggttctaccaattatattttctcagttgtgactatgaatcctgctgaaaatcctgattttatcttgtatgtaacggttcaacagcctgagcattattcaggtatccagttgggagaatttgccaccccaatcttggagcgggcttcagctatgaaagaatctctcaatcttcaatctccagccaaaaatttagataaagttacgacagaatcttcttatgcaatgcctagcatcaaggatatttcacctggtgagttggcggaagccttacgccgaaatattgtgcaaccaatcgttgtaggtactggaacaaagattaaagagacttctgtagaagaagggaccaatcttgcaccaaaccaacaagttctccttttatcggataaggtagaagaaattccagacatgtatggctggaaaaaagagactgccgagacctttgctaaatggttggatattgaactggaatttgaaggttcaggttccgttgttcagaag

SEQ ID NO: 1042 - DNA, 1689 bp, Streptococcus pneumoniae
  strain StrR-09
aaaaaagagttggaaactgcagaggtcaaggggattgattttacaaccagtcccaatcgtagttacccaaacggacaatttgcttctagttttatcggactagctcagctccatgaaaatgaagatggcagcaagagcttgctgggaacctctggaatggagagttccttgaacagtattcttgcagggacagacggcattattacctatgaaaaggatcgtctgggaaatattgtccccggaacggaacaagtttcccaacaaactgtagatggcaaggatgtttatacgactatttccagcacccttcagtccttcatggaaactcagatggatgcctttctagaaaaagtaaaaggtaagtatatgaccgcgaccttggtcagtgcaaagaccggtgaaatcctcgctaccacccaacgacctacctttaatgcagatactaaagaaggaatcactgaggactttgtttggcgtgatattctttatcaaagtaactatgaaccaggatcagccatgaaggttatgacgttagcttcttctattgataataataccttcccaagtggagaatacttcaatagcagtgaattcaaaatagcggatgcgacgactcgagattgggatgttaatgatggtttgactactggtgggatgatgactttcttacaaggtttcgctcactccagtaatgttggaatgagtctacttgaacaaaaaatgggagatgctacttggttggattatctaaaacgctttaaatttggggttccaactcgctttggcttgacagatgaatacgctggtcaacttccagctgataatattgttagtattgctcaaagctcatttgggcaaggaatttcagtgacacaaacacaaatgcttcgtgcctttacagctattgctaatgatggagttatgctggagccaaaatttataagtgctatttatgatactaacaatcagtctgtacgtaagtcacaaaaagaaatagtaggaaatcctgtttccaaagaggcagcaagcacaactcgaaatcacatgatcttagttgggacggaccctctatatggaactatgtataatcactacacaggaaagccaattataacagttcctggacaaaatgtagcagttaaatccggtacggctcaaatcgctgatgagaaaaatggaggatacttggttggttctaccaattatattttctcagttgtgactatgaatcctgctgaaaatcctgattttatcttgtatgtaacggttcaacagcctgagcattattcaggtatccagttgggagaatttgccaccccaatcttggagcgggcttcagctatgaaagactctctcaatcttcaaacaacagctaaagctttggagcaagtaagtcaacaaagtccttatcctatgcctagtgtcaaggatatttcacctggtgatttagcagaagaattgcgtcgcaatcttgtacaacccatcgttgtgggaacaggaacgaagattaaaaacagttctgctgaagaagggaagaatcttgccccgaatcagcaagtccttatcttatctgataaagtagaggaagttccagatatgtatggttggacaaaggagactgctgagacccttgctaagtggctcaatatagaacttgaatttcaaggttcgggttctactgtgcagaag

SEQ ID NO: 1043 - DNA, 1690 bp, Streptococcus pneumoniae
  strain StrR-10
caaaaaagagttggaaactgcagaggtcaaggggattgattttacaaccagtcctaatcgtagttacccaaacggacaatttgcttctagttttatcggtctagctcaactccatgaaaatgaagatggaagcaagagtttgctgggaacttctggaatggagagttccttgaacagtattcttgcagggaaagacggtattattacttatgaaaaggatcgtctgggtaatattgtccctggaacagaacaagtttcccaacaaacggtagatggcaaggatgtttatacaacattgtctagtccgctccaatctttcatggaaactcagatggatgcctttctagaaaaagtaaaaggtaagtatatgaccgcgaccttggtcagtgcaaagaccggtgaaatcctcgctaccacccaacgacctacctttaatgcagatactaaagaaggaatcactgaggactttgtttggcgtgatattctttatcaaagtaactatgaaccaggatcagccatgaaggttatgacgttagcttcttctattgataataataccttcccaagtggagaatacttcaatagcagtgaattcaaaatagcggatgcgacgactcgagattgggatgttaatgatggtttgactactggtgggatgatgactttcttacaaggtttcgctcactccagtaatgttggaatgagtctacttgaacaaaaaatgggagatgctacttggttggattatctaaaacgctttaaatttggggttccaactcgctttggcttgacagatgaatacgctggtcaacttccagctgataatattgttagtattgctcaaagctcatttgggcaaggaatttcagtgacacaaacacaaatgcttcgtgcctttacagctattgctaatgatggagttatgctggagccaaaatttataagtgctatttatgatactaacaatcagtctgtacgtaagtcacaaaaagaaatagtaggaaatcctgtttccaaagaggcagcaagcacaactcgaaatcacatgatcttagttgggacggaccctctatatggaactatgtataatcactacacaggaaagccaattataacagttcctggacaaaatgtagcagttaaatccggtacggctcaaatcgctgatgagaaaaatggaggatacttggttggttctaccaattatattttctcagttgtgactatgaatcctgctgaaaatcctgattttatcttgtatgtaacggttcaacagcctgagcattattcaggtatccagttgggagaatttgccaccccaatcttggagcgggcttcagctatgaaagaatctctcaatcttcaatctccagccaaaaatttagataaagttacgacagaatcttcttatgcaatgcctagcatcaaggatatttcacctggtgagttggcggaagccttacgccgaaatattgtgcaaccaatcgttgtaggtactggaacaaagattaaagagacttctgtagaagaagggaccaatcttgcaccaaaccaacaagttctccttttatcggataaggtagaagaaattccagacatgtatggctggaaaaaagagactgccgagacctttgctaaatggttggatattgaactggaatttgaaggttcaggttccgttgttcagaag

SEQ ID NO: 1044 - DNA, 1668 bp, Streptococcus pneumoniae
  strain StrR-11
agttggaaactgcagaggtcaaggggattgattttacaaccagtcctaatcgtagttacccaaacggacaatttgcttctagttttatcggactagctcagctccatgaaaatgaagatggcagcaagagcttgctgggaacctctgggatggagagttctttaaatagaattcttgcagggacagacggcattattacctatgaaaaggatcgtctgggaaatattgtccccggaacggaacaagtttcccaacaaacggtagatggcaaggatgtttatacgactatttccagcacccttcagtccttcatggagacccagatgaatgcctttcaagaaaaagtaaaaggcaagtatatgacggctaccttggtcagtgctaaaacaggggaaattcttgcaacaacgcaacggccgaccttcgatgctgatactaaggaaggacttaccaaggactttgtttggcgtgatatcctctatcaaagtaactatgagccagggtcaaccatgaaggtcatgacgcttgctgctgctattgataataacactttcccaggaggagaagttttcaatagtagtgaattaaaaatagcggatgcgacaattcgagattgggatgttaatgatggtttgacgactggtgggatgatgactttcttacaaggtttcgctcactccagtaatgttggaatgagtctacttgaacaaaaaatgggagatgctacttggttggattatctaaaccgctttaagtttggggtgccgacgcgttttggtctgactgatgagtattcaggtcaattgcctgcagataatattgttaatattgccatgagtgcatttggtcaggggatttcagtgacccagacgcaaatgattcgtgcctttacagctattgctaatgatggtgttatgctggagcctaaatttattagtgccatttatgatccaaatgatcaaactgctcggaaatctcaaaaagaaattgtgggaaatcctgtttctaaagatgcagctagtctaactcggactaacatgattttggtagggacggatccggtttatggaaccatgtataaccacagcacaggtaagccaactgtaactgttcctgggcaaaatgtagccctcaagtctggtacggctcagattgctgacgagaaaaatggtggttatctagtcgggttaaccaactatattttctcggctgtatcgatgaatccggctgaaaatcctgattttatcttgtatgtaacggtacagcaacctgaacattattcaggtatccagttgggagaatttgccaccccaatcttggagcgggcttcagctatgaaagaatctctcaatcttcaatctccagccaagaatttagataaagttacgacagaatcttcttatgcaatgcctagcatcaaggatatttcacctggtgagttggcggaagccttacgccgaaatattgtgcaaccaatcgttgtaggtactggaacaaagattaaagagacttctgtagaagaagggaccaatcttgcaccaaaccaacaagttctccttttatcggataaggtagaagaaattccagacatgtatggctggaaaaaagagactgctgaaacctttgctaaatggttggatattgagctggaatttgaagggtcaggtt

SEQ ID NO: 1045 - DNA, 1680 bp, Streptococcus pneumoniae
  strain StrR-12
ttggaaactgcagaggtcaaggggattgattttacaaccagtcccaatcgtagttacccaaatggacaatttgcttctagttttatcggtctagctcagctccatgaaaatgaagatggaagcaagagtttgctgggaacctctggaatggagagttccttgaacagtattcttgcagggacagacggcattattacctatgaaaaggatcgtctgggcaatattgtacccggaacagaacaagtttcccaacaaacggtggatggcaaggatgtttacacaaccatttccagccccctccagtccttcatggaaactcagatggatgcctttctagaaaaagtaaaaggtaagtatatgaccgcgaccttggtcagtgcaaagaccggtgaaatcctcgctaccacccaacgacctacctttaatgcagatactaaagaaggaatcactgaggactttgtttggcgtgatattctttatcaaagtaactatgaaccaggatcagccatgaaggttatgacgttagcttcttctattgataataataccttcccaagtggagaatacttcaatagcagtgaattcaaaatagcggatgcgacgactcgagattgggatgttaatgatggtttgactactggtgggatgatgactttcttacaaggtttcgctcactccagtaatgttggaatgagtctacttgaacaaaaaatgggagatgctacttggttggattatctaaaacgctttaaatttggggttccaactcgctttggcttgacagatgaatacgctggtcaacttccagctgataatattgttagtattgctcaaagctcatttgggcaaggaatttcagtgacacaaacacaaatgcttcgtgcctttacagctattgctaatgatggagttatgctggagccaaaatttataagtgctatttatgatactaacaatcagtctgtacgtaagtcacaaaaagaaatagtaggaaatcctgtttccaaagaggcagcaagcacaactcgaaatcacatgatcttagttgggacggaccctctatatggaactatgtataatcactacacaggaaagccaattataacagttcctggacaaaatgtagcagttaaatccggtgcggctcaaatcgctgatgagaaaaatggaggatacttggttggttctaccaattatattttctcagttgtgactatgaatcctgctgaaaatcctgattttatcttgtatgtaacggttcaacagcctgagcattattcaggtatccagttgggagaatttgccaccccaatcttggagcgggcttcagctatgaaagaatctctcaatcttcaatctccagccaaaaatttagataaagttacgacagaatcttcttatgcaatgcctagcatcaaggatatttcacctggtgagttggcggaagccttacgccgaaatattgtgcaaccaatcgttgtaggtactggaacaaagattaaagagacttctgtagaagaagggaccaatcttgcaccaaaccaacaagttctccttttatcggataaggtagaagaaattccagacatgtatggctggaaaaaagagactgccgagacctttgctaaatggttggatattgaactggaatttgaaggttcaggttccgttgttcagaag

SEQ ID NO: 1046 - DNA, 1689 bp, Streptococcus pneumoniae
  strain StrR-13
aaaaaagagttggaaactgcagaggtcaaggggattgattttacaaccagtcctaatcgtagttacccaaacggacaatttgcttctagttttatcggtctagctcaactccatgaaaatgaagatggaagcaagagtttgctgggaacttctggaatggagagttccttgaacagtattcttgcagggaaagacggtattattacttatgaaaaggatcgtctgggtaatattgtccctggaacagaacaagtttcccaacaaacggtagatggcaaggatgtttatacaacattgtctagtccgctccaatctttcatggaaactcagatggatgcctttctagaaaaagtaaaaggtaagtatatgaccgcgaccttggtcagtgcaaagaccggtgaaatcctcgctaccacccaacgacctacctttaatgcagatactaaagaaggaatcactgaggactttgtttggcgtgatattctttatcaaagtaactatgaaccaggatcagccatgaaggttatgacgttagcttcttctattgataataataccttcccaagtggagaatacttcaatagcagtgaattcaaaatagcggatgcgacgactcgagattgggatgttaatgatggtttgactactggtgggatgatgactttcttacaaggtttcgctcactccagtaatgttggaatgagtctacttgaacaaaaaatgggagatgctacttggttggattatctaaaacgctttaaatttggggttccaactcgctttggcttgacagatgaatacgctggtcaacttccagctgataatattgttagtattgctcaaagctcatttgggcaaggaatttcagtgacacaaacacaaatgcttcgtgcctttacagctattgctaatgatggagttatgctggagccaaaatttataagtgctatttatgatactaacaatcagtctgtacgtaagtcacaaaaagaaatagtaggaaatcctgtttccaaagaggcagcaagcacaactcgaaatcacatgatcttagttgggacggaccctctatatggaactatgtataatcactacacaggaaagccaattataacagttcctggacaaaatgtagcagttaaatccggtacggctcaaatcgctgatgagaaaaatggaggatacttggttggttctaccaattatattttctcagttgtgactatgaatcctgctgaaaatcctgattttatcttgtatgtaacggttcaacagcctgagcattattcaggtatccagttgggagaatttgccaccccaatcttggagcgggcttcagctatgaaagaatctctcaatcttcaatctccagccaaaaatttagataaagttacgacagaatcttcttatgcaatgcctagcatcaaggatatttcacctggtgagttggcggaagccttacgccgaaatattgtgcaaccaatcgttgtaggtactggaacaaagattaaagagacttctgtagaagaagggaccaatcttgcaccaaaccaacaagttctccttttatcggataaggtagaagaaattccagacatgtatggctggaaaaaagagactgccgagacctttgctaaatggttggatattgaactggaatttgaaggttcaggttccgttgttcagaag

SEQ ID NO: 1047 - DNA, 1690 bp, Streptococcus pneumoniae
  strain StrR-14
caaaaaagaattggaagctgcagaggtcaaggggattgattttacaaccagtcccaaccgtagttacccaaacggacaatttgcttctagttttatcggactagctcagctccatgaaaatgaagatggcagcaagagcttgctgggaacttctggaatggagagttccttgaacagtattcttgcagggacagacggcattattacctatgaaaaggatcgtctgggtaatattgtacccggaacagaacaagtttcccaacaaacggtagatggcaaggatgtttacacaaccatttccagccccctccagtcctttatggaaacccagatggatgcttttcaagagaaggtaaaaggaaagtacacgacagcgactttggtcagtgctaaaacaggggaaattctggcaacaacgcaacgaccgacctttgatgcagatacaaaagaaggcattacagaggactttgtttggcgtgatatcctttaccaaagtaactatgagccaggttcccctatgaaagtgatgatgttggctgctgctattgataataatacctttccagggggagaagtcttcaatagtagtgagttaaaaattgcagatgtcacgattcgagattgggacgtcaatgaaggattgactggtggcagaatgatgaccttttctcaagggttcgctcactcaagtaacgttgggatgacgcttcttgagcaaaagatgggagatgctacatggcttgattatctaaatcgctttaaatttggtgttccgactcgttttggcttgacggatgaatatgcaggccaacttccagctgacaatatcgtaaatattgctcagagttcatttggacaagggatttcagcgacccagacgcaaatgattcgtgccttcacggctattgccaacgatggagtcatgttagaacctaaatttatcagtgccatttatgatccaaatgatcaaactgctcggaaatcacaaaaagaagttgtgggaaatcctgtgtctaaagatgcagcgagcttgacgcgaacgcatatggttttagtcggtaccgatccagtatatggaactatgtataatcataagacagggaaaccaactgtaactgttcctgggcaaaatgtagccctcaagtctggtacggctcagattgccgatgagaaaaatggaggttacttagttggtacgaccaattacattttttcggctgtatcgatgaaccctgctgaaaatcctgattttattctctatgtgacggttcaacagcctgagcattattcaggtattcagttgggggaatttgccaatcctatcttggaaagggcagtggctatgaaagattcccttaacctccaatctaccgctaaaacgttaaatcaggtaaccaatcaaagcgcttatgccatgcctagcatcaaggacatttcacctggcgatttggcggaagccttacgtcgcaatattgtgcaaccaatcgttgtaggaacaggaacaaaaattaaagaatcatctgtagaagaagggacggatcttgcacctaaccagcaagttcttctcttatctgataaagcagaggaagttccagatatgtatggttggacaaaagagactgctgagacctttgctaagtggctcaatatagaacttgaatttgaaggttcgggctctactgtgcagaag

SEQ ID NO: 1048 - DNA, 1682 bp, Streptococcus pneumoniae
  strain StrR-15
aaaagagttggaaactgcagaggtcaaggggattgattttacaaccagtcccaatcgtagttacccaaacggacaatttgcttctagctttattggcttagcccaacttcatgaaaatgaggatggtagtaagagtttgttagggacttctggtttggagagttctttaaataccattcttgctgggacagacggtattattacctatgaaaaagaccgtgtaggaaatatcgtaccaggtacagaactggtatcgcaacaaactgtggatggcaaggatgtttatacaacattgtctagtccgctacaatctttcatggaaactcagatggatgcctttctagaaaaagtaaaaggtaagtatatgaccgcgaccttggtcagtgcaaagaccggtgaaatcctcgctaccacccaacgacctacctttaatgcagatactaaagaaggaatcactgaggactttgtttggcgtgatattctttatcaaagtaactatgaaccaggatcagccatgaaggttatgacgttagcttcttctattgataataataccttcccaagtggagaatacttcaatagcagtgaattcaaaatagcggatgcgacgactcgagattgggatgttaatgaaggtttgactactggtgggatgatgactttcttacaaggtttcgctcactccagtaatgttggaatgagtctacttgaacaaaaaatgggagatgctacttggttggattatctaaaacgctttaaatttggggttccaactcgctttggcttgacagatgaatacgctggtcaacttccagctgataatattgttagtattgctcaaagctcatttgggcaaggaatttcagtgacacaaacacaaatgcttcgtgcctttacagctattgctaatgatggagttatgctggagccaaaatttataagtgctatttatgatactaacaatcagtctgtacgtaagtcacaaaaagaaatagtaggaaatcctgtttccaaagaggcagcaagcacaactcgaaatcacatgatcttagttgggacggaccctctatatggaactatgtataatcactacacaggaaagccaattataacagttcctggacaaaatgtagcagttaaatccggtacggctcaaatcgctgatgagaaaaatggaggatacttggttggttctaccaattatattttctcagttgtgactatgaatcctgctgaaaatcctgattttatcttgtatgtaacggttcaacagcctgagcattattcaggtatccagttgggagaatttgccaccccaatcttggagcgggcttcagctatgaaagaatctctcaatcttcaatctccagccaaaaatttagataaagttacgacagaatcttcttatgcaatgcctagcatcaaggatatttcacctggtgagttggcggaagccttacgccgaaatattgtgcaaccaatcgttgtaggtactggaacaaagattaaagagacttctgtagaagaagggaccaatcttgcaccaaaccaacaagttctccttttatcggataaggtagaagaaattccagacatgtatggctggaaaaaagagactgctgaaacctttgctaaatggttggatattgagttggaatttgaaggttcaggttccgtcgttc

SEQ ID NO: 1049 - DNA, 1241 bp, Enterococcus faecium
  strain R690
gcagcgttgcgtgataccgttgaaaaaaccattaaaaactgtttggattttgaaaggagacaggagcatgaatagaataaaagttgcaatactgtttgggggttgctcagaggagcatgacgtatcggtaaaatctgcaatagagatagccgctaacattaataaagaaaaatacgagccgttatacattggaattacgaaatctggtgtatggaaaatgtgcgaaaaaccttgcgcggaatgggaaaacgacaattgctattcagctgtactctcgccggataaaaaaatgcacggattacttgttaaaaagaaccatgaatatgaaatcaaccatgttgatgtagcattttcagctttgcatggcaagtcaggtgaagatggatccatacaaggtctgtttgaattgtccggtatcccttttgtaggctgcgatattcaaagctcagcaatttgtatggacaaatcgttgacatacatcgttgcgaaaaatgctgggatagctactcccgccttttgggttattaataaagatgataggccggtggcagctacgtttacctatcctgtttttgttaagccggcgcgttcaggctcatccttcggtgtgaaaaaagtcaatagcgcggacgaattggactacgcaattgaatcggcaagacaatatgacagcaaaatcttaattgagcaggctgtttcgggctgtgaggtcggttgtgcggtattgggaaacagtgccgcgttagctgttggcgaggtggaccaaatcaggctgcagtacggaatctttcgtattcatcaggaagtcgagccggaaaaaggctctgaaaacgcagttataaccgttcccgcagacctttcagcagaggagcgaggacggatacaggaaacggcaaaaaaaatatataaagcgctcggctgtagaggtctagcccgtgtggatatgtttttacaagataacggccgcattgtactgaacgaagtcaatactctgcccggtttcacgtcatacagtcgttatccccgtatgatggccgctgcaggtattgcacttcccgaactgattgaccgcttgatcgtattagcgttaaaggggtgataagcatggaaataggatttacttttttagatgaaatagtacacggtgttcgttgggacgctaaatatgccacttgggataatttcaccggaaaaccggttgacggttatgaagtaaatcgcattgtagggacatacgaatt

SEQ ID NO: 1050 - DNA, 1249 bp, Enterococcus gallinarum
  strain R691
tcacaccgcatacggcctattataccgagcaagcgttgcgtgataccgttgaaaaaaccattaaaaactgtttggattttgaaaggagacaggagcatgaatagaataaaagttgcaatactgtttgggggttgctcagaggagcatgacgtatcggtaaaatctgcaatagagatagccgctaacattaataaagaaaaatacgagccgttatacattggaattacgaaatctggtgtatggaaaatgtgcgaaaaaccttgcgcggaatgggaaaacgacaattgctattcagctgtactctcgccggataaaaaaatgcacggattacttgttaaaaagaaccatgaatatgaaatcaaccatgttgatgtagcattttcagctttgcatggcaagtcaggtgaagatggatccatacaaggtctgtttgaattgtccggtatcccttttgtaggctgcgatattcaaagctcagcaatttgtatggacaaatcgttgacatacatcgttgcgaaaaatgctgggatagctactcccgccttttgggttattaataaagatgataggccggtggcagctacgtttacctatcctgtttttgttaagccggcgcgttcaggctcatccttcggtgtgaaaaaagtcaatagcgcggacgaattggactacgcaattgaatcggcaagacaatatgacagcaaaatcttaattgagcaggctgtttcgggctgtgaggtcggttgtgcggtattgggaaacagtgccgcgttagctgttggcgaggtggaccaaatcaggctgcagtacggaatctttcgtattcatcaggaagtcgagccggaaaaaggctctgaaaacgcagttataaccgttcccgcagacctttcagcagaggagcgaggacggatacaggaaacggcaaaaaaaatatataaagcgctcggctgtagaggtctagcccgtgtggatatgtttttacaagataacggccgcattgtactgaacgaagtcaatactctgcccggtttcacgtcatacagtcgttatccccgtatgatggccgctgcaggtattgcacttcccgaactgattgaccgcttgatcgtattagcgttaaaggggtgataagcatggaaataggatttacttttttagatgaaatagtacacggtgttcgttgggacgctaaatatgccacttgggataatttcaccggaaaaccggttgacggttatgaagtaaatcg

SEQ ID NO: 1051 - DNA, 1272 bp, Enterococcus faecium
  strain R481
tataccgagcaagcgttgcgtgataccgttgaaaaaaccattaaaaactgtttggattttgaaaggagacaggagcatgaatagaataaaagttgcaatactgtttgggggttgctcagaggagcatgacgtatcggtaaaatctgcaatagagatagccgctaacattaataaagaaaaatacgagccgttatacattggaattacgaaatctggtgtatggaaaatgtgcgaaaaaccttgcgcggaatgggaaaacgacaattgctattcagctgtactctcgccggataaaaaaatgcacggattacttgttaaaaagaaccatgaatatgaaatcaaccatgttgatgtagcattttcagctttgcatggcaagtcaggtgaagatggatccatacaaggtctgtttgaattgtccggtatcccttttgtaggctgcgatattcaaagctcagcaatttgtatggacaaatcgttgacatacatcgttgcgaaaaatgctgggatagctactcccgccttttgggttattaataaagatgataggccggtggcagctacgtttacctatcctgtttttgttaagccggcgcgttcaggctcatccttcggtgtgaaaaaagtcaatagcgcggacgaattggactacgcaattgaatcggcaagacaatatgacagcaaaatcttaattgagcaggctgtttcgggctgtgaggtcggttgtgcggtattgggaaacagtgccgcgttagttgttggcgaggtggaccaaatcaggctgcagtacggaatctttcgtattcatcaggaagtcgagccggaaaaaggctctgaaaacgcagttataaccgttcccgcagacctttcagcagaggagcgaggacggatacaggaaacggcaaaaaaaatatataaagcgctcggctgtagaggtctagcccgtgtggatatgtttttacaagataacggccgcattgtactgaacgaagtcaatactctgcccggtttcacgtcatacagtcgttatccccgtatgatggccgctgcaggtattgcacttcccgaactgattgaccgcttgatcgtattagcgttaaaggggtgataagcatggaaataggatttacttttttagatgaaatagtacacggtgttcgttgggacgctaaatatgccacttgggataatttcaccggaaaaccggttgacggttatgaagtaaatcgcattgtagggacatacgaattggcttgaatcgctttttgaagg

SEQ ID NO: 1052 - DNA, 1237 bp, Enterococcus faecium
  strain R492
tcccccggcatacggcctattataccgagcaagcgttgcgtgataccgttgaaaaaaccattaaaaactgtttggattttgaaaggagacaggagcatgaatagaataaaagttgcaatactgtttgggggttgctcagaggagcatgacgtatcggtaaaatctgcaatagagatagccgctaacattaataaagaaaaatacgagccgttatacattggaattacgaaatctggtgtatggaaaatgtgcgaaaaaccttgcgcggaatgggaaaacgacaattgctattcagctgtactctcgccggataaaaaaatgcacggattacttgttaaaaagaaccatgaatatgaaatcaaccatgttgatgtagcattttcagctttgcatggcaagtcaggtgaagatggatccatacaaggtctgtttgaattgtccggtatcccttttgtaggctgcgatattcaaagctcagcaatttgtatggacaaatcgttgacatacatcgttgcgaaaaatgctgggatagctactcccgccttttgggttattaataaagatgataggccggtggcagctacgtttacctatcctgtttttgttaagccggcgcgttcaggctcatccttcggtgtgaaaaaagtcaatagcgcggacgaattggactacgcaattgaatcggcaagacaatatgacagcaaaatcttaattgagcaggctgtttcgggctgtgaggtcggttgtgcggtattgggaaacagtgccgcgttagctgttggcgaggtggaccaaatcaggctgcagtacggaatctttcgtattcatcaggaagtcgagccggaaaaaggctctgaaaacgcagttataaccgttcccgcagacctttcagcagaggagcgaggacggatacaggaaacggcaaaaaaaatatataaagcgctcggctgtagaggtctagcccgtgtggatatgtttttacaagataacggccgcattgtactgaacgaagtcaatactctgcccggtttcacgtcatacagtcgttatccccgtatgatggccgctgcaggtattgcacttcccgaactgattgaccgcttgatcgtattagcgttaaaggggtgataagcatggaaataggatttacttttttagatgaaatagtacacggtgttcgttgggacgctaaatatgccacttgggataatttcaccggaaaaccggttgacggtta

SEQ ID NO: 1053 - DNA, 1263 bp, Enterococcus faecium
  strain R581
catacggcctattataccgagcaagcgttgcgtgataccgttgaaaaaaccattaaaaactgtttggattttgaaaggagacaggagcatgaatagaataaaagttgcaatactgtttgggggttgctcagaggagcatgacgtatcggtaaaatctgcaatagagatagccgctaacattaataaagaaaaatacgagccgttatacattggaattacgaaatctggtgtatggaaaatgtgcgaaaaaccttgcgcggaatgggaaaacgacaattgctattcagctgtactctcgccggataaaaaaatgcacggattacttgttaaaaagaaccatgaatatgaaatcaaccatgttgatgtagcattttcagctttgcatggcaagtcaggtgaagatggatccatacaaggtctgtttgaattgtccggtatcccttttgtaggctgcgatattcaaagctcagcaatttgtatggacaaatcgttgacatacatcgttgcgaaaaatgctgggatagctactcccgccttttgggttattaataaagatgataggccggtggcagctacgtttacctatcctgtttttgttaagccggcgcgttcaggctcatccttcggtgtgaaaaaagtcaatagcgcggacgaattggactacgcaattgaatcggcaagacaatatgacagcaaaatcttaattgagcaggctgtttcgggctgtgaggtcggttgtgcggtattgggaaacagtgccgcgttagctgttggcgaggtggaccaaatcaggctgcagtacggaatctttcgtattcatcaggaagtcgagccggaaaaaggctctgaaaacgcagttataaccgttcccgcagacctttcagcagaggagcgaggacggatacaggaaacggcaaaaaaaatatataaagcgctcggctgtagaggtctagcccgtgtggatatgtttttacaagataacggccgcattgtactgaacgaagtcaatactctgcccggtttcacgtcatacagtcgttatccccgtatgatggccgctgcaggtattgcacttcccgaactgattgaccgcttgatcgtattagcgttaaaggggtgataagcatggaaataggatttacttttttagatgaaatagtacacggtgttcgttgggacgctaaatatgccacttgggataatttcaccggaaaaccggttgacgggtatgaaagtaaatcgcattgtagggacattcgaatt

SEQ ID NO: 1054 - DNA, 1232 bp, Enterococcus faecalis
  strain R610
  misc_feature (1)...(1232): n=a,t,c or g
cggcctattatnccgagcaagcgttgcgtgataccgttgaaaaaaccattaaaaactgtttggattttgaaaggagacaggagcatgaatagaataaaagttgcaatactgtttgggggttgctcagaggagcatgacgtatcggtaaaatctgcaatagagatagccgctaacattaataaagaaaaatacgagccgttatacattggaattacgaaatctggtgtatggaaaatgtgcgaaaaaccttgcgcggaatgggaaaacgacaattgctattcagctgtactctcgccggataaaaaaatgcacggattacttgttaaaaagaaccatgaatatgaaatcaaccatgttgatgtagcattttcagctttgcatggcaagtcaggtgaagatggatccatacaaggtctgtttgaattgtccggtatcccttttgtaggctgcgatattcaaagctcagcaatttgtatggacaaatcgttgacatacatcgttgcgaaaaatgctgggatagctactcccgccttttgggttattaataaagatgataggccggtggcagctacgtttacctatcctgtttttgttaagccggcgcgttcaggctcatccttcggtgtgaaaaaagtcaatagcgcggacgaattggactacgcaattgaatcggcaagacaatatgacagcaaaatcttaattgagcaggctgtttcgggctgtgaggtcggttgtgcggtattgggaaacagtgccgcgttagttgttggcgaggtggaccaaatcaggctgcagtacggaatctttcgtattcatcaggaagtcgagccggaaaaaggctctgaaaacgcagttataaccgttcccgcagacctttcagcagaggagcgaggacggatacaggaaacggcaaaaaaaatatataaagcgctcggctgtagaggtctagcccgtgtggatatgtttttacaagataacggccgcattgtactgaacgaagtcaatactctgcccggtttcacgtcatacagtcgttatccccgtatgatggccgctgcaggtattgcacttcccgaactgattgaccgcttgatcgtattagcgttaaaggggtgataagcatggaaataggatttacttttttagatgaaatagtacacggtgttcgttgggacgctaaatatgccacttgggataatttcaccggaaaaccggttgacggttataagtaa

SEQ ID NO: 1055 - DNA, 1218 bp, Enterococcus gallinarum
  strain R684
taccgagcaagcgttgcgtgataccgttgaaaaaaccattaaaaactgtttggattttgaaaggagacaggagcatgaatagaataaaagttgcaatactgtttgggggttgctcagaggagcatgacgtatcggtaaaatctgcaatagagatagccgctaacattaataaagaaaaatacgagccgttatacattggaattacgaaatctggtgtatggaaaatgtgcgaaaaaccttgcgcggaatgggaaaacgacaattgctattcagctgtactctcgccggataaaaaaatgcacggattacttgttaaaaagaaccatgaatatgaaatcaaccatgttgatgtagcattttcagctttgcatggcaagtcaggtgaagatggatccatacaaggtctgtttgaattgtccggtatcccttttgtaggctgcgatattcaaagctcagcaatttgtatggacaaatcgttgacatacatcgttgcgaaaaatgctgggatagctactcccgccttttgggttattaataaagatgataggccggtggcagctacgtttacctatcctgtttttgttaagccggcgcgttcaggctcatccttcggtgtgaaaaaagtcaatagcgcggacgaattggactacgcaattgaatcggcaagacaatatgacagcaaaatcttaattgagcaggctgtttcgggctgtgaggtcggttgtgcggtattgggaaacagtgccgcgttagctgttggcgaggtggaccaaatcaggctgcagtacggaatctttcgtattcatcaggaagtcgagccggaaaaaggctctgaaaacgcagttataaccgttcccgcagacctttcagcagaggagcgaggacggatacaggaaacggcaaaaaaaatatataaagcgctcggctgtagaggtctagcccgtgtggatatgtttttacaagataacggccgcattgtactgaacgaagtcaatactctgcccggtttcacgtcatacagtcgttatccccgtatgatggccgctgcaggtattgcacttcccgaactgattgaccgcttgatcgtattagcgttaaaggggtgataagcatggaaataggatttacttttttagatgaaatagtacacggtgttcgttgggacgctaaatatgccacttgggataatttcaccggaaaaccggttgacggttagaa

SEQ ID NO: 1056 - DNA, 1265 bp, Enterococcus faecium
  strain R688
aatcacaccgcatacggcctattataccgagcaagcgttgcgtgataccgttgaaaaaaccattaaaaactgtttggattttgaaaggagacaggagcatgaatagaataaaagttgcaatactgtttgggggttgctcagaggagcatgacgtatcggtaaaatctgcaatagagatagccgctaacattaataaagaaaaatacgagccgttatacattggaattacgaaatctggtgtatggaaaatgtgcgaaaaaccttgcgcggaatgggaaaacgacaattgctattcagctgtactctcgccggataaaaaaatgcacggattacttgttaaaaagaaccatgaatatgaaatcaaccatgttgatgtagcattttcagctttgcatggcaagtcaggtgaagatggatccatacaaggtctgtttgaattgtccggtatcccttttgtaggctgcgatattcaaagctcagcaatttgtatggacaaatcgttgacatacatcgttgcgaaaaatgctgggatagctactcccgccttttgggttattaataaagatgataggccggtggcagctacgtttacctatcctgtttttgttaagccggcgcgttcaggctcatccttcggtgtgaaaaaagtcaatagcgcggacgaattggactacgcaattgaatcggcaagacaatatgacagcaaaatcttaattgagcaggctgtttcgggctgtgaggtcggttgtgcggtattgggaaacagtgccgcgttagctgttggcgaggtggaccaaatcaggctgcagtacggaatctttcgtattcatcaggaagtcgagccggaaaaaggctctgaaaacgcagttataaccgttcccgcagacctttcagcagaggagcgaggacggatacaggaaacggcaaaaaaaatatataaagcgctcggctgtagaggtctagcccgtgtggatatgtttttacaagataacggccgcattgtactgaacgaagtcaatactctgcccggtttcacgtcatacagtcgttatccccgtatgatggccgctgcaggtattgcacttcccgaactgattgaccgcttgatcgtattagcgttaaaggggtgataagcatggaaataggatttacttttttagatgaaatagtacacggtgttcgttgggacgctaaatatgccacttgggataatttcaccggaaaaccggttgacggttatgaagtaaatcgcattgtagggacat

SEQ ID NO: 1057 - DNA, 1269 bp, Enterococcus flavescens
  strain R689
tcacaccgcatacggcctattataccgagcaagcgttgcgtgataccgttgaaaaaaccattaaaaactgtttggattttgaaaggagacaggagcatgaatagaataaaagttgcaatactgtttgggggttgctcagaggagcatgacgtatcggtaaaatctgcaatagagatagccgctaacattaataaagaaaaatacgagccgttatacattggaattacgaaatctggtgtatggaaaatgtgcgaaaaaccttgcgcggaatgggaaaacgacaattgctattcagctgtactctcgccggataaaaaaatgcacggattacttgttaaaaagaaccatgaatatgaaatcaaccatgttgatgtagcattttcagctttgcatggcaagtcaggtgaagatggatccatacaaggtctgtttgaattgtccggtatcccttttgtaggctgcgatattcaaagctcagcaatttgtatggacaaatcgttgacatacatcgttgcgaaaaatgctgggatagctactcccgccttttgggttattaataaagatgataggccggtggcagctacgtttacctatcctgtttttgttaagccggcgcgttcaggctcatccttcggtgtgaaaaaagtcaatagcgcggacgaattggactacgcaattgaatcggcaagacaatatgacagcaaaatcttaattgagcaggctgtttcgggctgtgaggtcggttgtgcggtattgggaaacagtgccgcgttagctgttggcgaggtggaccaaatcaggctgcagtacggaatctttcgtattcatcaggaagtcgagccggaaaaaggctctgaaaacgcagttataaccgttcccgcagacctttcagcagaggagcgaggacggatacaggaaacggcaaaaaaaatatataaagcgctcggctgtagaggtctagcccgtgtggatatgtttttacaagataacggccgcattgtactgaacgaagtcaatactctgcccggtttcacgtcatacagtcgttatccccgtatgatggccgctgcaggtattgcacttcccgaactgattgaccgcttgatcgtattagcgttaaaggggtgataagcatggaaataggatttacttttttagatgaaatagtacacggtgttcgttgggacgctaaatatgccacttgggataatttcaccggaaaaccggttgacggttatgaagtaaatcgcattgtagggacatacgaat

SEQ ID NO: 1058 - DNA, 1169 bp, Enterococcus gallinarum
  strain R420
caaattttcttttcttttcctaggtacactgaatgtaaccttaaaagaaaaaaggaaaggaagaaaatgatgaaaaaaattgccgttttatttggagggaattctccagaatactcagtgtcactaacctcagcagcaagtgtgatccaagctattaacccgctgaaatatgaagtaatgaccattggcatcgcaccaacaatggattggtattggtatcaaggaaacctcgcgaatgttcgcaatgatacttggctagaagatcacaaaaactgtcaccagctgactttttctagccaaggatttatattaggagaaaaacgaatcgtccctgatgtcctctttccagtcttgcatgggaagtatggcgaggatggctgtatccaaggactgcttgaactaatgaacctgccttatgttggttgccatgtcgctgcctccgcattatgtatgaacaaatggctcttgcatcaacttgctgataccatgggaatcgctagtgctcccactttgcttttatcccgctatgaaaacgatcctgccacaatcgatcgttttattcaagaccatggattcccgatctttatcaagccgaatgaagccggttcttcaaaagggatcacaaaagtaactgacaaaacagcgctccaatctgcattaacgactgcttttgcttacggttctactgtgttgatccaaaaggcgatagcgggtattgaaattggctgcggcatcttaggaaatgagcaattgacgattggtgcttgtgatgcgatttctcttgtcgacggtttttttgattttgaagagaaataccaattaatcagcgccacgatcactgtcccagcaccattgcctctcgcgcttgaatcacagatcaaggagcaggcacagctgctttatcgaaacttgggattgacgggtctggctcgaatcgattttttcgtcaccaatcaaggagcgatttatttaaacgaaatcaacaccatgccgggatttactgggcactcccgctacccagctatgatggcggaagtcgggttatcctacgaaatattagtagagcaattgattgcactggcagaggaggacaaacgatgaacacattacaattgatcaataaaaaccatccattgaaaaaaaatcaagagcccccgcacttagtgcta

SEQ ID NO: 1059 - DNA, 1166 bp, Enterococcus gallinarum
  strain R631
caaattttcttttcttttcctaggtacactgaatgtaaccttaaaagaaaaaaggaaaggaagaaaatgatgaaaaaaattgccgttttatttggagggaattctccagaatactcagtgtcactagcctcagcagcaagtgtgatccaagctattgacccgctgaaatatgaagtaatgaccattggcatcgcaccaacaatggattggtattggtatcaaggaaacctcgcgaatgttcgcaatgatacttggctagaagatcacaaaaactgtcaccagctgactttttctagccaaggatttatattaggagaaaaacgaatcgtccctgatgtcctctttccagtcttgcatgggaagtatggcgaggatggctgtatccaaggactgcttgaactaatgaacctgccttatgttggttgccatgtcgctgcctccgcattatgtatgaacaaatggctcttgcatcaacttgctgataccatgggaatcgctagtgctcccactttgcttttatcccgctatgaaaacgatcctgccacaatcgatcgttttattcaagaccatggattcccgatctttatcaagccgaatgaagccggttcttcaaaagggatcacaaaagtaactgacaaaacagcgctccaatctgcattaacgactgcttttgcttacggttctactgtgttgatccaaaaggcgatagcgggtattgaaattggctgcggcatcttaggaaatgagcaattgacgattggtgcttgtgatgcgatttctcttgtcgacggtttttttgattttgaagagaaataccaattaatcagcgccacgatcactgtcccagcaccattgcctctcgcgcttgaatcacagatcaaggagcaggcacagctgctttatcgaaacttgggattgacgggtctggctcgaatcgattttttcgtcaccaatcaaggagcgatttatttaaacgaaatcaacaccatgccgggatttactgggcactcccgctacccagctatgatggcggaagtcgggttatcctacgaaatattagtagagcaattgattgcactggcagaggaggacaaacgatgaacacattacaattgatcaataaaaaccatccattgaaaaaaaatcaagagcccccgcacttagtg

SEQ ID NO: 1060 - DNA, 1028 bp, Enterococcus casseliflavus
  ref <308>: DATABASE ACCESSION NUMBER: ATCC 25788
aacatgaaaaaaatcgccttatttttggaggcaattcaccggaatacaccgtttctttagcttcagcaactagcgcaatcgaagcactccaatcatctccctatgactacgacctctctttgatcgggatcgccccagatgctatggattggtacttgtatacaggagaactggaaaacatccgacaagacacgtggttgttggatacgaaacataaacagaaaatacagccgctattcgaaggaaacggcttttggctaagtgaagagcagcaaacgttggtacctgatgttttatttcccattatgcatggcaaatacggggaagatggcagtatccaaggattgtttgaattgatgaagctgccttatgtaggctgcggggtggcaggttctgccttatgtatgaacaaatggctgctgcatcaagctgcagcagccattggcgtacaaagtgctcctacgattctcttgacaaatcaagccaaccagcaagaacaaatcgaagcttttatccagacccatggcttcccagttttctttaagcctaatgaagcgggctcctcaaaagggatcactaaagtcacctgcgttgaagaaatcgcttctgccttaaaagaagcctttacttattgttccgcagtgctcctacaaaaaaatattgccggtgttgagatcggttgcggtattttgggcaacgactctttgactgtcggtgcttgtgacgccatttcattagtagacggctttttcgattttgaagaaaagtaccagctgatcagcgccaaaatcaccgtccctgcgccattgcctgaaacgattgaaaccaaggtcaaagaacaagctcagctgctctatcgtagtcttggtcttaaaggtcttgctcgcatcgacttttttgtcacggagcgaggagaactatacttgaatgaaatcaatactatgccgggctttacgagtcactcccgctatcctgccatgatggcagcggtcggcttatcctatcaagaactactacaaaaactgctt

SEQ ID NO: 1061 - DNA, 1030 bp, Enterococcus casseliflavus
  strain R689
aatatgaaaaaaatcgccttatttttggaggcaattcaccggagtacgccgtttctttagcctcagcaactagcgcaatcgaagcactccaatcatctcccgatgactatgacctctctttgatcgggatcgccccagatgctatggattggtatttgtatacaggagaactggaaaacatccgacaagacacgtggttgttggatacgaaacataaacagaaaatccagccgctttttgaaggaaacggcttttggctaagtgaagagcaacaaacgttggttcctgatgttttatttcccattatgcatggcaaatacggggaagatggcagtatccaaggattgtttgaattgatgaaactaccttatgtaggctgcggggtggcagcctctgccttatgtatgaacaaatggctgctgcatcaagcagcagaagcgattggcgtacaaagtgctcctacgattctcttgacaaatcaagccaaccagcaagatcaaatcgaagcttttatccagacccatggctttccggttttttttaagcctaatgaagcgggctcctcaaaagggatcactaaagtcacctgcgttgaagaaatcgcttctgccttaaaagaagcctttacttattgttcagcagtgctcctacaaaaaaatattgccggtgttgagatcggttgcggtattttgggcaacgactctttgactgtcggtgcttgtgacgctatttcattagtagacggctttttcgattttgaagaaaagtaccagctgatcagcgccaagatcaccgttcctgcaccattgcctgaaacgattgaaaccaaggtcaaagaacaagctcagctgctctatcgtagtctttgtcttaaaggtcttgctcgcatcgacttttttgtcacggatcaaggagaactatacttgaatgaaatcaatactatgccgggctttacgagtcactcccgctatcctgccatgatggcagcgatcggcttatcctatcaagaactactacaaaaactgcttgt

SEQ ID NO: 1062 - DNA, 1031 bp, Enterococcus casseliflavus
  strain R754
aaacatgaaaaaaatcgccattatttttggaggcaattcaccggaatacaccgtttctttagcttcagcaactagcgcaatcgaagcactccaatcatctccctatgactacgacctctctttgatcgggatcgccccagatgctatggattggtacttgtatacaggagaactggaaaacatccgacaagacacgtggttgttggatacgaaacataaacagaaaatacagccgctattcgaaggaaacggcttttggctaagtgaagagcagcaaacgttggtacctgatgttttatttcccattatgcatggcaaatacggggaagatggcagtatccaaggattgtttgaattgatgaagctgccttatgtaggctgcggggtggcaggttctgccttatgtatgaacaaatggctgctgcatcaagctgcagcagccattggcgtacaaagtgctcctacgattctcttgacaaatcaagccaaccagcaagaacaaatcgaagcttttatccagacccatggcttcccagttttctttaagcctaatgaagcgggctcctcaaaagggatcactaaagtcacctgcgttgaagaaatcgcttctgccttaaaagaagcctttacttattgttccgcagtgctcctacaaaaaaatattgccggtgttgagatcggttgcggtattttgggcaacgactctttgactgtcggtgcttgtgacgccatttcattagtagacggctttttcgattttgaagaaaagtaccagctgatcagcgccaaaatcaccgtccctgcgccattgcctgaaacgattgaaaccaaggtcaaagaacaagctcagctgctctatcgtagtcttggtcttaaaggtcttgctcgcatcgacttttttgtcacggagcgaggagaactatacttgaatgaaatcaatactatgccgggctttacgagtcactcccgctatcctgccatgatggcagcggtcggcttatcctatcaagaactactacaaaaactgcttg

SEQ ID NO: 1063 - DNA, 1030 bp, Enterococcus casseliflavus
  strain R775
aacatgaaaaaaatcgccattatttttggaggcaattcaccggaatacaccgtttctttagcttcagcaactagcgcaatcgaagcactccaatcatctccctatgactacgacctctctttgatcgggatcgccccagatgctatggattggtacttgtatacaggagaactggaaaacatccgacaagacacgtggttgttggatacgaaacataaacagaaaatacagccgctatttgaaggaaacggcttttggctaagtgaagagcagcaaacgttagtacctgatattttatttcccattatgcatggcaaatacggggaagatggcagtatccaaggattgtttgaattgatgaaactaccttatgtaggttgcggggtggcaggttctgccttatgtatgaacaaatggctgctgcatcaagctgcagcagccattggcgtacaaagtgctcctacgattctcttgacaaatcaagccaaccagcaagaacaaatcgaagcttttatccagacccatggcttcccagttttctttaagcctaatgaagcgggctcttcaaaagggatcactaaagtcacctgcgttgaagaaatcgcttctgccttaaaaaaagcctttacttattgttccgcagtgctcctacaaaaaaatattgccggtgttgagatcggttgcggtattttgggcaacgactctttgactgtcggtgcttgtgacgccatttcattagtagacggctttttcgattttgaagaaaagtaccagctgatcagcgccaaaatcaccgtccctgcgccattgcctgaaacgattgaaaccaaggtcaaagaacaagctcagctgctctatcgtagtcttggtcttaaaggtcttgctcgcatcgacttttttgtcacggatcaaggagaactatacttgaatgaaatcaatactatgccgggctttacgagtcactcccgttatcctgccatgatggcagcggtcggcttatcctatcaagaactactacaaaaactgcttg

SEQ ID NO: 1064 - DNA, 1032 bp, Enterococcus flavescens
  ref <308>: DATABASE ACCESSION NUMBER: ATCC 49996
aaacatgaaaaaaatcgccattatttttggaggcaattcaccggaatacaccgtttctttagcttcagcaactagcgcaatcgaagcactccaatcatctccctatgactacgacctctctttgatcgggatcgccccagatgctatggattggtacttgtatacaggagaactggaaaacatccgacaagacacgtggttgttggatacgaaacagaaacagaaaatacagccgctattcgaaggaaacggcttttggttaagtgaagagcagcaaacgttggtacctgatgttttatttcccattatgcatggcaaatacggggaagatggcagtatccaaggattgtttgaattgatgaagctaccttatgtaggctgcggggtggcaggttctgccttatgtatgaacaaatggttgctgcatcaagctgcagcagccattggcgtacaaagtgctcctacgattctcttgacaaatcacgccaaccagcaagaacaaatcgaagcttttatccagacccatggctttccagttttctttaagcctaatgaagcgggttcctcaaaagggatcactaaagtcacctgcgttgaagaaatcgcttctgccttaaaagaagcctttacttattgttccgcagtgctcctacaaaaaaatattgccggtgttgagatcggttgcggtattttgggcaacgactctttgactgtcggtgcttgtgacgccatttcattagtagacggctttttcgattttgaagaaaagtaccagctgatcagcgccaaaatcaccgtccctgcgccattgcctgaaacgattgaaactaaggtcaaagaacaagctcagctgctctatcgtagtcttggacttaaaggtcttgctcgcatcgacttttttgtcacggatcaaggagaactatacttgaatgaaatcaatactatgccgggctttacgagtcactcccgctatcctgccatgatggcagcggtcgggttatcctatcaagaactactacaaaaactacttgt

SEQ ID NO: 1065 - DNA, 1034 bp, Enterococcus flavescens
  strain R758
aaaaacatgaaaaaaatcgccattatttttggaggcaattcaccggaatacaccgtttctttagcttcagcaactagcgcaatcgaagcactccaatcatctccctatgactacgacctctctttgatcgggatcgccccagatgctatggattggtacttgtatacaggagaactggaaaacatccgacaagacacgtggttgttggatacgaaacataaacagaaaatacagccgctattcgaaggaaacggcttttggctaagtgaagagcagcaaacgttggtacctgatgttttatttcccattatgcatggcaaatacggggaagatggcagtatccaaggattgtttgaattgatgaagctgccttatgtaggctgcggggtggcaagttctgccttatgtatgaacaaatggctgctgcatcaagctgcagcagccattggcgtacaaagtgctcctacgattctcttgacaaatcaagccaaccagcaagaacaaatcgaagcttttatccagacccatggctttccagttttctttaagcctaatgaagcgggctcctcaaaagggatcactaaagtcacctgcgttgaagaaatcgcttctgccttaaaagaagcctttacttattgttccgcagtgctcctacaaaaaaatattgccggtgttgagatcggttgcggtattttgggcaacgactctttgactgtcggtgcttgtgacgccatttcattagtagacggctttttcgattttgaagaaaagtaccagctgatcagcgccaaaatcaccgtccctgcgccattgcctgaaacgattgaaaccaaggtcaaagaacaagctcagctgctctatcgtagtcttggtcttaaaggtcttgctcgcatcgacttttttgtcacggatcaaggagaactatacttgaatgaaatcaatactatgccgggctttacgagtcactcccgctatcctgccatgatggcagcggtcggcttatcctatcaagaactactacaaaaactgcttgt

SEQ ID NO: 1066 - DNA, 1012 bp, Enterococcus flavescens
  strain R760
catgaaaaaaatcgccattatttttggaggcaattcaccggaatacaccgtttctttagcctcagcaactagcgcaatcgaagcactccaatcatctccctatgattacgacctctctttgatcgggatcgccccagatgctatggattggtacttgtatacaggagaactggaaaacatccgacaagacacgtggttgttggatacgaaacatacacagaaaatccagccactttttgaaggaaacggcttttggataagtgaagcgcagcaaacgttggtacctgatgttttatttcccattatgcatggtaaatacggggaagatggcagtatccaaggattgtttgaattgatgaagctgccttatgtaggctgtggggtggcagcctctgccttatgtatgaacaaatggttattgcatcaagcagcagcagcgattggcgtacaaagcgctcctacgattctcttgacaaatcaagccaaccagcaaagacaaatcgaagcctttatccagacccatggctttccagttttctttaagcctaatgaagcgggctcctcaaaagggatcacaaaagtaacttgtgttgaagaaatcgctcctgccttgaaggaagccttcgcttattgttccgcagtgctcttacaaaaaaatatcgctggcgttgagattggttgcggtatcttaggcaacgactctttgactgtcggtgcttgtgacgctatttcattagtagacggctttttcgattttgaagaaaagtaccagttgatcagcgccaaaatcaccgttcctgcgccattgcctgaaacgattgaaaccaaagtcaaagaacaagctcagctgctctatcacagtcttggtcttaaaggacttgctcgcatcgacttttttgtcacggatcaaggagaactatacttgaatgaaatcaatactatgccgggctttacgagtcactcccgctatcctgccatgatggcagcggtcggcttatcctatcaagaatta

SEQ ID NO: 1067 - DNA, 721 bp, Enterococcus faecium
  strain R481
  misc_feature (1)...(721): n=a,t,c or g
cttacgctttatcgattagacacgggnagcttgtccaatgggragccgatttgattttatggatgaacgctctcatcatgcggcaaatggaatatcatgcaatgaagcgcaaaatcgcagacgtttgcgctccatcatggaaaacagtgggtttgaagcatatagcctcgaatggtggcactatgtattaagagacgaaccataccccaatagctattttgatttccccgttaaataaacttttaaccgttgcacggacaaactatataagctaactctttcggcaggaaacccgacgtatgtaactggttcttagggaatttatatatagtagatagtattgaagatgtaaggcagagcgatattgcggtcattatctgcgtgcgctgcggcaagatagcctgataataagactgatcgcatagaggggtggtatttcacaccgcccattgtcaacaggcagttcagcctcgttaaattcagcatgggtatcacttatgaaaattcatctacattggtgataatagtaaatccagtagggcgaaataattgactgtaatttacggggcaaaacggcacaatctcaaacgagattgtgccgtttaaggggaagattctagaaatatttcatacttccaactatatagttaaggaggagactgaaaatgaagaagttgttttttttattgttattgttattcttaatatacttaggttattg

SEQ ID NO: 1068 - DNA, 668 bp, Enterococcus faecium
  strain R492
atttttaaggatgaacgctcttcatcatgcggcaaatggaatatcatgcaatgaagcgcaaaatcgcagacgtttgcgctccatcatggaaaacagtgggtttgaagcatatagcctcgaatggtggcactatgtattaagagacgaaccataccccaatagctattttgatttccccgttaaataaacttttaaccgttgcacggacaaactatataagctaactctttcggcaggaaacccgacgtatgtaactggttcttagggaatttatatatagtagatagtattgaagatgtaaggcagagcgatattgcggtcattatctgcgtgcgctgcggcaagatagcctgataataagactgatcgcatagaggggtggtatttcacaccgcccattgtcaacaggcagttcagcctcgttaaattcagcatgggtatcacttatgaaaattcatctacattggtgataatagtaaatccagtagggcgaaataattgactgtaatttacggggcaaaacggcacaatctcaaacgagattgtgccgtttaaggggaagattctagaaatatttcatacttccaactatatagttaaggaggagactgaaaatgaagaagttgttttttttattgttattgttattcttaatatacttaggttat

SEQ ID NO: 1069 - DNA, 760 bp, Enterococcus faecium
  strain R581
  misc_feature (1)...(760): n=a,t,c or g
cggcaagtgccattgatcttacgctttatcgattagacacgggtragcttgtaccaatgggaagccgatttgattttatggatgaacgctctcatcatgcggcaaatggaatatcatgcaatgaagcgcaaaatcgcagacgtttgcgctccatcatggaaaacagtgggtttgaagcatatagcctcgaatggtggcactatgtattaagagacgaaccataccccaatagctattttgatttccccgttaaataaacttttaaccgttgcacggacaaactatataagctaactctttcggcaggaaacccgacgtatgtaactggttcttagggaatttatatatagtagatagtattgaagatgtaaggcagagcgatattgcggtcattatctgcgtgcgctgcggcaagatagcctgataataagactgatcgcatagaggggtggtatttcacaccgcccattgtcaacaggcagttcagcctcgttaaattcagcatgggtatcacttatgaaaattcatctacattggtgataatagtaaatccagtagggcgaaataattgactgtaatttacggggcaaaacggcacaatctcaaacgagattgtgccgtttaaggggaagattctagaaatatttcatacttccaactatatagttaaggaggagactgaaaatgaagaagttgttttttttattgttattgttattcttaatatacttaggttatgactacgttaatgaaancctga

SEQ ID NO: 1070 - DNA, 801 bp, Enterococcus faecalis
  strain R610
  misc_feature (1)...(801): n=a,t,c or g
aaaaggaatacggggctttcaaaaatccaagccataacccgcgggcaagtgccatttgattcttacgctttaatcgattagacacgggtaagcttgtaccaatggggaaccgatttgattttaatgnatgaacgctcttcatcatgcggcaaatggaatatcatgcaatgaagcgcaaaatcgcagacgtttgcgctccatcatggaaaacagtgggtttgaagcatatagcctcgaatggtggcactatgtattaagagacgaaccataccccaatagctattttgatttccccgttaaataaacttttaaccgttgcacggacaaactatataagctaactctttcggcaggaaacccgacgtatgtaactggttcttagggaatttatatatagtagatagtattgaagatgtaaggcagagcgatattgcggtcattatctgcgtgcgctgcggcaagatagcctgataataagactgatcgcatagaggggtggtatttcacaccgcccattgtcaacaggcagttcagcctcgttaaattcagcatgggtatcacttatgaaaattcatctacattggtgataatagtaaatccagtagggcgaaataattgactgtaatttacggggcaaaacggcacaatctcaaacgagattgtgccgtttaaggggaagattctagaaatatttcatacttccaactatatagttaaggaggagactgaaaatgaagaagttgtttttttttattgttattgttattcttaatatacttaggttatgactacgttaatgaa

SEQ ID NO: 1071 - DNA, 711 bp, Enterococcus gallinarum
  strain R684
ttgtaccaatggggagccgatttgattttatggatgaacgctctcatcatgcggcaaatggaatatcatgcaatgaagcgcaaaatcgcagacgtttgcgctccatcatggaaaacagtgggtttgaagcatatagcctcgaatggtggcactatgtattaagagacgaaccataccccaatagctattttgatttccccgttaaataaacttttaaccgttgcacggacaaactatataagctaactctttcggcaggaaacccgacgtatgtaactggttcttagggaatttatatatagtagatagtattgaagatgtaaggcagagcgatattgcggtcattatctgcgtgcgctgcggcaagatagcctgataataagactgatcgcatagaggggtggtatttcacaccgcccattgtcaacaggcagttcagcctcgttaaattcagcatgggtatcacttatgaaaattcatctacattggtgataatagtaaatccagtagggcgaaataattgactgtaatttacggggcaaaacggcacaatctcaaacgagattgtgccgtttaaggggaagattctagaaatatttcatacttccaactatatagttaaggaggagactgaaaatgaagaagttgttttttttattgttattgttattcttaatatacttaggttatgactacgttaatgaagcactg

SEQ ID NO: 1072 - DNA, 751 bp, Enterococcus faecium
  strain R688
  misc_feature (1)...(751): n=a,t,c or g
gccattgatcttacgctttatcgattagacacgggtnagcttgtaccaatggggagccgatttgattttatggatgaacgctctcatcatgcggcaaatggaatatcatgcaatgaagcgcaaaatcgcagacgtttgcgctccatcatggaaaacagtgggtttgaagcatatagcctcgaatggtggcactatgtattaagagacgaaccataccccaatagctattttgatttccccgttaaataaacttttaaccgttgcacggacaaactatataagctaactctttcggcaggaaacccgacgtatgtaactggttcttagggaatttatatatagtagatagtattgaagatgtaaggcagagcgatattgcggtcattatctgcgtgcgctgcggcaagatagcctgataataagactgatcgcatagaggggtggtatttcacaccgcccattgtcaacaggcagttcagcctcgttaaattcagcatgggtatcacttatgaaaattcatctacattggtgataatagtaaatccagtagggcgaaataattgactgtaatttacggggcaaaacggcacaatctcaaacgagattgtgccgtttaaggggaagattctagaaatatttcatacttccaactatatagttaaggaggagactgaaaatgaagaagttgttttttttattgttattgttattcttaatatacttaggttatgactacgttaatgaagcactg

SEQ ID NO: 1073 - DNA, 685 bp, Enterococcus flavescens
  strain R689
atttgattttatggatgaacgctctcatcatgcggcaaatggaatatcatgcaatgaagcgcaaaatcgcagacgtttgcgctccatcatggaaaacagtgggtttgaagcatatagcctcgaatggtggcactatgtattaagagacgaaccataccccaatagctattttgatttccccgttaaataaacttttaaccgttgcacggacaaactatataagctaactctttcggcaggaaacccgacgtatgtaactggttcttagggaatttatatatagtagatagtattgaagatgtaaggcagagcgatattgcggtcattatctgcgtgcgctgcggcaagatagcctgataataagactgatcgcatagaggggtggtatttcacaccgcccattgtcaacaggcagttcagcctcgttaaattcagcatgggtatcacttatgaaaattcatctacattggtgataatagtaaatccagtagggcgaaataattgactgtaatttacggggcaaaacggcacaatctcaaacgagattgtgccgtttaaggggaagattctagaaatatttcatacttccaactatatagttaaggaggagactgaaaatgaagaagttgttttttttattgttattgttattcttaatatacttaggttatgactacgttaatga

SEQ ID NO: 1074 - DNA, 732 bp, Enterococcus faecium
  strain R690
atcgattagacacgggtgagcttgtaccaatggggagccgatttgattttatggatgaacgctctcatcatgcggcaaatggaatatcatgcaatgaagcgcaaaatcgcagacgtttgcgctccatcatggaaaacagtgggtttgaagcatatagcctcgaatggtggcactatgtattaagagacgaaccataccccaatagctattttgatttccccgttaaataaacttttaaccgttgcacggacaaactatataagctaactctttcggcaggaaacccgacgtatgtaactggttcttagggaatttatatatagtagatagtattgaagatgtaaggcagagcgatattgcggtcattatctgcgtgcgctgcggcaagatagcctgataataagactgatcgcatagaggggtggtatttcacaccgcccattgtcaacaggcagttcagcctcgttaaattcagcatgggtatcacttatgaaaattcatctacattggtgataatagtaaatccagtagggcgaaataattgactgtaatttacggggcaaaacggcacaatctcaaacgagattgtgccgtttaaggggaagattctagaaatatttcatacttccaactatatagttaaggaggagactgaaaatgaagaagttgttttttttattgttattgttattcttaatatacttaggttatgactacgttaatgaagcactg

SEQ ID NO: 1075 - DNA, 670 bp, Enterococcus gallinarum
  strain R691
tctcatcatgcggcaaatggaatatcatgcaatgaagcgcaaaatcgcagacgtttgcgctccatcatggaaaacagtgggtttgaagcatatagcctcgaatggtggcactatgtattaagagacgaaccataccccaatagctattttgatttccccgttaaataaacttttaaccgttgcacggacaaactatataagctaactctttcggcaggaaacccgacgtatgtaactggttcttagggaatttatatatagtagatagtattgaagatgtaaggcagagcgatattgcggtcattatctgcgtgcgctgcggcaagatagcctgataataagactgatcgcatagaggggtggtatttcacaccgcccattgtcaacaggcagttcagcctcgttaaattcagcatgggtatcacttatgaaaattcatctacattggtgataatagtaaatccagtagggcgaaataattgactgtaatttacggggcaaaacggcacaatctcaaacgagattgtgccgtttaaggggaagattctagaaatatttcatacttccaactatatagttaaggaggagactgaaaatgaagaagttgttttttttattgttattgttattcttaatatacttaggttatgactacgttaatgaagcactg

SEQ ID NO: 1076 - DNA, 948 bp, Escherichia coli
  strain DG131/3
atgaaaataataatttttagagtgctaacttttttctttgttatcttttctgttaatgtggttgcgaaggaatttaccttagatttctcgacagcaaagacgtatgtagattcgctgaatgtcattcgctctgcaataggtactccattacagactatttcatcaggaggtacgtctttactgatgattgatagtggcacaggggataatttgtttgcagttgatgtcagagggatagatccagaggaagggcggtttaataatctacggcttattgttgaacgaaataatttatatgtgacaggatttgttaacaggacaaataatgttttttatcgctttgctgatttttcacatgttacctttcctggtacaactgcggttacattgtctggtgacagtagctataccacgttacagcgtgttgcggggatcagtcgtacggggatgcagataaatcgccattcgttgactacttcttatctggatttaatgtcgcatagcggaacctcactgacgcagtctgtggcaagagcgatgttacggtttgttactgtgacagctgaagctttacgttttcggcaaattcagaggggatttcgtacaacacttgatgatctcagtgggcgttcttatgtaatgactgctgaagatgttgatcttacgttgaactggggaaggttgagtagtgtcctgcctgactatcatggacaagactctgttcgtgttggaagaatttcttttggaagtgttaatgcaattctgggtagcgtggcattaatactgaattgtcatcatcatgcatcgcgagttgccagaattgtacctaatgagtttccttctatgtgcccggtagatggaagagtgcgtgggattacgcacaataaaatattgtgggactcatccactctgggggcaattttgatacgcagggctattagcagttga

SEQ ID NO: 1077 - DNA, 1259 bp, Escherichia coli
  strain 94C
cacctgtatatgaagtgtatattatttaaatgggtactgtgcctgttactgggtttttcttcggtatcctattcccgggagtttacgatagacttttcgacccaacaaagttatgtctcttcgttaaatagtatacggacagagatatcgacccctcttgaacatatatctcaggggaccacatcggtgtctgttattaaccacaccccaccgggcagttattttgctgtggatatacgagggcttgatgtctatcaggcgcgttttgaccatcttcggctgattattgagcaaaataatttatatgtggccgggttcgttaatacggcaacaaatactttctaccgtttttcagattttacacatatatcagtgcccgatgtgacaacggtttccatgacaacggacagcagttataccactctgcaacgtgtcgcagcgctggaacgttccggaatgcaaatcagtcgtcactcactggtttcatcatatctggcgttaatggagttcagtggtaatacaatgaccagagatgcatccagagcagttctgcgttttgtcactgtcacagcagaagccttacgcttcaggcagatacagagagaatttcgtcaggcactgtctgaaactgctcctgtgtataccatgacgccgggagacgtggacctcactctgaactgggggcgaatcagcaatgtgcttccggagtatcggggagaggatggtgtcagagtggggagaatatcctttaataatatatcagcgatactgggtactgtggccgttatactgaattgccatcatcagggggcgcgttctgttcgcgccgtgaatgaagagagtcaaccagaatgtcagataactggcgacaggcccgttataaaaataaacaatacattatgggaaagtaatacagctgcagcgtttctgaacagaaagtcacagtttttatatacaacgggtaaataaaggagttaagtatgaagaagatgtttatggcggttttatttgcattagtttctgttaatgcaatggcggcggattgtgctaaaggtaaaattgagttttccaagtataatgaggatgacacatttacagtgaaggttgacgggaaagaatactggaccagtcgctggaatctgcaaccgttactgcaaagtgctcagctgacaggaatgactgtcacaatcaaatccagtacctgtgaatcaggctccggatttgctgaagtgcagtttaataatgactgaggcataacc

SEQ ID NO: 1078 - DNA, 22 bp, Artificial Sequence
  Synthetic DNA Sequence
agttctgcgttttgtcactgtc

SEQ ID NO: 1079 - DNA, 19 bp, Artificial Sequence
  Synthetic DNA Sequence
cggaagcacattgctgatt

SEQ ID NO: 1080 - DNA, 25 bp, Artificial Sequence
  Synthetic DNA Sequence
tatagctactgtcaccagacaatgt

SEQ ID NO: 1081 - DNA, 20 bp, Artificial Sequence
  Synthetic DNA Sequence
atgtcagagggatagatcca

SEQ ID NO: 1082 - DNA, 23 bp, Artificial Sequence
  Synthetic DNA Sequence
ttgarcraaataatttatatgtg

SEQ ID NO: 1083 - DNA, 20 bp, Artificial Sequence
  Synthetic DNA Sequence
tgatgatgrcaattcagtat

SEQ ID NO: 1084 - DNA, 39 bp, Artificial Sequence
  Synthetic DNA Sequence
ccacgccgctttgctgatttttcacatgttaccgcgtgg

SEQ ID NO: 1085 - DNA, 34 bp, Artificial Sequence
  Synthetic DNA Sequence
ccacgccactgtctgaaactgctcctgtgcgtgg

SEQ ID NO: 1086 - DNA, 20 bp, Artificial Sequence
  Synthetic DNA Sequence
ctactcccgccttttgggtt

SEQ ID NO: 1087 - DNA, 20 bp, Artificial Sequence
  Synthetic DNA Sequence
ctcacagcccgaaacagcct

SEQ ID NO: 1088 - DNA, 20 bp, Artificial Sequence
  Synthetic DNA Sequence
tgccgtttcctgtatccgtc

SEQ ID NO: 1089 - DNA, 20 bp, Artificial Sequence
  Synthetic DNA Sequence
atccacacgggctagacctc

SEQ ID NO: 1090 - DNA, 21 bp, Artificial Sequence
  Synthetic DNA Sequence
aatagcgcggacgaattggac

SEQ ID NO: 1091 - DNA, 20 bp, Artificial Sequence
  Synthetic DNA Sequence
aacgcggcactgtttcccaa

SEQ ID NO: 1092 - DNA, 21 bp, Artificial Sequence
  Synthetic DNA Sequence
tcggcaagacaatatgacagc

SEQ ID NO: 1093 - DNA, 381 bp, Staphylococcus saprophyticus
  strain CSsa-165
taacgggcgtctcgatagaaaaacacgtgaaaatcccaatgattataaacaatcaatatacgattttgctgaagctgtaacaaaaggtattaaggaacaaacaaataaaaattaataggcaacttaaccagaatcgttaaaactatatgacgattctggttttttaaattcaaaaagttttctaaaaaatttacctgcttttttaaagtataggtataaaatacaattgattaaaatagtaaaggaaatgaatcatgaaacaattaactaagcctttatacttttacctattactttttattacaacaacactgattggcgcgttactattatatttgccaatcacaggtaaacatcctattgattttgtggacgcccgtt

SEQ ID NO: 1094 - DNA, 23 bp, Artificial Sequence
  Synthetic DNA Sequence
ggtaaaacaggtacttctaacta

SEQ ID NO: 1095 - DNA, 20 bp, Artificial Sequence
  Synthetic DNA Sequence
cgatagaagcagcaggacaa

SEQ ID NO: 1096 - DNA, 20 bp, Artificial Sequence
  Synthetic DNA Sequence
ctgatggatgcggaagatac

SEQ ID NO: 1097 - DNA, 26 bp, Artificial Sequence
  Synthetic DNA Sequence
tcytcaaaagggatcacwaaagtmac

SEQ ID NO: 1098 - DNA, 23 bp, Artificial Sequence
  Synthetic DNA Sequence
tcttcaaaatcgaaaaagccgtc

SEQ ID NO: 1099 - DNA, 23 bp, Artificial Sequence
  Synthetic DNA Sequence
tcaaaagggatcacwaaagtmac

SEQ ID NO: 1100 - DNA, 26 bp, Artificial Sequence
  Synthetic DNA Sequence
gtaaakcccggcatrgtrttgatttc

SEQ ID NO: 1101 - DNA, 23 bp, Artificial Sequence
  Synthetic DNA Sequence
gacggytttttygattttgaaga

SEQ ID NO: 1102 - DNA, 23 bp, Artificial Sequence
  Synthetic DNA Sequence
aaaaartcgatkcgagcmagacc

SEQ ID NO: 1103 - DNA, 20 bp, Artificial Sequence
  Synthetic DNA Sequence
atcccgctatgaaaacgatc

SEQ ID NO: 1104 - DNA, 20 bp, Artificial Sequence
  Synthetic DNA Sequence
ggatcaacacagtagaaccg

SEQ ID NO: 1105 - DNA, 25 bp, Artificial Sequence
  Synthetic DNA Sequence
ctcctacgattctcttgayaaatca

SEQ ID NO: 1106 - DNA, 23 bp, Artificial Sequence
  Synthetic DNA Sequence
caaccgatctcaacaccggcaat

SEQ ID NO: 1107 - DNA, 23 bp, Artificial Sequence
  Synthetic DNA Sequence
ctcatttgacttcctcctttgct

SEQ ID NO: 1108 - DNA, 23 bp, Artificial Sequence
  Synthetic DNA Sequence
gtaagaatcggaaaagcggaagg

SEQ ID NO: 1109 - DNA, 23 bp, Artificial Sequence
  Synthetic DNA Sequence
acatcgtgatcgctaaaaggagc

SEQ ID NO: 1110 - DNA, 23 bp, Artificial Sequence
  Synthetic DNA Sequence
acgagaaagacaacaggaagacc

SEQ ID NO: 1111 - DNA, 25 bp, Artificial Sequence
  Synthetic DNA Sequence
ctttttccggctcgwyttcctgatg

SEQ ID NO: 1112 - DNA, 20 bp, Artificial Sequence
  Synthetic DNA Sequence
ggctgygatattcaaagctc

SEQ ID NO: 1113 - DNA, 20 bp, Artificial Sequence
  Synthetic DNA Sequence
accgacctcacagcccgaaa

SEQ ID NO: 1114 - DNA, 21 bp, Artificial Sequence
  Synthetic DNA Sequence
tcwgagcctttttccggctcg

SEQ ID NO: 1115 - DNA, 26 bp, Artificial Sequence
  Synthetic DNA Sequence
tttcgggctgtgaggtcggbtghgcg

SEQ ID NO: 1116 - DNA, 27 bp, Artificial Sequence
  Synthetic DNA Sequence
tttcgggctgtgaggtcggbtghgcgg

SEQ ID NO: 1117 - DNA, 801 bp, Enterococcus faecium
  strain U94526
aaattcgatccgcactacatcggaattacaaaaaacggtgtatggaagctatgcaagaagccatgtacggaatgggaagccgacagtctccccgccatactctccccggataggaaaacgcatgggctgcttgtcatgaaagaaagcgaatacgaaacacggcgtattgatgtggctttcccggttttgcatggcaaatgcggggaggatggtgcgatacaggggctgtttgtattgtctggtatcccctatgtgggctgtgatattcaaagctccgcagcttgcatggacaaatcactggcctacattcttacaaaaaatgcgggcatcgccgttcccgaatttcaaatgattgataaaggtgacaagccggaggcgggtgcgcttacctaccctgtctttgtgaagccggcacggtcaggttcgtcctttggcgtaaccaaagtaaacggtacggaagaacttaacgctgcgatagaagcggcaggacaatatgatggaaaaatcttaattgagcaagcgatttcgggctgtgaggtcgggtgtgcggtcatggggaacgaggatgatttgattgtcggcgaagtggatcaaatccggctgagccacggtatcttccgcatccatcaggaaaacgagccggaaaaaggctcagaaaatgcgatgattacagttcccgcagacattccggtcgaggaacgaaatcgggtgcaggaaacggcaaagaaagtatatcgggtgcttggatgcagagggcttgcccgtgttgatctttttttgcaggaggatggcggcatcgtt

SEQ ID NO: 1118 - DNA, 24 bp, Artificial Sequence
  Synthetic DNA Sequence
ttttcwgagcctttttccggctcg

SEQ ID NO: 1119 - DNA, 25 bp, Artificial Sequence
  Synthetic DNA Sequence
tttcgggctgtgaggtcggbtghgc

SEQ ID NO: 1120 - DNA, 24 bp, Artificial Sequence
  Synthetic DNA Sequence
tttcgggctgtgaggtcggbtghg

SEQ ID NO: 1121 - DNA, 22 bp, Artificial Sequence
  Synthetic DNA Sequence
tgtttgwattgtcyggyatccc

SEQ ID NO: 1122 - DNA, 18 bp, Artificial Sequence
  Synthetic DNA Sequence
tggtgcattgctacgtgg

SEQ ID NO: 1123 - DNA, 22 bp, Artificial Sequence
  Synthetic DNA Sequence
tttcgggctgtgaggtcggbtg

SEQ ID NO: 1124 - DNA, 22 bp, Artificial Sequence
  Synthetic DNA Sequence
gatttgrtccacytcgccraca

SEQ ID NO: 1125 - DNA, 20 bp, Artificial Sequence
  Synthetic DNA Sequence
actcacaactgggatggatg

SEQ ID NO: 1126 - DNA, 21 bp, Artificial Sequence
  Synthetic DNA Sequence
ttatggttgtgctggttgagg

SEQ ID NO: 1127 - DNA, 20 bp, Artificial Sequence
  Synthetic DNA Sequence
kcaaaygccatttcaagtaa

SEQ ID NO: 1128 - DNA, 20 bp, Artificial Sequence
  Synthetic DNA Sequence
gacgacyttatkgatataca

SEQ ID NO: 1129 - DNA, 23 bp, Artificial Sequence
  Synthetic DNA Sequence
atgatgachgamatgatgaaaac

SEQ ID NO: 1130 - DNA, 22 bp, Artificial Sequence
  Synthetic DNA Sequence
gactatccaagcatgcattatg

SEQ ID NO: 1131 - DNA, 22 bp, Artificial Sequence
  Synthetic DNA Sequence
catctggagctacrtarccagt

SEQ ID NO: 1132 - DNA, 20 bp, Artificial Sequence
  Synthetic DNA Sequence
agtgaaaaratggctgctgc

SEQ ID NO: 1133 - DNA, 23 bp, Artificial Sequence
  Synthetic DNA Sequence
catcaagaacactggctaygtag

SEQ ID NO: 1134 - DNA, 23 bp, Artificial Sequence
  Synthetic DNA Sequence
ctagatagagctaaaaccttcct

SEQ ID NO: 1135 - DNA, 23 bp, Artificial Sequence
  Synthetic DNA Sequence
cattatgcaaacgccatttcaag

SEQ ID NO: 1136 - DNA, 21 bp, Artificial Sequence
  Synthetic DNA Sequence
acttgtccacgttsgatrtct

SEQ ID NO: 1137 - DNA, 23 bp, Artificial Sequence
  Synthetic DNA Sequence
aattaatggctgcwgttgaygaa

SEQ ID NO: 1138 - DNA, 1032 bp, Enterococcus gallinarum
atgaaaaaaattgccgttttatttggagggaattctccagaatactcagtgtcactaacctcagcagcaagtgtgatccaagctattgacccgctgaaatatgaagtaatgaccattggcatcgcaccaacaatggattggtattggtatcaaggaaacctcgcgaatgttcgcaatgatacttggctagaagatcacaaaaactgtcaccagctgactttttctagccaaggatttatattaggagaaaaacgaatcgtccctgatgtcctctttccagtcttgcatgggaagtatggcgaggatggctgtatccaaggactgcttgaactaatgaacctgccttatgttggttgccatgtcgctgcctccgcattatgtatgaacaaatggctcttgcatcaacttgctgataccatgggaatcgctagtgctcccactttgcttttatcccgctatgaaaacgatcctgccacaatcgatcgttttattcaagaccatggattcccgatctttatcaagccgaatgaagccggttcttcaaaagggatcacaaaagtaactgacaaaacagcgctccaatctgcattaacgactgcttttgcttacggttctactgtgttgatccaaaaggcgatagcgggtattgaaattggctgcggcatcttaggaaatgagcaattgacgattggtgcttgtgatgcgatttctcttgtcgacggtttttttgattttgaagagaaataccaattaatcagcgccacgatcactgtcccagcaccattgcctctcgcgcttgaatcacagatcaaggagcaggcacagctgctttatcgaaacttgggattgacgggtctggctcgaatcgattttttcgtcaccaatcaaggagcgatttatttaaacgaaatcaacaccatgccgggatttactgggcactcccgctacccagctatgatggcggaagtcgggttatcctacgaaatattagtagagcaattgattgcactggcagaggaggacaaacgatga

SEQ ID NO: 1139 - DNA, 1768 bp, Enterococcus faecium
  strain BM4147
gatatcgttacgcttcatgtgccgctcaatacggatacgcactatattatcagccacgaacaaatacagagaatgaagcaaggagcatttcttatcaatactgggcgcggtccacttgtagatacctatgagttggttaaagcattagaaaacgggaaactgggcggtgccgcattggatgtattggaaggagaggaagagtttttctactctgattgcacccaaaaaccaattgataatcaatttttacttaaacttcaaagaatgcctaacgtgataatcacaccgcatacggcctattataccgagcaagcgttgcgtgataccgttgaaaaaaccattaaaaactgtttggattttgaaaggagacaggagcatgaatagaataaaagttgcaatactgtttgggggttgctcagaggagcatgacgtatcggtaaaatctgcaatagagatagccgctaacattaataaagaaaaatacgagccgttatacattggaattacgaaatctggtgtatggaaaatgtgcgaaaaaccttgcgcggaatgggaaaacgacaattgctattcagctgtactctcgccggataaaaaaatgcacggattacttgttaaaaagaaccatgaatatgaaatcaaccatgttgatgtagcattttcagctttgcatggcaagtcaggtgaagatggatccatacaaggtctgtttgaattgtccggtatcccttttgtaggctgcgatattcaaagctcagcaatttgtatggacaaatcgttgacatacatcgttgcgaaaaatgctgggatagctactcccgccttttgggttattaataaagatgataggccggtggcagctacgtttacctatcctgtttttgttaagccggcgcgttcaggctcatccttcggtgtgaaaaaagtcaatagcgcggacgaattggactacgcaattgaatcggcaagacaatatgacagcaaaatcttaattgagcaggctgtttcgggctgtgaggtcggttgtgcggtattgggaaacagtgccgcgttagttgttggcgaggtggaccaaatcaggctgcagtacggaatctttcgtattcatcaggaagtcgagccggaaaaaggctctgaaaacgcagttataaccgttcccgcagacctttcagcagaggagcgaggacggatacaggaaacggcaaaaaaaatatataaagcgctcggctgtagaggtctagcccgtgtggatatgtttttacaagataacggccgcattgtactgaacgaagtcaatactctgcccggtttcacgtcatacagtcgttatccccgtatgatggccgctgcaggtattgcacttcccgaactgattgaccgcttgatcgtattagcgttaaaggggtgataagcatggaaataggatttacttttttagatgaaatagtacacggtgttcgttgggacgctaaatatgccacttgggataatttcaccggaaaaccggttgacggttatgaagtaaatcgcattgtagggacatacgagttggctgaatcgcttttgaaggcaaaagaactggctgctacccaagggtacggattgcttctatgggacggttaccgtcctaagcgtgctgtaaactgttttatgcaatgggctgcacagccggaaaataacctgacaaaggaaagttattatcccaatattgaccgaactgagatgatttcaaaaggatacgtggcttcaaaatcaagccatagccgcg

SEQ ID NO: 1140 - DNA, 1086 bp, Enterococcus casseliflavus
gtaagaatcggaaaagcggaaggaagaaaaacatgaaaaaaatcgccattatttttggaggcaattcaccggaatacaccgtttctttagcttcagcaactagcgcaatcgaagcactccaatcatctccctatgactacgacctctctttgatcgggatcgccccagatgctatggattggtacttgtatacaggagaactggaaaacatccgacaagacacgtggttgttggatacgaaacataaacagaaaatacagccgctattcgaaggaaacggcttttggctaagtgaagagcagcaaacgttggtacctgatgttttatttcccattatgcatggcaaatacggggaagatggcagtatccaaggattgtttgaattgatgaagctgccttatgtaggctgcggggtggcaggttctgccttatgtatgaacaaatggctgctgcatcaagctgcagcagccattggcgtacaaagtgctcctacgattctcttgacaaatcaagccaaccagcaagaacaaatcgaagcttttatccagacccatggcttcccagttttctttaagcctaatgaagcgggctcctcaaaagggatcactaaagtcacctgcgttgaagaaatcgcttctgccttaaaagaagcctttacttattgttccgcagtgctcctacaaaaaaatattgccggtgttgagatcggttgcggtattttgggcaacgactctttgactgtcggtgcttgtgacgccatttcattagtagacggctttttcgattttgaagaaaagtaccagctgatcagcgccaaaatcaccgtccctgcgccattgcctgaaacgattgaaaccaaggtcaaagaacaagctcagctgctctatcgtagtcttggtcttaaaggtcttgctcgcatcgacttttttgtcacggagcgaggagaactatacttgaatgaaatcaatactatgccgggctttacgagtcactcccgctatcctgccatgatggcagcggtcggcttatcctatcaagaactactacaaaaactgcttgtcttagcaaaggaggaagtcaaatgag

SEQ ID NO: 1141 - DNA, 3946 bp, Enterococcus faecium
  strain BM4147
atgaataacatcggcattactgtttatggatgtgagcaggatgaggcagatgcattccatgctctttcgcctcgctttggcgttatggcaacgataattaacgccaacgtgtcggaatccaacgccaaatccgcgcctttcaatcaatgtatcagtgtgggacataaatcagagatttccgcctctattcttcttgcgctgaagagagccggtgtgaaatatatttctacccgaagcatcggctgcaatcatatagatacaactgctgctaagagaatgggcatcactgtcgacaatgtggcgtactcgccggatagcgttgccgattatactatgatgctaattcttatggcagtacgcaacgtaaaatcgattgtgcgctctgtggaaaaacatgatttcaggttggacagcgaccgtggcaaggtactcagcgacatgacagttggtgtggtgggaacgggccagataggcaaagcggttattgagcggctgcgaggatttggatgtaaagtgttggcttatagtcgcagccgaagtatagaggtaaactatgtaccgtttgatgagttgctgcaaaatagcgatatcgttacgcttcatgtgccgctcaatacggatacgcactatattatcagccacgaacaaatacagagaatgaagcaaggagcatttcttatcaatactgggcgcggtccacttgtagatacctatgagttggttaaagcattagaaaacgggaaactgggcggtgccgcattggatgtattggaaggagaggaagagtttttctactctgattgcacccaaaaaccaattgataatcaatttttacttaaacttcaaagaatgcctaacgtgataatcacaccgcatacggcctattataccgagcaagcgttgcgtgataccgttgaaaaaaccattaaaaactgtttggattttgaaaggagacaggagcatgaatagaataaaagttgcaatactgtttgggggttgctcagaggagcatgacgtatcggtaaaatctgcaatagagatagccgctaacattaataaagaaaaatacgagccgttatacattggaattacgaaatctggtgtatggaaaatgtgcgaaaaaccttgcgcggaatgggaaaacgacaattgctattcagctgtactctcgccggataaaaaaatgcacggattacttgttaaaaagaaccatgaatatgaaatcaaccatgttgatgtagcattttcagctttgcatggcaagtcaggtgaagatggatccatacaaggtctgtttgaattgtccggtatcccttttgtaggctgcgatattcaaagctcagcaatttgtatggacaaatcgttgacatacatcgttgcgaaaaatgctgggatagctactcccgccttttgggttattaataaagatgataggccggtggcagctacgtttacctatcctgtttttgttaagccggcgcgttcaggctcatccttcggtgtgaaaaaagtcaatagcgcggacgaattggactacgcaattgaatcggcaagacaatatgacagcaaaatcttaattgagcaggctgtttcgggctgtgaggtcggttgtgcggtattgggaaacagtgccgcgttagttgttggcgaggtggaccaaatcaggctgcagtacggaatctttcgtattcatcaggaagtcgagccggaaaaaggctctgaaaacgcagttataaccgttcccgcagacctttcagcagaggagcgaggacggatacaggaaacggcaaaaaaaatatataaagcgctcggctgtagaggtctagcccgtgtggatatgtttttacaagataacggccgcattgtactgaacgaagtcaatactctgcccggtttcacgtcatacagtcgttatccccgtatgatggccgctgcaggtattgcacttcccgaactgattgaccgcttgatcgtattagcgttaaaggggtgataagcatggaaataggatttacttttttagatgaaatagtacacggtgttcgttgggacgctaaatatgccacttgggataatttcaccggaaaaccggttgacggttatgaagtaaatcgcattgtagggacatacgagttggctgaatcgcttttgaaggcaaaagaactggctgctacccaagggtacggattgcttctatgggacggttaccgtcctaagcgtgctgtaaactgttttatgcaatgggctgcacagccggaaaataacctgacaaaggaaagttattatcccaatattgaccgaactgagatgatttcaaaaggatacgtggcttcaaaatcaagccatagccgcggcagtgccattgatcttacgctttatcgattagacacgggtgagcttgtaccaatggggagccgatttgattttatggatgaacgctctcatcatgcggcaaatggaatatcatgcaatgaagcgcaaaatcgcagacgtttgcgctccatcatggaaaacagtgggtttgaagcatatagcctcgaatggtggcactatgtattaagagacgaaccataccccaatagctattttgatttccccgttaaataaacttttaaccgttgcacggacaaactatataagctaactctttcggcaggaaacccgacgtatgtaactggttcttagggaatttatatatagtagatagtattgaagatgtaaggcagagcgatattgcggtcattatctgcgtgcgctgcggcaagatagcctgataataagactgatcgcatagaggggtggtatttcacaccgcccattgtcaacaggcagttcagcctcgttaaattcagcatgggtatcacttatgaaaattcatctacattggtgataatagtaaatccagtagggcgaaataattgactgtaatttacggggcaaaacggcacaatctcaaacgagattgtgccgtttaaggggaagattctagaaatatttcatacttccaactatatagttaaggaggagactgaaaatgaagaagttgttttttttattgttattgttattcttaatatacttaggttatgactacgttaatgaagcactgttttctcaggaaaaagtcgaatttcaaaattatgatcaaaatcccaaagaacatttagaaaatagtgggacttctgaaaatacccaagagaaaacaattacagaagaacaggtttatcaaggaaatctgctattaatcaatagtaaatatcctgttcgccaagaaagtgtgaagtcagatatcgtgaatttatctaaacatgacgaattaataaatggatacgggttgcttgatagtaatatttatatgtcaaaagaaatagcacaaaaattttcagagatggtcaatgatgctgtaaagggtggcgttagtcattttattattaatagtggctatcgagactttgatgagcaaagtgtgctttaccaagaaatgggggctgagtatgccttaccagcaggttatagtgagcataattcaggtttatcactagatgtaggatcaagcttgacgaaaatggaacgagcccctgaaggaaagtggatagaagaaaatgcttggaaatacgggttcattttacgttatccagaggacaaaacagagttaacaggaattcaatatgaaccatggcatattcgctatgttggtttaccacatagtgcgattatgaaagaaaagaatttcgttctcgaggaatatatggattacctaaaagaagaaaaaaccatttctgttagtgtaaatggggaaaaatatgagatcttttattatcctgttactaaaaataccaccattcatgtgccgactaatcttcgttatgagatatcaggaaacaatatagacggtgtaattgtgacagtgtttcccggatcaacacatactaattcaaggaggtaa

SEQ ID NO: 1142 - DNA, 25 bp, Artificial Sequence
  Synthetic DNA Sequence
gatcctctaaatgattctcaggtgg

SEQ ID NO: 1143 - DNA, 25 bp, Artificial Sequence
  Synthetic DNA Sequence
caattagcttagcaataggtgttgg

SEQ ID NO: 1144 - DNA, 20 bp, Artificial Sequence
  Synthetic DNA Sequence
tgtyttccaaggttcagctc

SEQ ID NO: 1145 - DNA, 20 bp, Artificial Sequence
  Synthetic DNA Sequence
aacatattkggttgataggt

SEQ ID NO: 1146 - DNA, 23 bp, Artificial Sequence
  Synthetic DNA Sequence
gggattacctatgccaatatgat

SEQ ID NO: 1147 - DNA, 24 bp, Artificial Sequence
  Synthetic DNA Sequence
agctgtgttagcvcgaacatcttg

SEQ ID NO: 1148 - DNA, 20 bp, Artificial Sequence
  Synthetic DNA Sequence
gactttgtttggcgtgatat

SEQ ID NO: 1149 - DNA, 20 bp, Artificial Sequence
  Synthetic DNA Sequence
tccyacwatttctttttgwg

SEQ ID NO: 1150 - DNA, 20 bp, Artificial Sequence
  Synthetic DNA Sequence
tgataatcacaccgcatacg

SEQ ID NO: 1151 - DNA, 20 bp, Artificial Sequence
  Synthetic DNA Sequence
tgctgtcatattgtcttgcc

SEQ ID NO: 1152 - DNA, 20 bp, Artificial Sequence
  Synthetic DNA Sequence
ataaagatgataggccggtg

SEQ ID NO: 1153 - DNA, 20 bp, Artificial Sequence
  Synthetic DNA Sequence
ctcgtatgtccctacaatgc

SEQ ID NO: 1154 - DNA, 20 bp, Artificial Sequence
  Synthetic DNA Sequence
gtttgaagcatatagcctcg

SEQ ID NO: 1155 - DNA, 21 bp, Artificial Sequence
  Synthetic DNA Sequence
cagtgcttcattaacgtagtc

SEQ ID NO: 1156 - DNA, 23 bp, Artificial Sequence
  Synthetic DNA Sequence
gttgaaatgcatcacgaacaatt

SEQ ID NO: 1157 - DNA, 23 bp, Artificial Sequence
  Synthetic DNA Sequence
aagaacgtttcagttaaggaaat

SEQ ID NO: 1158 - DNA, 19 bp, Artificial Sequence
  Synthetic DNA Sequence
aagaggtaatgtctgtggt

SEQ ID NO: 1159 - DNA, 18 bp, Artificial Sequence
  Synthetic DNA Sequence
tgaaggtttgccaggtga

SEQ ID NO: 1160 - DNA, 24 bp, Artificial Sequence
  Synthetic DNA Sequence
cgtttctgttaaagaaattagaag

SEQ ID NO: 1161 - DNA, 18 bp, Artificial Sequence
  Synthetic DNA Sequence
tccaggtgataacgttgg

SEQ ID NO: 1162 - DNA, 18 bp, Artificial Sequence
  Synthetic DNA Sequence
caagtccgtggaaatgca

SEQ ID NO: 1163 - DNA, 21 bp, Artificial Sequence
  Synthetic DNA Sequence
gttggtttcaacgttaagaac

SEQ ID NO: 1164 - DNA, 18 bp, Artificial Sequence
  Synthetic DNA Sequence
ggtttcaacgtcaagaac

SEQ ID NO: 1165 - DNA, 18 bp, Artificial Sequence
  Synthetic DNA Sequence
ggtttcaacgtgaagaac

SEQ ID NO: 1166 - DNA, 22 bp, Artificial Sequence
  Synthetic DNA Sequence
acgttaagaatgtttctgtcaa

SEQ ID NO: 1167 - DNA, 14 bp, Artificial Sequence
  Synthetic DNA Sequence
gttggtttcaacgt

SEQ ID NO: 1168 - DNA, 20 bp, Artificial Sequence
  Synthetic DNA Sequence
gaacaattggttgaaggtgt

SEQ ID NO: 1169 - DNA, 2160 bp, Streptococcus pneumoniae
  strain SP-665
atgaacaaaccaacgattctgcgcctaatcaagtatctgagcattagcttcttaagcttggttatcgcagccattgtcttaggcggaggagtttttttctactacgttagcaaggctcctagcctatccgagagtaaactagttgcaacaacttctagtaaaatctacgacaataaaaatcaactcattgctgacttgggttctgaacgccgcgtcaatgcccaagctaatgatattcccacagatttggttaaggcaatcgtttctatcgaagaccatcgcttcttcgaccacagggggattgattccatccgtatcctgggagctttcttgcgcaatctgcaaagtaattccctccaaggtggatcaactctcacccaacagttgattaagttgacttacttttcaacctcgacttccgaccagactatttctcgtaaggctcaggaagcttggttagcgattcagttagaacaaaaagcaaccaaacaggaaatcttgacctactatataaataaggtctacatgtctaatggcaactatggaatgcagacagcagctcaaaactactatggtaaagacctcaataatttaagtttacctcagttagccttgctggctggaatgcctcaggcaccaaaccaatatgacccctattcacatccagaagcagcccaagaccgccgaaacttggtcttatctgaaatgaaaaatcaaggttacatctctgctgaacagtatgagaaagcagtcaatacaccaattactgatggactacaaagtctcaaatcagcaagtaattaccctgcttacatggataattacctcaaggaggtcatcaatcaagtagaacaagaaactggctataaccttctaactactgggatggatgtttacacaaatgtagaccaagaagctcaaaaacatctgtgggatatctacaactccgatcaatacgtctcttaccctgacgatgatttgcaagtcgcatctacggtcgtagatgtttcaaatggtaaagtcatcgcccaacttggagctcgtcaccaagcaagtaacgtttcatttggtaccaaccaagctgtggaaaccaatcgtgactggggttctgctatgaaaccaatcaccgattatgcacctgccatagaatacggtgtttatgattccactgcaactatggttaatgatattccttataactatccgggaacaagcacacctgtctacaactgggatagagcatatttcggtaatattactctgcaatatgctcttcaacaatcacgaaatgtcacagccgttgagactttgaataaggtcggtctagatagagctaaaaccttccttaatggtcttggtatcgactatccaagcatgcattatgcaaacgccatttcaagtaatacaacagaatctaataaacaatacggagcaagtagtgaaaaaatggctgctgcttatgctgcctttgcaaatggtggcacttactataaaccaatgtatatccataaagtcgtcttcagtgatggaagtaaaaaagagttctctaatgtcggaactcgtgccatgaaggaaacgacagcctatatgatgaccgacatgatgaaaacagtcttgacttatggaactgggcgtggagcctatcttccttggcttcctcaagctggtaaaacaggaacctctaactatacagatgaggaagttgaaaaccacatcaagaacactggctatgtagctccagatgaaatgtttgttggttatactcgtaagtattctatggctgtatggacaggttattcgaatcgtttaactcctatcgttggagatggtttcctagttgcagctaaagtttatcgctcaatgataacgtatctatcagaagatactcatccagaagactggacgatgccagacggacttttcagaaacggggaatttgtattcaaaaatggagctcgcccaatatggactgaaccctctactcaacaatcctcaacagctgaaagttcaagctcatcatcagatagttcaacttcacagtctagctcaaccactccaagcacaaataatagtacgactaccaatcctaacaataatacgcaacaatcaaatacaacccctgatcaacaaaatcagaatcctcaaccagcacaaccataa

SEQ ID NO: 1170 - DNA, 20 bp, Artificial Sequence
  Synthetic DNA Sequence
acgaattggactacgcaatt

SEQ ID NO: 1171 - DNA, 20 bp, Artificial Sequence
  Synthetic DNA Sequence
acgaggatgatttgattgtc

SEQ ID NO: 1172 - DNA, 1560 bp, Streptococcus pneumoniae
  strain 64147
gatcctctaaatgattctcaggtggctgttattgcctctatttcaaaggagatgcctggcattagtatttctacttcttgggatagaaaggttttggaaacttccctttcttctatagttgggagtgtatccagtgaaaaagctggtctcccagcggaagaagcagaagcctatcttaaaaaaggctattctctaaatgaccgtgtaggaacctcctatttggaaaagcaatatgaagagaccttacaaggaaaacgctcggtaaaagaaatccatctggacaaatatggcaacatggaaagcgtggatacaattgaggaaggtagtaagggaaacaatatcaagctgaccattgatttggccttccaagatagcgtggatgctttgctgaaaagttatttcaattcagagttgggaaatggtggagccaagtattctgaaggtgtctatgcagtcgcccttaacccaaaaacaggtgctgttttgtctatgtcaggaattaaacatgacttgaaaacaggagagttgacgccggattccttgggaacggtaaccaatgtctttgtcccaggttcggttgtcaaagcagcgaccatcagctctggttgggaaaatggagtcttgtcaggaaatcagaccttgacagaccagtccattgtctttcaaggttcagctccaattaattcttggtatcctgccttttctagaccaatgccgattacggcggttcaggctctagagtattcatccaatgcttatatggtccaaacagccctaggtcttatggggcagacctatcaacccaatatgtttgtcggcaccagcaatctagagtctgctatggggaaattgcgttcaacctttggtgaatatggtttgggttctgcgaccggaattgacctaccagatgaatctactggatttgttcccaaagagtatagctttgctaatttcattaccaatgcctttgggcagtttgataactatacgccgatgcagttggctcagtatgtagcaactattgcaaatgatggtgttcgtgtggctcctcgtattgttgaaggcatttatggtaataatgataagggaggactgggtgacttgattcagcaactgcaaccgacagagatgaataaggtcaatatatccgactccgatatgagcatcttgcaccaaggtttttatcaggttgcccatggtactagtgaattgacaactggacgtgccttttcaaatggcgccttggtatccattagcggaaaaacaggtacagccgaaagctatgtggcagatggtcagcaagcaaccaataccaatgcggtggcctatgccccatctgataatccccaaatcgctgtagctgttgtcttccctcataacaccaaccttacaaatggtgtcggaccttccattgcgcgcgatattatcaacctctataaccaacatcatccaatgaattagaaaggaacatatgctttatccaacacctattgctaagctaattgacagttattcgaagttaccgggtatcgggattaagacggctacccgtttggcctt

SEQ ID NO: 1173 - DNA, 2007 bp, Streptococcus pneumoniae
  strain CS109
gagtcccgattgctgaggatgcaacctcctataatgtctatgcggtcattgatgagaactataagtcagcaacgggtaagattctttacgtagaaaaaacacaatttaacaaggttgcagaggtctttcataagtatctggacatggaagaatcctatgtaagagagcaactctcgcaacctaatctcaagcaagtttcctttggagcaaagggaaatgggattacctatgccaatatgatgactatcaaaaaagagttggaaactgcagaggtcaaggggattgattttacaaccagtcccaatcgtagttatccaaacggacaatttgcttctagttttatcggtctagctcagctccatgaaaatgaagatggcagcaagagcttgctgggaacttctggaatggagagttccttgaacagtattcttgcagggacagacggcattattacctatgaaaaggatcgtctgggcaatattgtacccggaacagaactggtatcgcaacaaactgtggatggcaaggatgtttatacaacattgtctagtccgctacaatctttcatggaaactcagatggatgcctttctagaaaaagtaaaaggtaagtatatgaccgcgaccttggtcagtgcaaagaccggtgaaattctcgctaccacccaacgacctacctttaatgcagatactaaagaaggaatcactgaggactttgtttggcgtgatattctttatcaaagtaactatgaaccaggatcagcctttaaggtcatgatgttagcttcttctattgataataataccttcccaagtggagaatacttcaatagcagtgaattcaaaatagcggatgcgacgactcgagattgggatgttaatgagggtttgactactggtgggatgatgactttctcacaaggtttcgctcactccagtaatgttggaacgagtctacttgaacaaaaaatgggagatgctacttggttggattatctaaaacgctttaaatttggggttccaactcgctttggcttgacagatgaatacgctggtcaacttccagctgataatattgttagtattgctcaaagctcatttgggcaaggaatttcagtgacacaaacacaaatgcttcgtgcctttacagctattgctaatgatggagttatgctggagccaaaatttataagtgctatttatgatactaacaatcagtctgtacgtaagtcacaaaaagaaatagtaggaaatcctgtttccaaagaggcagcaagcacaactcgaaatcacatgatcttagttgggacggaccctctatatggaactatgtataatcactacacaggaaagccaattataacagttcctggacaaaatgtagcagttaaatccggtacggctcaaatcgctgatgagaaaaatggaggatacttggttggttctaccaattatattttctcagttgtgactatgaatcctgctgaaaatcctgattttatcttgtatgtaacggttcaacagcctgagcattattcaggtatccagttgggagaatttgccaccccaatcttggagcgggcttcagctatgaaagaatctctcaatcttcaatctccagccaaaaatttagataaagttacgacagaatcttcttatgcaatgcctagcatcaaggatatttcacctggtgagttggcggaagccttacgccgaaatattgtgcaaccaatcgttgtaggtactggaacaaagattaaagagacttctgtagaagaagggaccaatcttgcaccaaaccaacaagttctccttttatcggataaggtagaagaaattccagacatgtatagctggaaaaaagagactgccgagacctttgctaaatggttggatattgaactggaatttgaaggttcaggttccgttgttcagaagcaagatgttcggactaatacagctatcaaaaacattaaaaaaattaaattaactttaggagactaatatg

SEQ ID NO: 1174 - DNA, 18 bp, Artificial Sequence
  Synthetic DNA Sequence
gaacgtggtgaagttcgc

SEQ ID NO: 1175 - DNA, 21 bp, Artificial Sequence
  Synthetic DNA Sequence
gttactggtgtagaaatgttc

SEQ ID NO: 1176 - DNA, 19 bp, Artificial Sequence
  Synthetic DNA Sequence
tactggtgtagaaatgttc

SEQ ID NO: 1177 - DNA, 20 bp, Artificial Sequence
  Synthetic DNA Sequence
gctcaacaagttccagatta

SEQ ID NO: 1178 - DNA, 2456 bp, Staphylococcus aureus
  NCTC  8325
atgaactgattatacttaacattaaaaaagatgataacaccttctacacctccatatcacaaaaaattataacattattttgacataaatactacatttgtaatatactacaaatgtagtcttatataaggaggatattgatgaaaaagataaaaattgttccacttattttaatagttgtagttgtcgggtttggtatatatttttatgcttcaaaagataaagaaattaataatactattgatgcaattgaagataaaaatttcaaacaagtttataaagatagcagttatatttctaaaagcgataatggtgaagtagaaatgactgaacgtccgataaaaatatataatagtttaggcgttaaagatataaacattcaggatcgtaaaataaaaaaagtatctaaaaataaaaaacgagtagatgctcaatataaaattaaaacaaactacggtaacattgatcgcaacgttcaatttaattttgttaaagaagatggtatgtggaagttagattgggatcatagcgtcattattccaggaatgcagaaagaccaaagcatacatattgaaaatttaaaatcagaacgtggtaaaattttagaccgaaacaatgtggaattggccaatacaggaacacatatgagattaggcatcgttccaaagaatgtatctaaaaaagattataaagcaatcgctaaagaactaagtatttctgaagactatatcaacaacaaatggatcaaaattgggtacaagatgataccttcgttccactttaaaaccgttaaaaaaatggatgaatatttaagtgatttcgcaaaaaaatttcatcttacaactaatgaaacagaaagtcgtaactatcctctagaaaaagcgacttcacatctattaggttatgttggtcccattaactctgaagaattaaaacaaaaagaatataaaggctataaagatgatgcagttattggtaaaaagggactcgaaaaactttacgataaaaagctccaacatgaagatggctatcgtgtcacaatcgttgacgataatagcaatacaatcgcacatacattaatagagaaaaagaaaaaagatggcaaagatattcaactaactattgatgctaaagttcaaaagagtatttataacaacatgaaaaatgattatggctcaggtactgctatccaccctcaaacaggtgaattattagcacttgtaagcacaccttcatatgacgtctatccatttatgtatggcatgagtaacgaagaatataataaattaaccgaagataaaaaagaacctctgctcaacaagttccagattacaacttcaccaggttcaactcaaaaaatattaacagcaatgattgggttaaataacaaaacattagacgataaaacaagttataaaatcgatggtaaaggttggcaaaaagataaatcttggggtggttacaacgttacaagatatgaagtggtaaatggtaatatcgacttaaaacaagcaatagaatcatcagataacattttctttgctagagtagcactcgaattaggcagtaagaaatttgaaaaaggcatgaaaaaactaggtgttggtgaagatataccaagtgattatccattttataatgctcaaatttcaaacaaaaatttagataatgaaatattattagctgattcaggttacggacaaggtgaaatactgattaacccagtacagatcctttcaatctatagcgcattagaaaataatggcaatattaacgcacctcacttattaaaagacacgaaaaacaaagtttggaagaaaaatattatttccaaagaaaatatcaatctattaaatgatggtatgcaacaagtcgtaaataaaacacataaagaagatatttatagatcttatgcaaacttaattggcaaatccggtactgcagaactcaaaatgaaacaaggagaaagtggcagacaaattgggtggtttatatcatatgataaagataatccaaacatgatgatggctattaatgttaaagatgtacaagataaaggaatggctagctacaatgccaaaatctcaggtaaagtgtatgatgagctatatgagaacggtaataaaaaatacgatatagatgaataacaaaacagtgaagcaatccgtaacgatggttgcttcactgttttattatgaattattaataagtgctgttacttctcccttaaatacaatttcttcattttcattgtatgttgaaagtgacactgtaacgagtccattttctttttttatggatttcttatttgtaatttcagcgataacgtacaatgtattacctggtatacagtttaataaatttaacgttattcatttgtgttcctgctacaacttcttctccgtatttaccttcttctacccataatttaaatgatattgaaagtgtatgcatgc

SEQ ID NO: 1179 - DNA, 20 bp, Artificial Sequence
  Synthetic DNA Sequence
atttggtgacgggtgacttt

SEQ ID NO: 1180 - DNA, 19 bp, Artificial Sequence
  Synthetic DNA Sequence
tccaccgttgccaatcgca

SEQ ID NO: 1181 - DNA, 20 bp, Artificial Sequence
  Synthetic DNA Sequence
agcagcttactagatgccgt

SEQ ID NO: 1182 - DNA, 20 bp, Artificial Sequence
  Synthetic DNA Sequence
aactgcaagagatcctttgg

SEQ ID NO: 1183 - DNA, 2535 bp, Streptococcus pneumoniae
  strain 175
atggcgatagaaaagctatcacccggcatgcaacagtatgtggatattaaaaagcaatatccagatgcttttttgctctttcggatgggtgatttttatgaattattttatgaggatgcggtcaatgctgcgcagattctggaaatttccttaacgagtcgcaacaagaatgccgacaatccgatccctatggcgggtgttccctatcattctgcccaacagtatatcgatgtcttgattgagcagggttataaggtggctatcgcagagcagatggaagatcctaaacaagcagttggggttgttaaacgagaggttgttcaggtcattacgccagggacagtggtcgatagcagtaagccggacagtcagaataattttttggtttccatagaccgcgaaggcaatcaatttggcctagcttatatggatttggtgacgggtgacttttatgtgacaggtcttttggatttcacgctggtttgtggggaaatccgtaacctcaaggctcgagaagtggtgttgggttatgacttgtctgaggaagaagaacaaatcctcagccgccagatgaatctggtactctcttatgaaaaagaaagctttgaagaccttcatttattggatttgcgattggcaacggtggagcaaacggcatctagtaagctgctccagtatgttcatcggactcagatgagggaattgaaccacctcaaacctgttatccgctacgaaattaaggatttcttgcagatggattatgcgaccaaggctagtctggatttggttgagaatgctcgctcaggtaagaaacaaggcagtcttttctggcttttggatgaaaccaaaacggctatggggatgcgtctcttgcgttcttggattcatcgccccttgattgataaggaacgaatcgtccaacgtcaagaagtagtgcaggtctttctcgaccatttctttgagcgtagtgacttgacagacagtctcaagggtgtttatgacattgagcgcttggctagtcgtgtttcttttggcaaaaccaatccaaaggatctcttgcagttggcgactaccttgtctagtgtgccacggattcgtgcgattttagaagggatggagcaacctactctagcctatctcatcgcacaactggatgcaatccctgagttggagagtttgattagcgcagcgattgctcctgaagctcctcatgtgattacagatgggggaattatccggactggatttgatgagactttagacaagtatcgttgcgttctcagagaagggactagctggattgctgagattgaggctaaggagcgagaaaactctggtatcagcacgctcaagattgactacaataaaaaggatggctactattttcatgtgaccaattcgcaactgggaaatgtgccagcccactttttccgcaaggcgacgctgaaaaactcagaacgctttggaaccgaagaattagcccgtatcgagggagatatgcttgaggcgcgtgagaagtcagccaacctcgaatacgaaatatttatgcgcattcgtgaagaggtcggcaagtacatccagcgtttacaagctctagcccaaggaattgcgacggttgatgtcttacagagtctggcggttgtggctgaaacccagcatttgattcgacctgagtttggtgacgattcacaaattgatatccggaaagggcgccatgctgtcgttgaaaaggttatgggggctcagacctatattccaaatacgattcagatggcagaagataccagtattcaattggttacagggccaaacatgagtgggaagtctacctatatgcgtcagttagccatgacggcggttatggcccagctgggttcctatgttcctgctgaaagcgcccatttaccgatttttgatgcgatttttacccgtatcggagcagcagatgacttggtttcgggtcagtcaacctttatggtggagatgatggaggccaataatgccatttcgcatgcgaccaagaactctctcattctctttgatgaattgggacgtggaactgcaacttatgacgggatggctcttgctcagtccatcatcgaatatatccatgagcacatcggagctaagaccctctttgcgacccactaccatgagttgactagtctggagtctagtttacaacacttggtcaatgtccacgtggcaactttggagcaggatgggcaggtcaccttccttcacaagattgaaccgggaccagctgataaatcctacggtatccatgttgccaagattgctggcttgccagcagaccttttagcaagggcggataagattttgactcagctagagaatcaaggaacagagagtcctcctcccatgagacaaactagtgctgtcactgaacagatttcactctttgatagggcagaagagcatcctatcctagcagaattagctaaactggatgtgtataatatgacacctatgcaggttatgaatgtcttagtagagttaaaacagaaactataa

SEQ ID NO: 1184 - DNA, 623 bp, Streptococcus pneumoniae
  strain StrR-05
tgacgggtgacttttatgtgacaggtcttttggatttcacgctggtttgtggggaaatccgtaacctcaaggctcgagaagtggtgttgggttatgacttgtctgaggaagaagaacaaatcctcagccgccagatgaatctggtactctcttatgaaaaagaaagctttgaagaccttcatttattggatttgcgattggcaacggtggagcaaacggcatctagtaagctgctccagtatgttcatcggactcagatgagggaattgaaccacctcaaacctgttatccgatacgaaattaaggatttcttgcagatggattatgcgaccaaggctagtctggatttggttgagaatgctcgctcaggtaagaaacaaggcagtcttttctggcttttggatgaaaccaaaacggctatggggatgcgtctcttgcgttcttggattcatcgccccttgattgataaggaacgaatcgtccaacgtcaagaagtagtgcaggtctttctcgaccatttctttgagcgtagtgacttgacagacagtctcaagggtgtttatgacattgagcgcttggctagtcgtgtttcttttggcaaaaccaatccaaaggatctcttg

SEQ ID NO: 1185 - DNA, 621 bp, Streptococcus pneumoniae
  strain StrR-06
tgacgggtgacttttatgtgacaggtcttttggatttcacgctggtttgtggggaaatccgtaacctcaaggctcgagaagtggtgttgggttatgacttgtctgaggaagaagaacaaatcctcagccgccagatgaatctggtactctcttatgaaaaagaaagctttgaagaccttcatttattggatttgcgattggcaacggtggagcaaacggcatctagtaagctgctccagtatgttcatcggactcagatgagggaattgaaccacctcaaacctgttatccgatacgaaattaaggatttcttgcagatggattatgcgaccaaggctagtctggatttggttgagaatgctcgctcaggtaagaaacaaggcagtcttttctggcttttggatgaaaccaaaacggctatggggatgcgtctcttgcgttcttggattcatcgccccttgattgataaggaacgaatcgtccaacgtcaagaagtagtgcaggtctttctcgaccatttctttgagcgtagtgacttgacagacagtctcaagggtgtttatgacattgagcgcttggctagtcgtgtttcttttggcaaaaccaatccaaaggatctct

SEQ ID NO: 1186 - DNA, 622 bp, Streptococcus pneumoniae
  strain StrR-11
tgacgggtgacttttatgtgacaggtcttttggatttcacgctggtttgtggggaaatccgtaacctcaaggctcgagaagtggtgttgggttatgacttgtctgaggaagaagaacaaatcctcagccgccagatgaatctggtactctcttatgaaaaagaaagctttgaagaccttcatttattggatttgcgattggcaacggtggagcaaacggcatctagtaagctgctccagtatgttcatcggactcagatgagggaattgaaccacctcaaacctgttatccgctacgaaattaaggatttcttgcagatggattatgcgaccaaggctagtctggatttggttgagaatgctcgctcaggtaagaaacaaggcagtcttttctggcttttggatgaaaccaaaacggctatggggatgcgtctcttgcgttcttggattcatcgccccttgattgataaggaacgaatcgtccaacgtcaagaagtagtgcaggtctttctcgaccatttctttgagcgtagtgacttgacagacagtctcaagggtgtttatgacattgagcgcttggctagtcgtgtttcttttggcaaaaccaatccaaaggatctctt

SEQ ID NO: 1187 - DNA, 622 bp, Streptococcus pneumoniae
  strain StrR-55
tgacgggtgacttttatgtgacaggtcttttggatttcacgctggtttgtggggaaatccgtaacctcaaggctcgagaagtggtgttgggttatgacttgtctgaggaagaagaacaaatcctcagccgccagatgaatctggtactctcttatgaaaaagaaagctttgaagaccttcatttattggatttgcgattggcaacggtggagcaaacggcatctagtaagctgctccggtatgttcatcggactcagatgagggaattgaaccacctcaaacctgttatccgctacgaaattaaggatttcttgcagatggattatgcgaccaaggctagtctggatttggttgagaatgctcgctcaggtaagaaacaaggcagtcttttctggcttttggatgaaaccaaaacggctatggggatgcgtctcttgcgttcttggattcatcgccccttgattgataaggaacgaatcgtccaacgtcaagaagtagtgcaggtctttctcgaccatttctttgagcgtagtgacttgacagacagtctcaagggtgtttatgacattgagcgcttggctagtcgtgtttcttttggcaaaaccaatccaaaggatctctt

SEQ ID NO: 1188 - DNA, 599 bp, Streptococcus oralis
  ref <308>: DATABASE ACCESSION NUMBER: ATCC 35037
gggtgacttttatgtaacggggctattggatttcacgttggtttgtggggaaattcgcaatctcaaggctagagaagtggtgctgggttatgacttgtctgaggaagaagaacaaatcctcagtcgtcagatgaatctggtgctttcttatgagaaggaaggctttgaggaccttcatttactggatccacgactggcagctgtggagcaagcggcagctagtaagctcctccagtatgttcaccggacccagatgcgggaattgaaccacctcaaaccagttatccgctatgaaatcaaagatttcttacagatggactatgcgaccaaggctagtctggatttggttgagaatgcccgttcaggcaagaagcaaggcagtcttttctggcttttagatgaaaccaagacggctatgggaatgcgtctcttgcgttcttggattcatcgtcctttgattgataaggagcgaatcgtccagcgtcaagaggtggtgcaggtctttcttgaccacttctttgagcgtagtgatttaacggacagtcttaagggtgtttatgatatcgaacgcttggctagtcgggtttcttttggcaaga

SEQ ID NO: 1189 - DNA, 624 bp, Streptococcus mitis
  ref <308>: DATABASE ACCESSION NUMBER: ATCC 49456
ggtgacgggtgacttttatgtgacaggtcttttggattttacgctggtttgtggggaaatccgcaatctcaaggctcgagaagtggtgctgggttatgacttgtctgaggaagaagaacagatccttagtcgtcagatgaatctggtactttcctatgaaaaagaaggctttgaagaccttcatttactggattcacgattggcagctgtggagcaagcggcatctagtaaactgcttcagtatgttcatcggactcagatgagggaattgaaccacctcaagcctgttatccgctatgaaatcaaagattttttgcagatggattatgcgaccaaggctagtctggatttggttgagaatgcccgttcaggcaagaagcaaggtagtcttttttggcttttggatgaaaccaaaacagctatgggaatgcgtctcttgcggtcttggattcatcgccccctgattgataaggaacgaattgtccaacgccaagaagttgtgcaggtctttctcgaccatttctttgagcgtagtgatttgacagacagtctcaagggtgtttatgacattgagcgcttggctagtcgtgtttcttttggcaaaaccaatccaaaggatctctt

SEQ ID NO: 1190 - DNA, 599 bp, Streptococcus mitis
  strain LSPQ 2583
tgacgggtgactttcaggtgactagtttagaggactttgtcttggtctgcggggaaatccgcaatttgaaagctagggaagtggtgctgggctatgccttgccagaagctgaggagcaggttttggctggacagatgaaccttttactgtcctatgtggagaaggttttggaggatgttcagctgctgggcgaggagctgtctcctatggagcgtcaggcagcagggaaactgctggagtatgtgcaccggacccagatgagggagctcagccatttgaagaaggctcagcattatgaaatcaaggacttcctgcaaatggactatgccaccaaggcgagtctggatttgacagaaaatgctcgctcgggcaagaagcacggcagtctttattggctgatggacgagactaagacggccatgggcggccgcatgctgcgctcttggatccagcgtccgctgattgatgaagcgcgaattagccagcgacagaatgtcgttgaggtttttctggatcatttctttgagcggagtgatttgacggagagcctcaagggggtctatgatatcgagcggctggctagtcgggtgtcttttggc

SEQ ID NO: 1191 - DNA, 622 bp, Streptococcus mitis
  ref <308>: DATABASE ACCESSION NUMBER: ATCC 903
tgacgggtgactttcaggtgactagtttagaggactttgccctggtctgcggggaaatccgtaatttgaaggctagggaagtggtgctgggctatgctttgccagaagctgaggagcaggtcttggctggacagatgaatcttttgctgtcctatgtacagacggccttggacgatgtccagctgctgggcgaggaactgtctcctatggagcgtcaggcagcggggaaattgctagagtatgtgcaccggacccagatgagggagctcagccatttgaagaaggcccagcattatgaaatcaaggactttctgcaaatggattatgctaccaaggcgagtctggatttgacagaaaatgctcgctcgggtaagaaacacggcagtctttattggctgatggacgagaccaagacggccatgggcggccgtatgctgcgctcttggatccagcgtccgttgattgatgaagtgcgaattagccagcggcagaatgtcgtcgaggtttttctggaacatttctttgagcggagtgatttgacggagagcctcaagggagtctatgatatcgagcggctggctagtcgggtgtcttttggcaagaccaatccaaaggatctctt

SEQ ID NO: 1192 - DNA, 22 bp, Artificial Sequence
  Synthetic DNA Sequence
ggtaaaacaggaacctctaact

SEQ ID NO: 1193 - DNA, 22 bp, Artificial Sequence
  Synthetic DNA Sequence
ggtaagacaggtacttctaact

SEQ ID NO: 1194 - DNA, 24 bp, Artificial Sequence
  Synthetic DNA Sequence
catttcaagtaatacaacagaatc

SEQ ID NO: 1195 - DNA, 24 bp, Artificial Sequence
  Synthetic DNA Sequence
catttcaagtaacacaactgaatc

SEQ ID NO: 1196 - DNA, 24 bp, Artificial Sequence
  Synthetic DNA Sequence
gccatttcaagtaatacaacagaa

SEQ ID NO: 1197 - DNA, 25 bp, Artificial Sequence
  Synthetic DNA Sequence
caaacgccatttcaagtaatacaac

SEQ ID NO: 1198 - DNA, 381 bp, Staphylococcus saprophyticus
  ref <308>: DATABASE ACCESSION NUMBER: ATCC 43867
aacgggcgtctcgatagaaaaacacgtgaaaatcccaatgattataaacaatcaatatacgattttgctgaagctgtaacaaaaggtattaaggaacaaacaaataaaaattaataggcaacttaaccagaatcgttaaaactatatgacgattctggttttttaaattcaaaaagttttctaaaaaatttacttgcttctttaaagtataggtatgaaatacaattgattaaaatagtaaaggaaatgaatcatgaaacaattaactaagcctttatacttttacctattactttttattacaacaacgctgattggcgcgttactattatatttgccaatcacakgtaaacatcctattgattttgtggacgcccgtta

SEQ ID NO: 1199 - DNA, 25 bp, Artificial Sequence
  Synthetic DNA Sequence
gtattaaagaagatatccaaaaagc

SEQ ID NO: 1200 - DNA, 25 bp, Artificial Sequence
  Synthetic DNA Sequence
tcaaagaagaaactaaaaaagctgt

SEQ ID NO: 1201 - DNA, 19 bp, Artificial Sequence
  Synthetic DNA Sequence
aacgtaggtgtccttcttc

SEQ ID NO: 1202 - DNA, 22 bp, Artificial Sequence
  Synthetic DNA Sequence
gtgttgaaatgttccgtaaaca

SEQ ID NO: 1203 - DNA, 21 bp, Artificial Sequence
  Synthetic DNA Sequence
  modified_base (3): i
  modified_base (9): i
  modified_base (12): i
ggngarmgnggnaaygaratg

SEQ ID NO: 1204 - DNA, 21 bp, Artificial Sequence
  Synthetic DNA Sequence
  modified_base (3): i
  modified_base (10): i
  modified_base (13): i
gcnaayaacntcnwmyatgcc

SEQ ID NO: 1205 - DNA, 20 bp, Artificial Sequence
  Synthetic DNA Sequence
  modified_base (6): i
  modified_base (9): i
  modified_base (18): i
aayacntcnawyatgccngt

SEQ ID NO: 1206 - DNA, 19 bp, Artificial Sequence
  Synthetic DNA Sequence
  modified_base (3): i
  modified_base (6): i
  modified_base (9): i
  modified_base (15): i
cknsrngtngartcngcca

SEQ ID NO: 1207 - DNA, 20 bp, Artificial Sequence
  Synthetic DNA Sequence
  modified_base (3): i
  modified_base (6): i
  modified_base (12): i
ccntcntcwccnggcatytc

SEQ ID NO: 1208 - DNA, 25 bp, Artificial Sequence
  Synthetic DNA Sequence
tcaaaaagttttctaaaaaatttac

SEQ ID NO: 1209 - DNA, 25 bp, Artificial Sequence
  Synthetic DNA Sequence
acgggcgtccacaaaatcaatagga

SEQ ID NO: 1210 - DNA, 22 bp, Artificial Sequence
  Synthetic DNA Sequence
accagcttgcccaatacaaagg

SEQ ID NO: 1211 - DNA, 24 bp, Artificial Sequence
  Synthetic DNA Sequence
attcttgtaacaggctttgatccc

SEQ ID NO: 1212 - DNA, 23 bp, Artificial Sequence
  Synthetic DNA Sequence
  modified_base (3): i
  modified_base (6): i
  modified_base (9): i
  modified_base (12): i
  modified_base (15): i
  modified_base (18): i
ccnccnrgnggnganacngcwcc

SEQ ID NO: 1213 - DNA, 26 bp, Artificial Sequence
  Synthetic DNA Sequence
  modified_base (6): i
  modified_base (9): i
  modified_base (12): i
  modified_base (15): i
  modified_base (18): i
  modified_base (24): i
aarggnggnacngcngcnathccngg

SEQ ID NO: 1214 - DNA, 23 bp, Artificial Sequence
  Synthetic DNA Sequence
ggtaaaacaggtacctctaacta

SEQ ID NO: 1215 - DNA, 1337 bp, Streptococcus pyogenes
  strain D471
aacaaaataaaagaacttacctattttccatccaaaatgtttagcaatcatcatctgcaaggcaacgtattgcatggcattgatgtgatgagcaactaatatgtcattagaacgttgcgtcaaactagcatctaaataaagatcgaaatgcagttatcaaaaatgcaagctcctatcggcccttgttttaattattactcacattgccttaatgtatttacttgcttattattaacttttttgctaagttagtagcgtcagttattcattgaaaggacattattatgaaaattcttgtaacaggctttgatccctttggcggcgaagctattaatcctgcccttgaagctatcaagaaattgccagcaaccattcatggagcagaaatcaaatgtattgaagttccaacggtttttcaaaaatctgccgatgtgctccagcagcatatcgaaagctttcaacctgatgcagtcctttgtattgggcaagctggtggccggactggactaacgccagaacgcgttgccattaatcaagacgatgctcgcattcctgataacgaagggaatcagcctattgatacacctattcgtgcagatggtaaagcagcttatttttcaaccttgccaatcaaagcgatggttgctgccattcatcaggctgggcttcctgcttctgtttctaatacagctggtacctttgtttgcaatcatttgatgtatcaagccctttacttagtggataaatattgtccaaatgccaaagctgggtttatgcatattccctttatgatggaacaggttgttgataaacctaatacagctgccatgaacctcgatgatattacaagaggaattgaggctgctatttttgccattgtcgatttcaaagatcgttccgatttaaaacgtgtagggggcgctactcactgactgtgacgctactaaacctattttaaaaaaacagagatatgaactaactctgttttttttgtgctaaaaatgaaagacctagggaaacttttcatcggtctttctcaattgtcatcttaatctaatactacttctaacatcagcgggtatagtttgccagtaattaagaaacgttgttgatctaaatgagcaatcccattcaaaacattaaggtcagggtaatgggacttatcaagatttaaggcttttaacaaaggactaatatcataggtggctaccacctttccagaatcaggttggagtttgacaatagtattggtttgccaaatattggcatagagataaccatctacatactctaattcgttaagcattgagatagggacactttctatagcaactagt

SEQ ID NO: 1216 - DNA, 23 bp, Artificial Sequence
  Synthetic DNA Sequence
ggtaagactggtacatcaaacta

SEQ ID NO: 1217 - DNA, 25 bp, Artificial Sequence
  Synthetic DNA Sequence
caaatgccatttcaagtaacacaac

SEQ ID NO: 1218 - DNA, 25 bp, Artificial Sequence
  Synthetic DNA Sequence
caaacgccatttcaagtaacacaac

SEQ ID NO: 1219 - DNA, 25 bp, Artificial Sequence
  Synthetic DNA Sequence
caaatgctatttcaagtaatacaac

SEQ ID NO: 1220 - DNA, 25 bp, Artificial Sequence
  Synthetic DNA Sequence
caaacgccatttcaagtaatacgac

SEQ ID NO: 1221 - DNA, 23 bp, Artificial Sequence
  Synthetic DNA Sequence
  modified_base (6): i
  modified_base (9): i
  modified_base (12): i
  modified_base (18): i
gayacnccnggncaygtngaytt

SEQ ID NO: 1222 - DNA, 26 bp, Artificial Sequence
  Synthetic DNA Sequence
  modified_base (9): i
  modified_base (12): i
  modified_base (15): i
  modified_base (21): i
atygayacnccnggncaygtngaytt

SEQ ID NO: 1223 - DNA, 26 bp, Artificial Sequence
  Synthetic DNA Sequence
  modified_base (3): i
  modified_base (6): i
  modified_base (12): i
  modified_base (24): i
ayntcnarrtgnarytcrcccatncc

SEQ ID NO: 1224 - DNA, 24 bp, Artificial Sequence
  Synthetic DNA Sequence
  modified_base (3): i
  modified_base (6): i
  modified_base (9): i
  modified_base (12): i
  modified_base (18): i
  modified_base (21): i
ccngynhtnytngarccnatnatg

SEQ ID NO: 1225 - DNA, 26 bp, Artificial Sequence
  Synthetic DNA Sequence
  modified_base (3): i
  modified_base (15): i
  modified_base (18): i
  modified_base (21): i
  modified_base (24): i
tanccraacatytcnsmnarnggnac

SEQ ID NO: 1226 - DNA, 20 bp, Artificial Sequence
  Synthetic DNA Sequence
  modified_base (3): i
  modified_base (9): i
gtnrmrtanccraacatytc

SEQ ID NO: 1227 - DNA, 26 bp, Artificial Sequence
  Synthetic DNA Sequence
  modified_base (3): i
  modified_base (6): i
  modified_base (9): i
  modified_base (12): i
  modified_base (24): i
gtnccnytnkcngaratgttyggnta

SEQ ID NO: 1228 - DNA, 29 bp, Artificial Sequence
  Synthetic DNA Sequence
  modified_base (3): i
  modified_base (6): i
  modified_base (9): i
  modified_base (12): i
  modified_base (24): i
gtnccnytnkcngaratgttyggntaygc

SEQ ID NO: 1229 - DNA, 26 bp, Artificial Sequence
  Synthetic DNA Sequence
  modified_base (9): i
  modified_base (12): i
  modified_base (15): i
  modified_base (18): i
  modified_base (21): i
tccatytgngcngcnccngtnatcat

SEQ ID NO: 1230 - DNA, 2145 bp, Escherichia coli
tgaacgcctaaaagataaacgaggaaacaaatggctcgtacaacacccatcgcacgctaccgtaacatcggtatcagtgcgcacatcgacgccggtaaaaccactactaccgaacgtattctgttctacaccggtgtaaaccataaaatcggtgaagttcatgacggcgctgcaaccatggactggatggagcaggagcaggaacgtggtattaccatcacttccgctgcgactactgcattctggtctggtatggctaagcagtatgagccgcatcgcatcaacatcatcgacaccccggggcacgttgacttcacaatcgaagtagaacgttccatgcgtgttctcgatggtgcggtaatggtttactgcgcagttggtggtgttcagccgcagtctgaaaccgtatggcgtcaggcaaacaaatataaagttccgcgcattgcgttcgttaacaaaatggaccgcatgggtgcgaacttcctgaaagttgttaaccagatcaaaacccgtctgggcgcgaacccggttccgctgcagctggcgattggtgctgaagaacatttcaccggtgttgttgacctggtgaaaatgaaagctatcaactggaacgacgctgaccagggcgtaaccttcgaatacgaagatatcccggcagacatggttgaactggctaacgaatggcaccagaacctgatcgaatccgcagctgaagcttctgaagagctgatggaaaaatacctgggtggtgaagaactgactgaagcagaaatcaaaggtgctctgcgtcagcgcgttctgaacaacgaaatcatcctggtaacctgtggttctgcgttcaagaacaaaggtgttcaggcgatgctggatgcggtaattgattacctgccatccccggttgacgtacctgcgatcaacggtatcctggacgacggtaaagacactccggctgaacgtcacgcaagtgatgacgagccgttctctgcactggcgttcaaaatcgctaccgacccgtttgttggtaacctgaccttcttccgtgtttactccggtgtggttaactctggtgataccgtactgaactccgtgaaagctgcacgtgagcgtttcggtcgtatcgttcagatgcacgctaacaaacgtgaagagatcaaagaagttcgcgcgggcgacatcgctgctgctatcggtctgaaagacgtaaccactggtgacaccctgtgtgacccggatgcgccgatcattctggaacgtatggaattccctgagccggtaatctccatcgcagttgaaccgaaaaccaaagctgaccaggaaaaaatgggtctggctctgggccgtctggctaaagaagacccgtctttccgtgtatggactgacgaagaatctaaccagaccatcatcgcgggtatgggcgaactgcacctcgacatcatcgttgaccgtatgaagcgtgaattcaacgttgaagcgaacgtaggtaaaccgcaggttgcttaccgtgaaactatccgccagaaagttaccgatgttgaaggtaaacacgcgaaacagtctggtggtcgtggtcagtatggtcatgttgttatcgacatgtacccgctggagccgggttcaaacccgaaaggctacgagttcatcaacgacattaaaggtggtgtaatccctggcgaatacatcccggccgttgataaaggtatccaggaacagctgaaagcaggtccgctggcaggctacccggtagtagacatgggtattcgtctgcacttcggttcttaccatgacgttgactcctctgaactggcgtttaaactggctgcttctatcgcctttaaagaaggctttaagaaagcgaaaccagttctgcttgagccgatcatgaaggttgaagtagaaactccggaagagaacaccggtgacgttatcggtgacttgagccgtcgtcgtggtatgctcaaaggtcaggaatctgaagttactggcgttaagatccacgctgaagtaccgctgtctgaaatgttcggatacgcaactcagctgcgttctctgaccaaaggtcgtgcatcatacactatggaattcctgaagtatgatgaagcgccgagtaacgttgctcaggccgtaattgaagcccgtggtaaataa

SEQ ID NO: 1231 - DNA, 37 bp, Artificial Sequence
  Synthetic DNA Sequence
gcgagcccgaagataaaaaagaacctctgctgctcgc

SEQ ID NO: 1232 - DNA, 42 bp, Artificial Sequence
  Synthetic DNA Sequence
ggagccgcgcgattttataaatgaatgttgataaccggctcc

SEQ ID NO: 1233 - DNA, 35 bp, Artificial Sequence
  Synthetic DNA Sequence
gcgagcgttactggtgtagaaatgttccggctcgc

SEQ ID NO: 1234 - DNA, 20 bp, Artificial Sequence
  Synthetic DNA Sequence
actaaataaacgctcattcg

SEQ ID NO: 1235 - DNA, 38 bp, Artificial Sequence
  Synthetic DNA Sequence
gcgagccgaagttgaagttgttggtattgctggctcgc

SEQ ID NO: 1236 - DNA, 34 bp, Artificial Sequence
  Synthetic DNA Sequence
gcgagccgtggtgaagttcgcgttggtggctcgc

SEQ ID NO: 1237 - DNA, 38 bp, Artificial Sequence
  Synthetic DNA Sequence
gcgagccgcgaaatcgaagttgctgtattagggctcgc

SEQ ID NO: 1238 - DNA, 38 bp, Artificial Sequence
  Synthetic DNA Sequence
gcgagcggcgttaattttggcaccgaagaagagctcgc

SEQ ID NO: 1239 - DNA, 33 bp, Artificial Sequence
  Synthetic DNA Sequence
gcgagcgcagacctttcagcagaggaggctcgc

SEQ ID NO: 1240 - DNA, 38 bp, Artificial Sequence
  Synthetic DNA Sequence
gcgagccggcaagacaatatgacagcaaaatcgctcgc

SEQ ID NO: 1241 - DNA, 35 bp, Artificial Sequence
  Synthetic DNA Sequence
gcgagcggggaacgaggatgatttgattggctcgc

SEQ ID NO: 1242 - DNA, 600 bp, Enterococcus faecium
  strain BM4147-1
ttcttagagacattgaatatgccttatgtcggcgcaggcgtattgaccagtgcatgtgccatggataaaatcatgaccaagtatattttacaagctgctggtgtgccgcaagttccttatgtaccagtacttaagaatcaatggaaagaaaatcctaaaaaagtatttgatcaatgtgaaggttctttgctttatccgatgtttgtcaaacctgcgaatatgggttctagtgtcggcattacaaaggcagaaaaccgagaagagctgcaaaatgctttagcaacagcctatcagtatgattctcgagcaatcgttgaacaaggaattgaagcgcgcgaaatcgaagttgctgtattaggaaatgaagatgttcggacgactttgcctggcgaagtcgtaaaagacgtagcattctatgattatgaagccaaatatatcaataataaaatcgaaatgcagattccagccgaagtgccggaagaagtttatcaaaaagcgcaagagtacgcgaagttagcttacacgatgttaggtggaagcggattgagccggtgcgatttctttttgacaaataaaaatgaattattcctgaatgaatta

SEQ ID NO: 1243 - DNA, 2275 bp, Enterococcus faecalis
ggtaccaaagaaaaaaacgaacgccacaaccaacagcctctaaagcaacacctgcttctgaaattgagggagatttagcaaatgtcaatgagattcttttggttcacgatgatcgtgtcgggtcagcaacgatgggaatgaaagtcttagaagaaattttagataaagagaaaatttcaatgccgattcgaaaaattaatattaatgaattaactcaacaaacacaggctttaattgtcacaaaagctgaactaacggaacaagcacgtaaaaaagcaccgaaagcgacacacttatcagtaaaaagttatggttaatccccaaaaatatgaaacagtgggtttcgctcttaaaagaaagtgcctagagaggaagaaaacaatggaaaatcttacgaatatttcaattgaattaaatcaacagtttaatacaaaagaagaagctattcgcttttccggccagaaactagtcgaggcaggctgtgttgagcccgcttatatcgaagcaatgattgaaagagaccaattgctatctgcccatatggggaattttattgccattcctcatggaacagaagaagccaaaaaattagtgaaaaaatcaggaatctgtgtagtgcaagtcccagagggcgttaattttggcaccgaagaagatgaaaaaattgctaccgtattatttgggattgccggagtcggtgaagaacatttgcaattagtccaacaaattgcactttattgtagtgatatggataacgtggtgcaacttgccgatgcattaagtaaagaagaaataacagaaaatttagccattgcttaaaggagagaataagaatgaacgcagtacattttggagcaggaaatattggacgcggctttattggcgaaattttagctaaaacgggtttcatattaccgtttgtggatgttaatggaaaccatcatcaagcgttaaaagaacgtaaaagttatacaattgaattggccgatgcctcacatcaacaaattaacgttgaaaatgtgaccgggttaaataacatgacagaaccagaaaaagtagtagaagcaattgcggaagccgatttagtcacgacggcaattggtcctaatattttaccaagaattgctgaattaattgctcaaggaattgatgcacgtgccgaagcaaattgtcaaaacggcccgctggatattatcgcttgtgaaaatatgattggtggttcaacctttttagcagaagaagtggccataatatttgaaaaacccagcttatctgaacaatggattggttttcctgatgcggcagttgatcggattgttccattacaaaaacataaagatccactttttgttcaagttgagcctttttgtgaatgggtcattgatgataccaaccgaaaagccaaagagattcagttagaaggcgtcattacttgtcgattagagccgtatattgaacgaaaattatttagtgtaaccagtggccatgctacagttgcctatacaggggcgttgttaggctatcaaaccattgacgaagcgatgcaggacgccttagtggtagcgcaactcaaatcagttttgcaggaaaccggtaaacttttagtggccaaatggaattttgatgaacaagaacatgcagcctatattgaaaaaattatcaaccgtttccaaaataaatatatttcagatgctattacacgtgtagcacggacaccaatcagaaaattaggtgcgcaagaacggtttattcgaccaatccgtgaattacaggaacgcaatctagtgtcggccgcatttatagcaatgattggtattgtctttaattatcatgatccagaagatgaacaaagccgtcaattacaggaaatgcttgaccaagaaagtgttgatacagtggatcgctgaagtaacgggcattgaagatccagaaacggttaaaaatattaaacaaaacgtagaactgctatgcgcgaccacaagtagcataattaacaaaatccttctaccaagatacttcacatttcttaattaaagaaaaaacaaccgcgcctcacctgagccgacccccaaaagttagacctagaaatctaacttttggaggtttttttgtatggcaaaatacagttttgaaatttaaacttaaacttgttcatgactacttatatggtcaaggaggtctaaggtttctcgcaaagaagtatgggtttaaagatagtctcaaataagcaaatggataaatgcctataaagaacttggtgaagaaggggggatcc

SEQ ID NO: 1244 - DNA, 442 bp, Staphylococcus aureus subsp. aureus
  ref <308>: DATABASE ACCESSION NUMBER: ATCC 25923
gatcaatctttgtcggtacacgatattcttcacgactaaataaacgctcattcgcgattttataaatgaatgttgataacaatgttgtattatctactgaaatctcattacgttgcatcggaaacattgtgttctgtatgtaaaagccgtcttgataatctttagtagtaccgaagctggtcatacgagagttatattttccagccaaaacgatatttttataatcattacgtgaaaaaggtttcccttcattatcacacaaatattttagcttttcagtttctatatcaactgtagcttctttatccatacgttgaataattgtacgattctgacgcaccatcttttgcacacctttaatgttatttgttttaaaagcatgaataagtttttcaacacaacgatgtgaatcttctaagaagtcaccgtaaaatgaaggatc

SEQ ID NO: 1245 - DNA, 845 bp, Bacillus anthracis
  strain CIP 9444
gatggcggaaagctaccagaaatctacaacgcccttacggtaaaacagagcaacgaaaacggaacaagcattaacttaacatttgaagttgcacttcatttaggtgatgacacagttcgtacagttgcaatgtcttccacagatggacttgttcgtggcacagaagtagaagatactggtaaagcaatctctgtaccagttggtgatgcaacacttggtcgtgtatttaacgtattaggtgatgcaattgacttagatggtgaggttcctgcggatgtacgtcgtgatccaattcaccgtcaagcacctgcattcgaagaattatctactaaagtagaaattcttgaaactggtattaaagtagtagacttacttgctccttacattaagggtggtaagatcggtctattcggtggtgccggtgtaggtaaaacggtattaattcaggaattaatcaataacatcgcacaagaacacggtggtatctctgtattcgctggtgtaggtgagcgtactcgtgagggtaatgacttataccacgaaatgagcgattctggcgtaattaagaaaactgcgatggtattcggacaaatgaacgagccacctggagcacgtcaacgtgttgcgttaacaggtttaacaatggctgagcatttccgtgatgagcaaggacaagatgtacttctgttcatcgataatatcttccgtttcacgcaagcaggttctgaagtatctgcccttcttggccgtatgccatctgcggtaggttaccaaccaacacttgcaacagaaatgggtcaattacaagagcgtattacatctacaaataaagggtctatcacgtc

SEQ ID NO: 1246 - DNA, 656 bp, Bacillus mycoides
  ref <308>: DATABASE ACCESSION NUMBER: ATCC 11986
tgcacttcatttaggtgatgacacagttcgtacagttgcaatgtcttccacagatggacttgttcgtggcacagaagtagaagatactggtaaagcaatctctgtaccagttggtgatgtaacacttggtcgtgtatttaacgtattaggtgatgcaattgacttagatggtgatgttcctgcggatgtacgtcgtgatccaattcaccgtcaagcgcctgcattcgaagagttatctactaaagtagaaattcttgaaactggtattaaagtagtagacttacttgctccttacattaagggtggtaagattggtctattcggtggtgccggcgtaggtaaaacagtattaattcaggaattaattaataacatcgcacaagagcacggtggtatctctgtattcgctggtgtaggtgagcgtactcgtgaaggtaacgacttataccacgaaatgagcgattctggcgtaattaagaaaactgcgatggtattcggacaaatgaacgagccacctggagcacgtcaacgtgttgcattaacaggtttaacaatggctgaacatttccgtgatgagcaaggacaagacgtactattgttcatcgataacatcttccgtttcacgcaagcgggttctgaagtatctgcccttcttg

SEQ ID NO: 1247 - DNA, 791 bp, Bacillus thuringiensis
  ref <308>: DATABASE ACCESSION NUMBER: ATCC 10792
cgaaaacggaagtattaacttaacatttgaagttgcacttcatttaggtgatgatacagttcgtacagttgcgatgtcttccacagatggacttgttcgtggcacagaagtagaagatactggtaaaccaatctctgtaccagttggtgatgtaacacttggtcgcgtatttaacgtattaggtgatgcaattgacttagatggtgaggttcctgcagatgtacatcgtgatccaattcaccgtcaagcacctgcattcgaagaattatctactaaagtagaaattcttgaaactggtattaaagtagtagacttacttgctccttacattaagggtggtaagatcggcctattcggtggtgccggcgtaggtaaaacagtattaattcaggaattaattaacaacatcgcacaagagcacggtggtatctctgtattcgctggtgtaggtgagcgtactcgtgagggtaatgacttataccacgaaatgagcgattctggcgtaatcaagaaaactgcgatggtattcggacaaatgaacgagccacctggagcacgtcaacgtgttgcattaacaggtttaacaatggctgagcatttccgtgatgagcaaggacaagacgtacttctgttcatcgataacatcttccgtttcacgcaagcgggttctgaagtatctgcccttcttggtcgtatgccatctgcggtaggttaccaaccaacacttgcaacagaaatgggtcaattacaagagcgtattacatctacaaataaagggtctatcacgtcta

SEQ ID NO: 1248 - DNA, 825 bp, Bacillus thuringiensis
  strain BGSC 4AC1
atctacaatgcccttacggtaaaacaaagcaacgaaaacggaagcatgaacttaacatttgaagttgcacttcatttaggtgatgatacagttcgtacagttgcgatgtcttccacagatggacttgttcgtggcacagaagtagaagatactggtaaagcaatctctgtaccagttggtgatgcaacacttggacgtgtattcaacgtattaggtgatgcaattgacttagatggtgaacttcctgcggatgtacaccgtgatccaattcaccgtcaagcacctgcattcgaagaattatctactaaagtagaaattcttgaaactggtattaaagtagtagacttacttgctccttacattaagggtggtaagatcggcctattcggtggtgccggcgtaggtaaaacagtattaattcaggagttaatcaataacatcgcacaagagcacggtggtatctctgtattcgctggtgtaggtgagcgtactcgtgagggtaatgacttataccacgaaatgagcgattctggcgtaatcaagaaaactgcgatggtattcggacaaatgaacgagccacctggagcacgtcaacgtgttgcattaacaggtttaacaatggctgagcatttccgtgatgagcaaggacaagacgtacttctgttcatcgataacatcttccgtttcacgcaagcgggttctgaagtatctgcccttcttggtcgtatgccatctgcggtaggttaccaaccaacacttgcaacagaaatgggtcaattacaagagcgtattacatctacaaataaagggtctatcacgtctatc

SEQ ID NO: 1249 - DNA, 775 bp, Bacillus thuringiensis
  strain HER 1236
atctacaacgcccttacggtaaaacaaagcaacgaaaacggaagtattaacttaacatttgaagttgcacttcatttaggtgatgatacagttcgtacagttgcgatgtcttccacagatggacttgttcgtggcacagaagtagaagatactggtaaaccaatctctgtaccagttggtgatgtaacacttggtcgcgtatttaacgtattaggtgatgcaattgacttagatggtgaggttcctgcagatgtacatcgtgatccaattcaccgtcaagcacctgcattcgaagaattatctactaaagtagaaattcttgaaactggtattaaagtagtagacttacttgctccttacattaagggtggtaagatcggcctattcggtggtgccggcgtaggtaaaacagtattaattcaggaattaattaacaacatcgcacaagagcacggtggtatctctgtattcgctggtgtaggtgagcgtactcgtgagggtaatgacttataccacgaaatgagcgattctggcgtaatcaagaaaactgcgatggtattcggacaaatgaacgagccacctggagcacgtcaacgtgttgcattaacaggtttaacaatggctgagcatttccgtgatgagcaaggacaagacgtacttctgttcatcgataacatcttccgtttcacgcaagcgggttctgaagtatctgcccttcttggtcgtatgccatctgcggtaggttaccaaccaacacttgcaacagaaatgggtc

SEQ ID NO: 1250 - DNA, 832 bp, Bacillus weihenstephanensis
  strain WSBC 10204
ccagcaatctacaacgcccttacggtaaaacaaagcaacgaaaacggagcgagcatcaacttaacatttgaagttgcacttcatttaggtgatgacacagttcgtacagttgcgatgtcttccacagatggacttgttcgtggcacagaagtagaagatactggtaaagcaatctctgtaccagttggtgatgtaacacttggtcgcgtattcaacgtattaggtgatgcaattgacttagatggtgatgttcctgcggatgtacgtcgtgatccaattcaccgtcaagcacctgcattcgaagaactatctacaagaatagaaattcttgaaactggtattaaagtagtagatttacttgctccttacattaagggtggtaagatcggtctattcggtggtgccggtgtaggtaaaacggtattaattcaggaattaattaacaacatcgcacaagagcacggtggtatctctgtattcgctggtgtaggtgagcgtactcgtgagggtaatgacttataccacgaaatgagcgattctggcgtaattaagaaaactgcgatggtatttggacaaatgaacgagccacctggagcacgtcaacgtgttgcattaacaggtttaacaatggctgaacatttccgtgatgagcaaggacaagacgtactattgttcatcgataacatcttccgtttcacgcaagcaggttctgaagtatctgcccttcttggtcgtatgccatctgcggtaggttaccaaccaacacttgcaacagaaatgggtcaattacaagagcgtattacatctacaaataaagggtctatcacgtcta

SEQ ID NO: 1251 - DNA, 802 bp, Bacillus thuringiensis
  strain HER 1418
aaatctacaacgcccttacggtaaaacaaagcaacgaaaacggaagtattaacttaacatttgaagttgcacttcatttaggtgatgatacagttcgtacagttgcgatgtcttccacagatggacttgttcgtggcacagaagtagaagatactggtaaaccaatctctgtaccagttggtgatgtaacacttggtcgcgtatttaacgtattaggtgatgcaattgacttagatggtgaggttcctgcagatgtacatcgtgatccaattcaccgtcaagcacctgcattcgaagaattatctactaaagtagaaattcttgaaactggtattaaagtagtagacttacttgctccttacattaagggtggtaagatcggcctattcggtggtgccggcgtaggtaaaacagtattaattcaggaattaattaacaacatcgcacaagagcacggtggtatctctgtattcgctggtgtaggtgagcgtactcgtgagggtaatgacttataccacgaaatgagcgattctggcgtaatcaagaaaactgcgatggtattcggacaaatgaacgagccacctggagcacgtcaacgtgttgcattaacaggtttaacaatggctgagcatttccgtgatgagcaaggacaagacgtacttctgttcatcgataacatcttccgtttcacgcaagcgggttctgaagtatctgcccttcttggtcgtatgccatctgcggtaggttaccaaccaacacttgcaacagaaatgggtcaattacaagagcgtattacatctac

SEQ ID NO: 1252 - DNA, 823 bp, Bacillus thuringiensis
  strain HER 1410
aaatctacaacgcccttacggtaaaacaaagcaacgaaaacggaagtattaacttaacatttgaagttgcacttcatttaggtgatgatacagttcgtacagttgcaatgtcttccacagatggacttgttcgtggcacagaagtagaagatactggtaaaccaatctctgtaccagttggtgatgtaacacttggtcgcgtatttaacgtattaggtgatgcaattgacttagatggtgaggttcctgcagatgtacatcgtgatccaattcaccgtcaagcacctgcattcgaagaattatctactaaagtagaaattcttgaaactggtattaaagtagtagacttacttgctccttacattaagggtggtaagatcggcctattcggtggtgccggcgtaggtaaaacagtattaattcaggaattaattaacaacatcgcacaagagcacggtggtatctctgtattcgctggtgtaggtgagcgtactcgtgagggtaatgacttataccacgaaatgagcgattctggcgtaatcaagaaaactgcgatggtattcggacaaatgaacgagccacctggagcacgtcaacgtgttgcattaacaggcttaacaatggctgagcatttccgtgatgagcaaggacaagacgtacttctgttcatcgataacatcttccgtttcacgcaagcgggttctgaagtatctgcccttcttggtcgtatgccatctgcggtaggttaccaaccaacacttgcaacagaaatgggtcaattacaagagcgtattacatctacaaataaagggtctatcacgtc

SEQ ID NO: 1253 - DNA, 798 bp, Bacillus cereus
  ref <308>: DATABASE ACCESSION NUMBER: ATCC 13472
ccagaaatctacaatgcccttacggtaaaacaaagcaacgaaaacggaagcatgaacttaacatttgaagttgcacttcatttaggtgatgatacagttcgtacagttgcgatgtcttccacagatggacttgttcgtggcacagaagtagaagatactggtaaagcaatctctgtaccagttggtgatgcaacacttggacgtgtattcaacgtattaggtgatgcaattgacttagatggtgaacttcctgcggatgtacaccgtgatccaattcaccgtcaagcacctgcattcgaagaattatctactaaagtagaaattcttgaaactggtattaaagtagtagacttacttgctccttacattaagggtggtaagatcggcctattcggtggtgccggcgtaggtaaaacagtattaattcaggaattaatcaataacatcgcacaagagcatggtggtatctctgtattcgctggtgtaggtgagcgtactcgtgagggtaatgacttataccacgaaatgagcgattctggcgtaatcaagaaaactgcgatggtattcggacaaatgaacgagccacctggagcacgtcaacgtgttgcattaacaggtttaacaatggctgagcatttccgtgatgagcaaggacaagacgtacttctgttcatcgataacatcttccgtttcacgcaagcgggttctgaagtatctgcccttcttggtcgtatgccatctgcggtaggttaccaaccgacacttgcaacagaaatgggtcaattacaagagcgtatt

SEQ ID NO: 1254 - DNA, 767 bp, Bacillus cereus
  ref <308>: DATABASE ACCESSION NUMBER: ATCC 7064
catttgaagttgcacttcatttaggtgatgacacagttcgtacagttgcaatgtcttccacagatggacttgttcgtggcacagaagtagaagatactggtaaagcaatctctgtaccagttggtgatgcaacacttggtcgtgtatttaacgtattaggtgatgcaattgacttagatggtgaggttcctgcggatgtacgtcgtgatccaattcaccgtcaagcacctgcattcgaagaattatctactaaagtagaaattcttgaaactggtattaaagtagtagacttacttgctccttacattaagggtggtaagatcggtctattcggtggtgccggtgtaggtaaaacggtattaattcaggaattaatcaataacatcgcacaagaacacggtggtatctctgtattcgctggtgtaggtgagcgtactcgtgagggtaatgacttataccacgaaatgagcgattctggcgtaattaagaaaactgcgatggtattcggacaaatgaacgagccacctggagcacgtcaacgtgttgcgttaacaggtttaacaatggctgagcatttccgtgatgagcaaggacaagacgtacttctgttcatcgataatatcttccgtttcacgcaagcaggttctgaagtatctgcccttcttggccgtatgccatctgcggtaggttaccaaccaacacttgcaacagaaatgggtcaattacaagagcgtattacatctacaaataaagggtctatcacgtct

SEQ ID NO: 1255 - DNA, 1174 bp, Staphylococcus aureus
  strain C-14
  misc_feature (1)...(1174): n=a,t,c or g
gaaatgcgtgaatcatttttagattatgcgatgagtgttatcgttgctcgtgcattgccagatgttcgtgacggtttaaaaccagtacatcgtcgtatactatatggattaaatgaacaaggtatgacaccggataaatcatataaaaaatcagcacgtatcgttggtgacgtaatgggtaaatatcaccctcatggtgacttatctatttatgaagcaatggtacgtatggctcaagatttcagttatcgttatccgcttgttgatggccaaggtaactttggttcaatggatggagatggcgcagcagcaatgcgttatactgaagcgcgtatgactaaaatcacacttgaactgttacgtgatattaataaagatacaatagattttatcgataactatgatggtaatgaaagagagccgtcagtcttacctgctcgattccctaacttattagccaatggtgcatcaggtatcgcggtaggtatggcaacgaatattccaccacataacttaacagaattaatcaatggtgtacttagcttaagtaagaaccctgatatttcaattgctgagttaatggaggatattgaaggtcctgatttcccaactgctggacttattttaggtaagagtggtattagacgtgcatatgaaacaggtcgtggttcaattcaaatgcgttctcgtgcagttattgaagaacgtggagncggacgtcaacgtattgttgtcactgaaattcctttccaagtgaataaggctcgtatgattgaaaaaattgcagagctcgttcgtgacaagaaaattgacggtatcactgatttacgtgatgaaacaagtttacgtactggtgtgcgtgtcgttattgatgtgcgtaaggatgcaaatgctagtgtcattttaaataacttatacaaacaaacacctcttcaaacatcatttggtgtgaatatgattgcacttgtaaatggtagaccgaagcttattaatttaaaagaagcgttggtacattatttagagcatcaaaagacagttgttagaagacgtacgcaatacaacttacgtaaagctaaagatcgtgcccacattttagaaggattacgtatcgcacttgaccatatcgatgaaattatttcaacgattcgtgagtcagatacagataaagttgcaa

SEQ ID NO: 1256 - DNA, 780 bp, Bacillus weihenstephanensis
  strain WSBC 10209
atctacaacgcccttacggtaaaacaaagcaacgaaaacggagcaagcattaacttaacatttgaagttgcacttcatttaggtgatgacacagttcgtacagttgcaatgtcttccacagatggacttgttcgtggcacagaagtagaagatactggtaaagcaatctctgtaccagttggtgatgtaacacttggtcgtgtatttaacgtattaggtgatgcaattgacttagatggagatgttcctgcggatgtacgtcgtgatccaattcaccgtcaagcgcctgcattcgaagagttatctactaaagtagaaattcttgaaactggtattaaagtagtagacttacttgctccttacattaagggtggtaagatcggtctattcggtggtgccggtgtaggtaaaacagtattaattcaggaattaattaacaacatcgcacaagagcacggtggtatctctgtattcgctggtgtaggtgagcgtactcgtgaaggtaacgacttataccacgaaatgagcgattctggcgtaattaagaaaactgcgatggtattcggacaaatgaacgagccacctggagcacgtcaacgtgttgcattaacaggtttaacaatggctgaacatttccgtgatgagcaagggcaagacgtactattgttcatcgataacatcttccgtttcacgcaagcgggttctgaagtatctgcccttcttggtcgtatgccatctgcggtaggttaccagccaacacttgcaacagaaatgggtcaa

SEQ ID NO: 1257 - DNA, 817 bp, Bacillus anthracis
  strain CIP 7700
ctaccagaaatctacaacgcccttacggtaaaacagagcaacgaaaacggaacaagcattaacttaacatttgaagttgcacttcatttaggtgatgacacagttcgtacagttgcaatgtcttccacagatggacttgttcgtggcacagaagtagaagatactggtaaagcaatctctgtaccagttggtgatgcaacacttggtcgtgtatttaacgtattaggtgatgcaattgacttagatggtgaggttcctgcggatgtacgtcgtgatccaattcaccgtcaagcacctgcattcgaagaattatctactaaagtagaaattcttgaaactggtattaaagtagtagacttacttgctccttacattaagggtggtaagatcggtctattcggtggtgccggtgtaggtaaaacggtattaattcaggaattaatcaataacatcgcacaagaacacggtggtatctctgtattcgctggtgtaggtgagcgtactcgtgagggtaatgacttataccacgaaatgagcgattctggcgtaattaagaaaactgcgatggtattcggacaaatgaacgagccacctggagcacgtcaacgtgttgcgttaacaggtttaacaatggctgagcatttccgtgatgagcaaggacaagatgtacttctgttcatcgataatatcttccgtttcacgcaagcaggttctgaagtatctgcccttcttggccgtatgccatctgcggtaggttaccaaccaacacttgcaacagaaatgggtcaattacaagagcgtattacatctacaaata

SEQ ID NO: 1258 - DNA, 829 bp, Bacillus thuringiensis
  strain HER 1404
ccagaaatctacaacgcccttacggtaaaacaaagcaacgaaaacggaagtattaacttaacatttgaagttgcacttcatttaggtgatgatacagttcgtacagttgcgatgtcttccacagatggacttgttcgtggcacagaagtagaagatactggtaaaccaatctctgtaccagttggtgatgtaacacttggtcgcgtatttaacgtattaggtgatgcaattgacttagatggtgaggttcctgcagatgtacatcgtgatccaattcaccgtcaagcacctgcattcgaagaattatctactaaagtagaaattcttgaaactggtattaaagtagtagacttacttgctccttacattaagggtggtaagatcggcctattcggtggtgccggcgtaggtaaaacagtattaattcaggaattaattaacaacatcgcacaagagcacggtggtatctctgtattcgctggtgtaggtgagcgtactcgtgagggtaatgacttataccacgaaatgagcgattctggcgtaatcaagaaaactgcgatggtattcggacaaatgaacgagccacctggagcacgtcaacgtgttgcattaacaggtttaacaatggctgagcatttccgtgatgagcaaggacaagacgtacttctgttcatcgataacatcttccgtttcacgcaagcgggttctgaagtatctgcccttcttggtcgtatgccatctgcggtaggttaccaaccaacacttgcaacagaaatgggtcaattacaagagcgtattacatctacaaataaagggtctatcacgtcta

SEQ ID NO: 1259 - DNA, 844 bp, Bacillus cereus
  ref <308>: DATABASE ACCESSION NUMBER: ATCC 15816
tggcggaaagctaccagaaatctacaacgcccttacggtaaaacagagcaacgaaaacggtgaacttaacttaacatttgaagttgcacttcatttaggtgatgatacagttcgtacagttgcgatgtcttccacagatggacttgttcgtggcacagaagtagaagatactggtaaagcaatctctgtaccagttggtgatgcaacacttggtcgcgtatttaacgtattaggtgatgctattgacttagatggtgaggttcctgcggatgtacgtcgtgatccaattcaccgtcaagcacctgcattcgaagaattatctactaaagtagaaattcttgaaactggtattaaagtagtagacttacttgctccttacattaagggtggtaagatcggcctattcggtggtgccggtgtaggtaaaacagtattaattcaggagttaatcaacaacatcgcacaagagcacggtggtatctctgtattcgctggtgtaggtgagcgtactcgtgagggtaatgacttataccacgaaatgagcgattctggcgtaattaagaaaactgcgatggtattcggacaaatgaacgagccacctggagcacgtcaacgtgttgcattaacaggcttaacaatggctgaatatttccgtgatgagcaaggacaagacgtacttctgttcatcgataatatcttccgtttcacgcaagcaggttctgaagtatctgcccttcttggccgtatgccatctgcggtaggttaccaaccaacacttgcaacagaaatgggtcaattacaagagcgtattacatctacaaataaagggtctatcacgtctatc

SEQ ID NO: 1260 - DNA, 840 bp, Bacillus cereus
  ref <308>: DATABASE ACCESSION NUMBER: ATCC 49064
aagctaccagaaatctacaacgcccttacggtaaaacagagcaacgaaaacggaacaagcattaacttaacatttgaagttgcacttcatttaggtgatgacacagttcgtacagttgcaatgtcttccacagatggacttgttcgtggcacagaagtagaagatactggtaaagcaatctctgtaccagttggtgatgcaacacttggtcgtgtatttaacgtattaggtgatgcaattgacttagatggtgaggttcctgcggatgtacgccgtgatccaattcaccgtcaagcacctgcattcgaagaattatctactaaagtagaaattcttgaaactggtattaaagtagtagacttacttgctccttacattaagggtggtaagatcggtctattcggtggtgccggtgtaggtaaaacagtattaattcaggaattaatcaacaacatcgcacaagaacacggtggtatctctgtattcgctggtgtaggtgagcgtactcgtgagggtaatgacttataccacgaaatgagcgattcaggcgtaattaagaaaactgcgatggtattcggacaaatgaacgagccacctggagcgcgtcaacgtgttgcgttaacaggtttaacaatggctgagcatttccgtgatgagcaaggacaagacgttcttctgttcatcgataatatcttccgtttcacgcaagcaggttctgaagtatctgcccttcttggtcgtatgccatctgcggtaggttaccaaccaacacttgcaacagaaatgggtcaattacaagagcgtattacatctacaaataaagggtctatcacgtctatc

SEQ ID NO: 1261 - DNA, 839 bp, Bacillus thuringiensis
  strain BGSC 4AZ1
gcggaaagctaccagaaatctacaatgcccttacggtaaaacaaagcaacgaaaacggaagcatgaacttaacatttgaagttgcacttcatttaggtgatgatacagttcgtacagttgcgatgtcttccacagatggacttgttcgtggcacagaagtagaagatactggtaaagcaatctctgtaccagttggtgatgcaacacttggacgtgtattcaacgtattaggtgatgcaattgacttagatggtgaacttcctgcggatgtacaccgtgatccaattcaccgtcaagcacctgcattcgaagaattatctactaaagtagaaattcttgaaactggtattaaagtagtagacttacttgctccttacattaagggtggtaagatcggcctattcggtggtgccggcgtaggtaaaacagtattaattcaggagttaatcaataacatcgcacaagagcacggtggtatctctgtattcgctggtgtaggtgagcgtactcgtgagggtaatgacttataccacgaaatgagcgattctggcgtaatcaagaaaactgcgatggtattcggacaaatgaacgagccacctggagcacgtcaacgtgttgcattaacaggtttaacaatggctgagcatttccgtgatgagcaaggacaagacgtacttctgttcatcgataacatcttccgtttcacgcaagcgggttctgaagtatctgcccttcttggtcgtatgccatctgcggtaggttaccaaccaacacttgcaacagaaatgggtcaattacaagagcgtattacatctacaaataaagggtctatcacgtct

SEQ ID NO: 1262 - DNA, 833 bp, Bacillus thuringiensis
  strain BGSC 4H2
aagctaccagaaatctacaatgcccttacggtaaaacaaagcaacgaaaacggaagcatgaacttaacatttgaagttgcacttcatttaggtgatgatacagttcgtacagttgcgatgtcttccacagatggacttgttcgtggcacagaagtagaagatactggtaaagcaatctctgtaccagttggtgatgcaacacttggacgtgtattcaacgtattaggtgatgcaattgacttagatggtgaacttcctgcggatgtacaccgtgatccaattcaccgtcaagcacctgcattcgaagaattatctactaaagtagaaattcttgaaactggtattaaagtagtagacttacttgctccttacattaagggtggtaagatcggcctattcggtggtgccggcgtaggtaaaacagtattaattcaggaattaatcaataacatcgcacaagagcacggtggtatctctgtattcgctggtgtaggtgagcgtactcgtgagggtaatgacttataccacgaaatgagcgattctggcgtaatcaagaaaactgcgatggtattcggacaaatgaacgagccacctggagcacgtcaacgtgttgcattaacaggtttaacaatggctgagcatttccgtgatgagcaaggacaagacgtacttctgttcatcgataacatcttccgtttcacgcaagcgggttctgaagtatctgcccttcttggtcgtatgccatctgcggtaggttaccaaccaacacttgcaacagaaatgggtcaattacaagagcgtattacatctacaaataaagggtctatcacgtc

SEQ ID NO: 1263 - DNA, 790 bp, Bacillus thuringiensis
  strain BGSC 4Q1
cgaaaacggaagcatgaacttaacatttgaagttgcacttcatttaggtgatgatacagttcgtacagttgcgatgtcttccacagatggacttgttcgtggcacagaagtagaagatactggtaaagcaatttctgtaccagttggtgatgtaacacttggacgtgtattcaacgtattaggtgatgcaattgacttagatggtgaacttcctgcggatgtacaccgtgatccaattcaccgtcaagcacctgcattcgaagaattatctactaaagtagaaattcttgaaactggtattaaagtagtagacttacttgctccttacattaagggtggtaagatcggcctattcggtggtgccggtgtaggtaaaacagtattaattcaggaattaattaacaacatcgcacaagagcacggtggtatctctgtattcgctggtgtaggtgagcgtactcgtgagggtaatgacttataccacgaaatgagcgattctggcgtaatcaagaaaactgcgatggtattcggacaaatgaacgagccacctggagcacgtcaacgtgttgcattaacaggtttaacaatggctgagcatttccgtgatgagcaaggacaagacgtacttctgttcatcgataacatcttccgtttcacgcaagcgggttctgaagtatctgcccttcttggtcgtatgccatctgcggtaggttaccaaccaacacttgcaacagaaatgggtcaattacaagagcgtattacatctacaaataaagggtctatcacgtct

SEQ ID NO: 1264 - DNA, 644 bp, Bacillus thuringiensis
  strain HER 1232
agttgcacttcatttaggtgatgatacagttcgtacagttgcgatgtcttccacagatggacttgttcgtggcacagaagtagaagatactggtaaaccaatctctgtaccagttggtgatgtaacacttggtcgcgtatttaacgtattaggtgatgcaattgacttagatggtgaggttcctgcagatgtacatcgtgatccaattcaccgtcaagcacctgcattcgaagaattatctactaaagtagaaattcttgaaactggtattaaagtagtagacttacttgctccttacattaagggtggtaagatcggcctattcggtggtgccggcgtaggtaaaacagtattaattcaggaattaattaacaacatcgcacaagagcacggtggtatctctgtattcgctggtgtaggtgagcgtactcgtgagggtaatgacttataccacgaaatgagcgattctggcgtaatcaagaaaactgcgatggtattcggacaaatgaacgagccacctggagcacgtcaacgtgttgcattaacaggtttaacaatggctgagcatttccgtgatgagcaaggacaagacgtacttctgttcatcgataacatcttccgtttcacgcaagcgggttctgaag

SEQ ID NO: 1265 - DNA, 823 bp, Bacillus anthracis
  ref <308>: DATABASE ACCESSION NUMBER: ATCC 4229
ggcggaaagctaccagaaatctacaacgcccttacggtaaaacagagcaacgaaaacggaacaagcattaacttaacatttgaagttgcacttcatttaggtgatgacacagttcgtacagttgcaatgtcttccacagatggacttgttcgtggcacagaagtagaagatactggtaaagcaatctctgtaccagttggtgatgcaacacttggtcgtgtatttaacgtattaggtgatgcaattgacttagatggtgaggttcctgcggatgtacgtcgtgatccaattcaccgtcaagcacctgcattcgaagaattatctactaaagtagaaattcttgaaactggtattaaagtagtagacttacttgctccttacattaagggtggtaagatcggtctattcggtggtgccggtgtaggtaaaacggtattaattcaggaattaatcaataacatcgcacaagaacacggtggtatctctgtattcgctggtgtaggtgagcgtactcgtgagggtaatgacttataccacgaaatgagcgattctggcgtaattaagaaaactgcgatggtattcggacaaatgaacgagccacctggagcacgtcaacgtgttgcgttaacaggtttaacaatggctgagcatttccgtgatgagcaaggacaagatgtacttctgttcatcgataatatcttccgtttcacgcaagcaggttctgaagtatctgcccttcttggccgtatgccatctgcggtaggttaccaaccaacacttgcaacagaaatgggtcaattacaagagcgtattacatctacaa

SEQ ID NO: 1266 - DNA, 715 bp, Paracoccidioides brasiliensis
  ref <308>: DATABASE ACCESSION NUMBER: ATCC 200443
tggtccgagrcccgattcmatgaaattatcaaggaaacctccaayttcattaagaaggtcggatataaccccaagactgttcctttcgttcccatttctggtttccagggtgacaacatgatcgatscctctgccaactgcccatggtacaagggctggtacmakgagactgccgacaggcaagyactctggcaagacccttcttgaggccattgacgscattgagccccccamscgtcctwccgataaacctctccgtcttcctctccaggatgtctacaagatctccggtattggmactgttcctgtcggacgtrttgagactggagtcatcaagcccggtatggtcgtgaccttcgctcccgccaacgtcaccactgaagtcaagtccgttgaaatgcaccaccagcagctttccgacggtawccccggtgacaacgtcggcttcaacgtcaagaatgtttccgtcaaagaagtccgccgtggtaacgttgcctggtgactctaagaatgatcccgcmawgggctgcgattccttcaatgcycaggtcatcgtcctcaaccaccctggtcaggttggcgctggttatgccccagtcctcgaytgccatactgcccacattgcytgcaarttcgctgagmtcmakgagaagattgaycgccgaaccggmaagtctgttgagaacgcccccaagttcatcaagtccggtgatgc

SEQ ID NO: 1267 - DNA, 875 bp, Blastomyces dermatitidis
  ref <308>: DATABASE ACCESSION NUMBER: ATCC 56220
gagtcctcttatttacttttgtcatgactaccttactaatctgtcatagatcgttacaacgaaatcgtcaaggagacttccaacttcatcaagaaggtcggatacaaccccaagaacgttcctttcgttcctatctccggtttcaacggcgacaacatgcttgagccctcccccaactgcccctggtacaagggttgggagaaggagaccaaggccggtaaggtcactggtaagaccctcctcgaggccatcgacgccattgagccccctacccgtcccgccaacaaggtcagtactacctcaattacttgaactctcttcatacgttccgattactgactgcttcacagcccctccgtcttcccctccaggacgtttacaagatcggtggtattggaacggtgcccgtcggtcgtgttgagaccggtaccatctcccctggtatggtcgttaccttgtatgtatcctgaccatcccccttggcaatcattacgtactaactcactcttcagcgctcccgccaacgtcaccactgaagtcaagagtgttgaaatgcaccaccagcagctcgctgccggtcagcccggtgacaacgttggtttcaacgtgaagaacgtctccgtcaaggaaatccgtcgtggtaacgttgctggtgatagcaagaacgacccccctgccggtgctgcttccttcaacgcccaggtcatcgtcctcaaccaccccggtcaggtcggtgctggttacgccccagtccttgactgccacactgcccacattgcttgcaagttctctgaactccttgagaagattgaccgtcgtaccggaaagtctgttgaggaccaccccaagttcatcaagtccggtgacgctgccat

SEQ ID NO: 1268 - DNA, 1124 bp, Histoplasma capsulatum
  strain WSA-377
gtgagcgtggtatcaccatcgatattgccctctggaaattcgagaccccgaagtacagtgtcactgtcattggtgagtgctttttacccctcttaagcagatttcaacttccagagtatctactctaacatatccgcttagatgctcccggccatcgtgacttcatcaagaacatgatcactggtacctcccaggctgactgcgctatcctcatcattgctgccggtactggtgagttcgaggctggtatctccaaggatggccagactcgtgagcacgctctgcttgctttcacccttggtgtgaggcaactcatcgttgccatcaacaagatggacaccaccaagtggtccgagtcccgtttcaacgaaatcatcaaggaggtttccaacttcatcaagaaggtcggatataaccccaaggctgttcccttcgtgccaatctctggtttcgagggtgacaacatgattgaaccctcccccaactgcacctggtacaagggctggaacaaggagactgcctctggcaagtcttctggtaaaacccttctcgatgccattgacgccattgaacccccaacccgtcctaccgataagcctctccgtcttcccctccaggatgtttacaaaatctctggtattggcactgttcccgtcggacgtgttgagactggtgtcatcaagcccggtatggtcgtgactttcgctccctccaacgtcaccactgaagtcaagtccgtcgagatgcaccaccaacaactccaggctggttaccctggtgacaacgtcggcttcaacgtcaagaacgtttcagtcaaggaagtccgccgtggcaacgttgctggcgactccaaaaatgatccccccaagggctgcgaatccttcaatgcccaggtcatcgtccttaaccaccccggccaggttggcgctggttatgccccagtcctcgactgccacactgcccacattgcttgcaagttctctgaactcattgagaagatcgaccgccgtactggaaagtctgttgagaacaaccccaagttcatcaagtctggtgatgctgctatcgtcaagatggttccctccaagcccatgtgcgtggagcccttcactgactatccccct

SEQ ID NO: 1269 - DNA, 1043 bp, Trichophyton rubrum
  strain WSA-224
  misc_feature (1)...(1043): n=a,t,c or g
gtgagcgtggtatcaccatcgatatcgccctctggaagttcgagacccccaagtacaatgtcaccgtcattggtatgtttctttgccttgttccctcatgtggttgtaccatatctaacgagagtagacgcccccggtcaccgtgacttcatcaagaacatgatcactggtacctcccaggctgactgcgctattctcatcattgctgccggtactggtgagttcgaggctggtatctccaaggatggccagacccgtgagcacgctctgctcgccttcaccctcggtgtcaagcagctcatcgttgccatcaacaagatggacaccaccggctggtccgaggatcgtttcaaggaaattatcaaggaagtcaccaacttcatcaagaaggttggctacgaccccaagggtgttccattcgttccaatctctggtttcaacggtgacaacatgattgaggcctccaccaactgcccatggtacaagggatggaacaaggagaccaaggccggtggtgccaagtccggcaagaccctcctcgaggccatcgatgccatcgacatgccaacccgtcctaccgacaagcccctccgtctcccactccaggatgtctacaagatctctggtatcggaactgtgccagtcggtcgtgttgagaccggtatcatcaagcccggtatggtcgtcaccttngcccccgccaacgtcaccactgaagtcaagtccgtykaaatgcaccaccagcagcttcagcagggtgtccccggtgacaacgtcggcttcaatgtcaagaacgtttccgtcaaggaagtccgccgtggtaacgttgccggtgactccaagaacgacccaccatccggctgtgcctccttcaacgcccaggtcatygtcctcaaccaccccggccagatcggtgctggttacgstccagtcctcgactgccacactgstcacattgcttgcaagttcgctgagctcctcgagaagattgaccgccgtaccggtaaatccgtcgaagccaaccccaagttcgtcaagtctgg

SEQ ID NO: 1270 - DNA, 1105 bp, Microsporum canis
  strain WSA-217
gctgagcgtgagcgtggtatcaccattgatatcgccctctggaagttcgagacccccaagtacatggtcaccgtcatcggtatgctttatctgtttcccatttatagttgcgaccagtaactaacaaaaagtagatgcccccgggcaccgtgacttcatcaagaacatgattactggtacctcccaggccgactgcgctattctcatcattgctgccggtactggtgagttcgaggctggtatctccaaggatggccagactcgtgagcacgccctgctcgctttcaccctcggtgtcaagcagctcatcgttgccatcaacaagatggacaccaccaactggtctgagtcccgtttcggtgaaatcatcaaggaagtcaccaacttcatcaagaaggtcggctacgaccccaagggtgtcccattcgtcccaatctctggcttcaacggtgacaacatgattgagccctccaccaactgcccatggtacaagggatggaacaaggagaccaaggccggtggcaaatcctctggtaagaccctccttgaggccatcgatgccattgacatgcccactcgtcccaccgacaagcctctccgtctcccactccaggatgtctacaagatctctggtatcggaacagtaccagtcggtcgtgttgagactggtatcatcaagcctggtatggttgtcactttygcccccgccaacgtcaccactgaagtcaagtccgtcgaaatgcaccaccagcagctygtccagggtgttcccggtgacaacgttggcttcaacgtcaagaacgtytctgtcaaggaagtccgccgtggtaacgttgccggtgattccaagaacgacccaccagctggctgcgcctctttcaaggcccaggtcatcgtcctcaaccaccccggccagatcggtgctggttacgccccagtccttgactgccacactgcccacattgcttgcaagttctctgagcttcttgagaagattgaccgccgtactggtaaatccgtcgaaaccagccctaagttcgtcaagtctggtgatgccgctattgccaccatggttccatccaagcccatgtgcgttgaggctttc

SEQ ID NO: 1271 - DNA, 1244 bp, Aspergillus versicolor
  strain WSA-175
gagcgtgagcgtggtatcaccatcgatatcgctctctggaagttccagacccctaagtatgaggtcaccgtcattggtatgttgtccttcttgtgttaccatcgaaacatatctaacctacaactgcagacgcccccggtcaccgtgacttcatcaagaacatgatcactggtacctcccaggccgactgcgctattctcatcattgcttccggtactggtgaattcgaggctggtatctccaaggatggccagacccgtgagcacgctctgctcgctttcaccctcggtgtccgtcagctcatcgttgccctcaacaagatggacactgctggctgggctgaggctcgttacaacgaaatcgtcaaggaaacttccggtttcatcaagaaggtcggctacaaccccaagtcggttcccttcgtccccatctccggtttcaacggtgacaacatgcttgagccctcctccaactgcccctggtacaagggttgggagaaggagaccaaggctggtaaggccactggtaagaccctcctcgaggccatcgacgccattgagcctcccgtccgtccctccaacaagcctctccgtcttcccctccaggatgtctacaagatctctggtattggaactgtccccgtcggccgtgtcgagaccggtaccatcgtccccggtatggtcgtcaccttcgctcccgccaacgtcaccactgaagtcaagtccgttgagatgcaccaccagcagctcaaggagggtgttcccggtkacaacgttggtttcaacgtgaagaacgtttccgtcaaggaagtccgccgtggtaacgtcgctggtgactccaagaacgacccccctgccggtgctgcctctttcaccgcccaggtcatcgtcctcaaccaccccggtcaggtcggcgctggttacgctcccgtcctcgactgccacaccgctcacattgcctgcaagttcgctgagctccaggagaagatcgaccgccgtaccggaaagtctgtcgaatytgcccccaagttcatcaagtctggtgacgccgctatcgtcaagatgattccctccaagcccatgtgtgtcgagtctttcactgactaccctcctytcggccgtttcgccgtccgtgacgtaagttctttccccagcttttcgatgctacccttctmtgaatcacgtgtcatgtcttggcacccgcccatcacatgaccacgcaaccctataccccgccacaccctt

SEQ ID NO: 1272 - DNA, 1032 bp, Exophiala moniliae
  strain WSA-219
gctgagcgtgagcgtggtatcaccatcgatatcgctctctggaagttcgagacccccaagtactatgtcaccgtcatcgacgcccccggtcatcgtgacttcatcaagaacatgatcactggtacttcccaagctgactgcgccattctcatcattgctgccggtactggtgaattcgaagccggtatctccaaggatggtcagacccgtgagcacgctctgcttgcctacaccctgggtgtcaagcagctcattgtcgccatcaacaagatggacactaccaagtggtctgaggaccgtttcaacgaaatcatcaaggagacttccagcttcatcaagaaggtcggctacaaccccaagtccgttcctttcgtccccatctccggcttcaacggtgacaacatgatcgacgtctccaccaactgcccctggtacaagggctgggagaaggagaccaaggctggcaaggcctctggcaagactctccttgaggccatcgacgccattgaccccccctctcgtcccaccgacaagcctytccgtctccctctccaggatgtgtacaagatctctggtatcggaacggtgcccgtcggtcgtgtcgagactggtatcatcaaggccggtatggtcgttaccttcgctcctgccaacgtcaccactgaagtcaagtccgtcgaaatgcaccacgaacagctcgccgagggtgttccaggtgacaacgtcggtttcaacgtcaagaacgtytccgtcaaggaggttcgtcgtggaaacgtttgcggtgactccaagaacgacccacccaagggcgctgattccttcaacgcccaggtcatcgtcttgaaccaccctggtcaagttggtgctggctacgccccagtgttggattgccacactgcccacattgcttgcaagttctctgagcttctcgagaagatcgatcgtcgkaccggaaagtcgatcgaaaacaaccccaagttcatcaagtctggtgacgctgccatcgtcaagatggttcccagcaagcccatg

SEQ ID NO: 1273 - DNA, 1106 bp, Hortaea werneckii
  ref <308>: DATABASE ACCESSION NUMBER: ATCC 34944
taacagcccgtgcgaccgtctcgtccaataactaatgattcgcaggtactatgtcgtgagtatccggtccttttttgttaatttaccagaaatgacgaaatttttgactaattaacacactcagaccgtcattgacgccccgggtcaccgtgacttcatcaagaacatgatcactggtacctcccaggccgactgcgctgtcctcatcattgctgccggtactggtgagttcgaggctggtatctccaaggatggccagacccgtgagcacgccctgctcgcctacaccctcggtgtcaagcagctcatcgtcgccatcaataagatggacaccaccaagtggtccgaggagcgttacggcgagatcatcaaggagacctctgccttcatcaagaaggtcggtttcaacccgaagcacgtcccgttcgtcccgatctccggtttcaacggtgacaacatgatcgaggcctycaccaactgcccgtggtacaagggctgggagaaggagaccaaggccaaggtcaccggcaagaccctycttgaggccattgacaacatcgacccgccgagccgtccttccgacaagccgctccgtcttcccctccaggatgtctacaagatcggtggtattgggacagtcccagtcggccgtgtcgagaccggtaccatcaaggccggcatggtcgttaccttcgctccggctggtgtcaccactgaagtgaagtccgttgaratgcaccacgagcagctcgctgagggtytgccgggtgacaacgtcggcttcaacgtcaagaacgtttccgtcaaggagatccgtcgtggcaacgttgctggtgacagcaaggctgacccgccgaagggctgcgacagcttcaacgcccaggtcatcgtcctgaaccaccctggccaggtcggtgctggttacgctccagtcctggactgccacactgcccacattgcctgcaagttcggcgagctcctcgagaagatcgaccgtcgctytggcaagtccattgaagcctygcctaagtacatcaagtctggtgacgctgccatygtcaagatgattccgtccaagccgatgtgcgttgagccattcactgagt

SEQ ID NO: 1274 - DNA, 1119 bp, Fusarium solani
  ref <308>: DATABASE ACCESSION NUMBER: ATCC 32793
ctcaaggccgagcgtgagcgtggtatcaccatcgacattgccctctggaagttcgagactccccgctactatgtcaccgtcattggtatgttgctgtcacctctctcacacatgtctcaccactaacaatcaacagacgcccccggccaccgtgatttcatcaagaacatgatcactggtacttcccaggccgactgcgccattctcatcattgccgccggtactggtgagttcgaggctggtatctccaaggatggccagacccgtgagcacgccctgctcgcctacaccctcggtgtcaagaacctcattgtcgccatcaacaagatggacaccaccaagtggtccgagtcccgttaccaggagatcatcaaggagacctccaacttcatcaagaaggtcggctacaaccccaaggctgtcgctttcgtccccatctccggtttcaacggcgacaacatgcttactccctccaccaactgcccctggtacaagggctgggagcgtgagatcaagtccggcaagctcactggcaagaccctcctcgaggccattgactccatcgagccccccaagcgtcccgtcgacaagcccctycgacttcccctccaggatgtctacaagatcggtggtattggcacggttcccgtcggccgtatcgagactggtgtcatcaagcccggtatggtcgttaccttmgccccctccaacgtcaccactgaagtcaagtccgtcgaratgcaccacgagcagctctytgagggtcttcccggtgacaacgtcggcttcaacgtgaagaacgtytccgtcaaggagatccgacgtggcaacgtcgctggtgactccaagaacgacccccctytgggtgccgcctctttcaccgcccaggtcattgtcctcaaccaccctggccaggtcggtgccggttacgcccccgttytggactgccacactgcccacattgcctgcaagttcgccgagatccaggagaagatcgaccgccgaactggtaaggctgttgagtccgcccccaagttcatcaagtctggtgactccgccatcgtcaagatggttccctccaagcccatgtgcgttgaggctttcactgactacccccct

SEQ ID NO: 1275 - DNA, 1113 bp, Aureobasidium pullulans
  strain WSA-234
ctgaagtctgagcgtgagcgtggtatcactatcgatatcgccctctggaagttcgagacccccaagtacatggtcaccgtcatcgatgcccccggtcaccgtgatttcatcaagaacatgatcactggtacctcccaggctgactgcgccattctcatcattgctgccggtactggtgagttcgaggctggtatctccaaggatggccagactcgtgagcacgctctcctcgcctacacccttggtgtcaagcagctcatcgttgccatcaacaagatggacaccaccaagtggtctgaggcccgttaccaggagatcatcaaggagacctccggtttcatcaagaaggtcggctacaaccccaagcacgttcccttcgtccccatctccggcttcaacggagacaacatgatcgaggtcagctccaactgcccttggtacaagggttgggagaaggagaccaaggccaaggccactggcaagaccctcctcgaggccattgacgccatcgaccctccttcccgtcctaccgacaagcccctccgtcttcccctccaggatgtctacaagatcggtggtattggcacggtgcccgtcggtcgtgttgagaccggtaagatcatgggtggtatggttgtcaccttcgcccccgctggtgtcaccaccgaggtcaagtccgtcgagatgcaccacgagcagctcaccgagggtcttcccggtgacaacgtcggcttcaacgtcaagaacgtytccgtcaaggagatccgtcgtggcaacgttgccggtgactccaagaacgacccccccaagggttgtgactccttcaacgcccaggtcatcgtcctgaaccaccctggtcaggtcggtgctggttacgcacccgtcctcgactgccacactgcccacattgcttgcaagttytccgagcttgttgagaagattgaccgcagaaccggcaagtccgttgaggctgcccccaagttcatcaagtctggtgacgccgccatcgtcaagatggttccctccaagcccatgtgtgttgaggctttcaccgactaccctcctytcggtcgtttcgccgtccggtatgtttttcttcttcaatcattcttc

SEQ ID NO: 1276 - DNA, 731 bp, Blastomyces dermatitidis
  ref <308>: DATABASE ACCESSION NUMBER: ATCC 14112
ggtctgagacccgtttcaacgaaattatcaaggaagtcagcaacttcatcaagaaggtcggatacaaccccaagtctgttcccttcgtgccaatctccggtttcgagggtgacaacatgattgagccttcccccaactgcccttggtacaagggctggaacaaggagactgctgctggcaaggccgccggtaagactcttctcgatgccattgacgccatcgacccccccgtccgtcctaccgagaagcctctccgtcttcccctccaggatgtgtacaagatctccggtattggcactgttcccgttggacgtgtcgagactggtgtcatcaagcctggtatggtcgtgaccttcgcccctgccaacgtcaccactgaagtcaagtccgttgaaatgcaccaccagcagctccaggctggttaccctggtgacaacgtcggcttcaacgtcaagaacgtttccgtcaaggaagtccgccgtggcaacgttgccggtgactccaagaacgacccccccaagggctgcgagtccttcaacgcccaggtcatcgtcctcaaccaccccggccaggttggcgctggttatgccccagtcctcgactgccacactgcccacattgcttgcaagttctctgagctcatcgagaagattgaccgccgtaccggaaagtctgttgaggacaaccccaagttcatcaagtccggtgatgctgctatcgtcaagatgatt

SEQ ID NO: 1277 - DNA, 1046 bp, Exophiala dermatitidis
  ref <308>: DATABASE ACCESSION NUMBER: ATCC 76088
ccgagcgtgagcgtggtatcaccatcgatatcgccctctggaagttcgagacccccaagtactatgtcaccgtcatcgacgccccgggtcatcgtgactttatcaagaacatgatcactggtacctcgcaggccgactgcgccatcttgatcattgccgccggtaccggtgaattcgaagccggtatctccaaggatggtcagacccgtgagcacgctctgctcgcctacaccttgggtgtcaagcagctcatcgtcgccatcaacaagatggacaccaccaagtggtccgaggagcgtttcaacgaaatcatcaaggagacttccaacttcatcaagaaggtcggctacaaccccaaggccgttcctttcgtccccatctccggcttcaacggtgacaacatgattgaggtctccaccaactgcccgtggtacaagggatgggagaaggagtccaaggctggcaaggccaccggcaagaccctcctcgaggccattgacgccatcgacccacccacccgtcccaccgacaagcctctccgtctccctctccaggatgtctacaagatctctggtatcggaacggttcctgtcggtcgtgtcgagaccggtaccatcaaggccggtatggtcgtcaccttcgctccggccaacgtcaccactgaagtcaagtccgtcgaaatgcaccacgagcagctcgccgagggtytgccaggtgacaacgttggcttcaacgtcaagaacgtytccgtcaaggaggttcgtcgtggtaacgttgccggtgactccaagaacgacccgcccaagggtgccgagtccttcaacgcccaggtcattgtcctcaaccaccctggtcagatcggtgccggctacgctccagtcttggattgccacactgcccacattgcttgcaagttcgccgagttgctcgagaagatcgaccgtcgtaccggaaagtccatcgagaacaaccccaagttcatcaagtctggtgatgctgccatcgtcaagatgattcccagcaagcccatgtgtgtcgaggctttc

SEQ ID NO: 1278 - DNA, 1109 bp, Fusarium moniliforme
  strain WSA-213
cgtgagcgtggtatcaccatcgatattgctctctggaagttcgagactcctcgctactatgtcaccgtcattggtatgttgtcgctcatacctcatcctacttcctcatactaacacatcattcagacgctcccggtcaccgtgatttcatcaagaacatgatcactggtacttcccaggccgattgcgccattctcatcattgccgccggtactggtgagttcgaggctggtatctccaaggatggccagacccgtgagcacgctcttcttgcctacacccttggtgtcaagaacctcatcgtcgccatcaacaagatggacaccaccaagtggtctgaggcccgttaccaggagatcatcaaggagacctcctctttcatcaagaaggtcggctacaaccccaaggctgtcgctttcgtccccatctccggtttcaacggtgacaacatgcttaccccctccaccaactgcccctggtacaagggttgggagcgtgagatcaagtccggcaagctctccggcaagaccctcctcgaggccattgactccatcgagcctcccaagcgtcccgttgacaagcccctccgtcttcccctccaggatgtctacaagatcggtggtattggaacggttcccgtcggccgtattgagactggtgtcatcaagcccggtatggtcgttaccttcgctccctccaacgtcaccactgaagtcaagtccgtcgaratgcaccacgagcagytcagtkagggccagcccggtgacaacgttggtttcaacgtgaagaacgtttccgtcaaggacatccgacgtggtaacgtcgctggtgactccaagaacgaccccccccagggtgccgcttctttcaccgcccaggtcatcgtcctcaaccaccccggccaggtcggtgctggttacgctcctgtcctcgattgccacactgcccacattgcctgcaagttcgccgagatccaggagaagatcgaccgccgaaccggtaaggctactgaggccgctcccaagttcatcaagtctggtgactccgccatcgtcaagatggttccctccaagcccatgtgtgtcgaggctttcactgactaccctcct

SEQ ID NO: 1279 - DNA, 765 bp, Aspergillus terreus
  strain WSA-174
cctgcaagtggtctgaggaccgttacaacgaaatcgtgaaggagacctccaacttcatcaagaaggtcggctacaaccccaaggccgttcccttcgtccccatctccggtttcaacggtgacaacatgcttgagccttcccccaactgcccctggtacaagggttgggagaaggagggcaagtccggcaaggtcaccggtaagactctcctcgaggccatcgatgccatcgagccccccgtccgtcctgccaacaagcctctccgtcttcccctccaggatgtgtacaagatctctggtatcggaactgtccccgtcggccgtgtcgagactggtgtcatcacccccggcatggttgttaccttcgctccttccaacgtcaccactgaagtgaagtccgttgagatgcaccaccagcagctcaaggagggtctccccggtgacaacgttggtttcaacgtcaagaacgtctccgtcaaggaggtccgtcgtggtaacgtcgctggtgactccaagaacgacccccctgctggcgctgcctccttcaccgcccaggtcatcgttctcaaccaccccggtcaggtcggcgctggctacgcccccgtcctcgactgccacactgcccacattgcctgcaagttcgctgagctccaggagaagattgaccgccgtaccggaaagtctgttgagtcttctcccaagttcatcaagtctggtgatgctgccatcgtcaagatgatccctycaaagcccatgtgcgtcgaag

SEQ ID NO: 1280 - DNA, 1105 bp, Aspergillus fumigatus
  ref <308>: DATABASE ACCESSION NUMBER: ATCC 64746
gcgtggtatcaccatcgacattgccctctggaagttccagactcccaagtatgaggtcactgtcatcggtaagctcgactcgccccgatatgttttggtgctgtagctaacacgatctgaagatgcccccggtcaccgtgacttcatcaagaacatgatcactggtacctcccaggctgactgcgctatcctcatcattgcctccggtactggtgagttcgaggctggtatctccaaggatggccagacccgtgagcacgctctgctggctttcaccctcggtgtcaagcagctcatcgtcgccctcaacaagatggacacctgcaagtggtccgaggatcgttacaacgaaattgtcaaggaaacctccaacttcatcaagaaggtcggctacaaccccaaggccgttcccttcgtmcccatckctggcttcaacggtgacaacatgcttgagccctcctccaactgcccctggtacaagggatgggagaaggagaccaaggccggcaaggtcactggtaagaccctcatcgaggccatygacgccattgagccccctgtccgtccctccaacaagcccctycgtcttcccctccaggatgtytacaagatctctggtatcggaacggtccctgtcggccgtgtcgagaccggtatcatcaagcccggcatggtcgtcacctttgcccccgccaacgtcaccactgaagtcaagtccgtcgaaatgcaccaccagcagctccaggagggtgtccccggtgacaacgtcggtttcaacgtcaagaacgtttccgtcaaggaagtccsccgtggtaacgtttgcggtgactccaagaacgatccccctcagggtgctgcctccttcaacgcccaggtcatcgtcctcaaccaccccggtcaggtcggcgctggttacgcccccgtcctcgactgccacactgcccacattgcttgcaagttctytgagctgcttgagaagattgaccgccgtaccggcaagtctgttgagaacaaccccaagttcatcaagtccggtgawgccgccatcgtgaagatggttccttccaagcccatgtgtgtcgagtccttcactgactacccccct

SEQ ID NO: 1281 - DNA, 1343 bp, Cryptococcus laurentii
  ref <308>: DATABASE ACCESSION NUMBER: ATCC 44096
gccgagcgagagcgaggtatcaccatcgacattgctctctggaagttcgagacccccaagtacaacgtcaccgtcattgacgcccccggacaccgagacttcatcaagaacatgatcaccggtacctcccaggccgactgcgccatccttatcattgccaccggtatcggagagttcgaggccggtatctctaaggacggtcagacccgagagcacgctttgctcgccttcaccctcggtgtcaggcagctcatcgttgcttgcaacaagatggacacctgcaagtggtccgaggaccgattcaacgagatcgtcaaggagaccaacggtttcatcaagaaggtcggatacaaccccaaggctgttcccttcgtccccatctctggatggcacggagacaagtgagtgccgttctttgcgttgagccctctttgtcgctccccctccctctcaagtggcggcggcggtctccacccacaaatcgggtggcgaatccgccacacccaccacttctcgccaccgagtgtggcacttcttccaactcctctttccactcctcctcgtctcgtctctttttttctccgttgtctttgacaaggggagtgtgctgatagtaaagcatgcttgaggagaccaccaacatgccgtggtacaagggatggaccaaggagaccaagtccggtgtcgttaagggtaagaccctcctcgacgccatcgacgccatcgagcctcctcaacgacccaccgacaagcccctccgacttcccctccaggatgtctacaagatcggtggtatcggtacggtgcccgtcggccgagtcgagaccggtgtcatcaaggccgggtaagtcacgggagcctgacggctgttgttgccacacccaacttatatccagtatggtcgtcaccttcgctcctaccaacgtcaccactgaggttaagtccgttgagatgcaccacgagcagatccctgagggtcttcccggagacaacgttggtttcaacgtgaagaacgtttccatcaaggacatccgacgaggaaacgtytgctccgactccaagaacgaccccgctaaggaggccgcttctttcaacgcccaggtcattgtcctcaaccaccctggacagattggtgccggttacacccccgtcctcgactgccacaccgcccacattgcctgcaagttcgccgagctcatcgagaagatcgaccgacgaactggtaagaccatggaggccgcccccaagttcgtcaagtccggagacgccgccattgtcaagctcgttgcccagaagcccatctgtgtcgagtcttactctgactaccctccccttggacgatt

SEQ ID NO: 1282 - DNA, 734 bp, Emmonsia parva
  ref <308>: DATABASE ACCESSION NUMBER: ATCC 10784
tggtccgaggctcgtttcaacgaaatcatcaaggaagtcaccaacttcatcaagaaggtcggatacaaccccaagtctgttcccttcgtgccaatctctggtttcgagggtgataacatgattgagccctccaccaactgcccctggtacaagggctggaccaaggagaccgctgccggcaagtcaaccggtaagactcttcttgacgccattgatgccatcgatcaaccctcccgtcctaccgacaagcccctccgtcttcccctccaggatgtgtacaagatctccggtattggcactgttcccgttggacgtgttgagactggtatcatcaagcctggtatggtcgtgaccttcgctccctccaacgtcaccactgaagtcaagtccgtcgaaatgcaccaccaacagctcttggctggtaaccccggtgacaacgtcggtttcaacgtcaagaacgtttccgtcaaggaagtccgccgtggcaacgttgctggtgactcaaagaacgacccccccaagggctgcgactccttcaacgcccaggtcatcgtcctcaatcaccccggtcaagttggcgctggttatgccccagtcctcgactgccacactgcccacattgcttgcaagttctctgagctcctcgagaagattgaccgccgtaccggaaagtccactgagaacaaccccaagttcatcaagtctggtgacgccgctatcgtcaagatggttcc

SEQ ID NO: 1283 - DNA, 1107 bp, Fusarium solani
  ref <308>: DATABASE ACCESSION NUMBER: ATCC 62877
cgtgagcgtggtatcaccatcgacattgccctctggaagttcgagactccccgctactatgtcaccgtcattggtatgttgctgtcacctctctcacacatgtctcaccactaacaatcaacagacgcccccggccaccgtgacttcatcaagaacatgatcactggtacttcccaggccgactgcgccattctcatcattgccgctggtactggtgagttcgaggctggtatctccaaggatggccagacccgtgagcacgccctgctcgcctacaccctcggtgtcaagaacctcattgtcgccatcaacaagatggacaccaccaagtggtccgagtcccgttaccaggagatcatcaaggagacctccaacttcatcaagaaggtcggctacaaccccaaggctgtcgctttcgtccccatctccggtttcaacggcgacaacatgcttactccctccaccaactgcccctggtacaagggctgggagcgtgagatcaagtccggcaagctcactggcaagaccctcctcgaggccattgactccatcgagccccccaagcgtcccgtcgacaagcccctccgacttcccctccaggatgtctacaagatcggtggtattggcacggttcccgtcggccgtatcgagactggtgtcatcaagcccggtatggtcgttaccttcgccccctccaacgtcaccactgaagtcaagtccgtcgagatgcaccacgagcagctctytgagggtcttcccggtgacaacgtcggcttcaacgtkaagaacgtytccgtcaaggagatccgacgtggcaacgtcgctggtgactccaagaacgacccccctytgggtgccgcctctttcaccgcccaggtcattgtcctcaaccaccctggccaggtcggtgccggttacgcccccgttytggactgccacactgcccacattgcctgcaagttcgccgagatccaggagaagatcgaccgccgaactggtaaggctgttgagtccgcccccaagttcatcaagtctggtgactccgccatcgtcaagatggttccctccaagcccatgtgcgttgaggctttcactgactacccccct

SEQ ID NO: 1284 - DNA, 1045 bp, Sporothrix schenckii
  ref <308>: DATABASE ACCESSION NUMBER: ATCC 14285
gctcaaggccgagcgtgagcgcggtatcaccatcgatattgctctgtggaagttcgagacccccaagtactacgtcaccgtcattgacgcccccggtcatcgcgatttcatcaagaacatgatcactggtacctcgcaggccgactgcgccattctcatcattgccgctggtactggtgagttcgaggctggtatctccaaggatggccagactcgtgagcacgctctgctcgcctacaccctgggtgtgcggcagctgatcgtcgccatcaacaagatggacacggccaagtgggctgaggctcgttaccaggagatcatcaaggagacctccaacttcatcaagaaggtcggctacaaccccaagactgttgccttcgtccccatctcgggcttccacggcgacaacatgcttactccctcgaccaactgcccctggtacaagggctgggagaaggagggcaagagcggcaaggttaccggtaagactctgctggacgccattgacgccgtcgagccccccaagcgccccacggacaagcccctgcgtctgcccctccaggatgtctacaagatcggcggtatcggcactgtccctgtcggccgtatcgagactggtgtcctgaagcccggcatggtcgtcacctttgccccgtccaacgtcaccactgaagtcaagtccgtcgagatgcaccacgagcagcttgttgagggtgttcccggcgacaacgtcggcttcaacgtcaagaacgtytccgtcaaggagatccgtygtggcaacgttgccggtgactccaagaacgaccccccctcgggcgccgccaccttcaacgcccaggtcattgtcctgaaccaccccggccaggtcggcaacggctacgccccggttytggactgccacaccgcccacattgcctgcaagttcaccgagatccttgagaagatcgaccgccgtaccggcaagtcggttgagaacaaccccaagttcatcaagtcgggtgacgccgccattgtcaagctgacgccctygaagcccatgtgcgtt

SEQ ID NO: 1285 - DNA, 764 bp, Aspergillus nidulans
  strain WSA-176
ttgccagtggtccgaggcccgttacaacgaaatcgtcaaggagacttccggtttcatcaagaaggtcggatacaaccccaagtccgttgccttcgtccccatctccggtttcaacggtgacaacatgctcgaggcctctaccaactgcccctggtacaagggttgggagaaggagaccaaggccggtaaggccactggtaagaccctccttgaggccatcgacgccattgagccccccacccgtccctccaacaagcccctccgtcttcccctccaggatgtctacaagatctccggtattggaactgtccccgtcggccgtgtcgagactggtgttatcacccccggcatggtcgtcaccttcgctcctgccaacgtcaccactgaagtcaagtccgttgagatgcaccaccagcagctcaaggagggtgtccccggtgacaacgtcggtttcaacgtcaagaacgtttccgtcaaggaaatccgtcgtggtaacgttgcctccgactccaagaacgaccccgcctccggcgctgcctctttcaacgcccaggtcatcgttctcaaccaccccggtcaggtcggtgctggttacgcccccgtcctcgactgccacaccgcccacattgcttgcaagttctctgagcttcttgagaagattgaccgccgtaccggaaaggctgttgaaaccagccccaagttcatcaagtccggtgacgctgccatcgtcaagatgattccttccaagcccatgtgcgktccga

SEQ ID NO: 1286 - DNA, 971 bp, Cladophialophora carrionii
  ref <308>: DATABASE ACCESSION NUMBER: ATCC 16264
accatcgatatcgcgctctggaagttcgagactcccaagtacttcgtcaccgtcatcgatgcccctggtcatcgtgacttcatcaagaacatgatcactggtacctcccaggctgattgtgctattctcatcattgccgctggtactggtgagttcgaggccggtatctccaaggatggccagacccgtgagcatgctctgctcgcctacaccctgggcgtgaagcagcttatcgtcgccatcaacaagatggacaccaccaaatggtctgaggatcgtttcaacgaaatcatcaaggagacttccaacttcatcaagaaggtcggatacaaccccaagtccgttccattcgtgcccatctccggcttcaacggtgacaacatgatcgacgtctccaccaatgccccctggtacaagggctgggaaaaggagtccaaggctggcaaggccaccggcaagaccctccttgaggctatcgactccatcgaccctcctgctcgtcccaccgacaagcctctccgtctcccactccaggatgtctacaagatttctggtatcggcacggtgcccgtcggtcgtgttgagactggtaccatcaaggccggtatggtcgtcacctttgcccccgccaacgtcaccactgaagtcaagtccgtcgaaatgcaccacgaacagctygccgagggcgttccgggtgacaacgtcggcttcaacgtcaagaacgtytccgtgaaggaggttcgtcgtggaaacgttgctggtgactccaagaacgacccccccaagggtgccgactccttcaacgcccaggtcatcgtcctcaaccaccctggtcaggtcggtgctggctacgccccggtcttggattgccacactgcccacattgcctgcaagttctytgagctcctcgagaagatcgatcgtcgkaccggcaagtccatggaaaacaaccccaagttcatcaagtctgg

SEQ ID NO: 1287 - DNA, 732 bp, Exserohilum rostratum
  strain WSA-215
ggtctgaggaccgttaccaggagatcatcaaggagacctccaacttcatcaagaaggtcggctacaaccccaagcacgttcccttcgtccccatctccggtttcaacggagacaacatgatcgaggcctccagcaactgcccctggtacaagggttgggagaaggagaccaaggccaaggccactggtaagaccctccttgaggccattgacgccatcgaccctcccagccgtcctaccgacaagcccctccgtcttcccctccaggatgtctacaagattggtggtattggcacggttcccgtcggtcgtgtcgagaccggtatcatcaaggccggtatggtcgtcaccttcgcccccgctggtgtcaccactgaagtcaagtccgtcgagatgcaccacgagcagcttaccgagggtgtccccggtgacaacgtcggcttcaacgtcaagaacgtctccgtcaaggagatccgtcgtggtaacgttgccggtgactccaagaacgacccccccaagggctgcgagtctttcaacgctcaggtcattgtcctcaaccaccctggtcaggtcggtgccggttacgcgccagtcctcgactgccacaccgcccacattgcctgcaagttctctgagctcctcgagaagattgaccgccgtaccggaaagtctgtcgaagcctctcccaagttcatcaagtctggtgacgcggccatcgtcaagatggttccct

SEQ ID NO: 1288 - DNA, 337 bp, Bacillus thuringiensis
  strain HER 1236
aatggatcctgtatacgcacaaaaattaggcgttaacatagatgaattrctattatcacagcctgatacaggggagcaaggattggaaatcgcggaagcacttgtacgaagtggtgcggttgacattatcgtaattgactctgtagcagctcttgtaccgaaagcagagattgaaggcgatatgggtgactcacacgtaggtttacaagcacgtttaatgtcacaagcacttmgtaagctttcaggagcaatcaacaaatcarrarcaatwgcaatctttattaaccaaattcgwgaaaaagttggggttatgttcggaaacccagaaacaactcca

SEQ ID NO: 1289 - DNA, 336 bp, Bacillus thuringiensis
  strain HER 1232
aatggatcctgtatatgcacaaaaattaggcgttaacatagatgaattrctattatcacagcctgatacaggggagcaaggattggaaatcgcggaagcacttgtacgaagtggtgcggttgacattatcgtaattgactctgtagcagctcttgtaccgaaagcagagattgaaggcgatatgggtgactcacacgtaggtttacaagcacgtttaatgtcacaagcacttmgtaagctttcaggagcaatcaacaaatcaraarcaattgcaatctttattaaccaaattcgtgaaaaagttggggttatgttcggaaacccagaaacaactcc

SEQ ID NO: 1290 - DNA, 23 bp, Artificial Sequence
  Synthetic DNA Sequence
  modified_base (9): i
  modified_base (13): i
  modified_base (15): i
  modified_base (18): i
gaytaygcnatgnsngtnathgt

SEQ ID NO: 1291 - DNA, 23 bp, Artificial Sequence
  Synthetic DNA Sequence
  modified_base (3): i
  modified_base (6): i
  modified_base (9): i
  modified_base (15): i
  modified_base (18): i
gcnytnccngaygtnmgngaygg

SEQ ID NO: 1292 - DNA, 20 bp, Artificial Sequence
  Synthetic DNA Sequence
  modified_base (3): i
  modified_base (9): i
  modified_base (12): i
  modified_base (18): i
arnscytcnarnatrtgngc

SEQ ID NO: 1293 - DNA, 20 bp, Artificial Sequence
  Synthetic DNA Sequence
atggctgaattacctcaatc

SEQ ID NO: 1294 - DNA, 25 bp, Artificial Sequence
  Synthetic DNA Sequence
atgattgttgtatatcttcttcaac

SEQ ID NO: 1295 - DNA, 20 bp, Artificial Sequence
  Synthetic DNA Sequence
cagaaagtttgaagcgttgt

SEQ ID NO: 1296 - DNA, 20 bp, Artificial Sequence
  Synthetic DNA Sequence
aacgattcgtgagtcagata

SEQ ID NO: 1297 - DNA, 22 bp, Artificial Sequence
  Synthetic DNA Sequence
cggtcaacattgaggaagagct

SEQ ID NO: 1298 - DNA, 23 bp, Artificial Sequence
  Synthetic DNA Sequence
acgaaatcgaccgtctctttttc

SEQ ID NO: 1299 - DNA, 2661 bp, Staphylococcus aureus
  strain 601055
atggctgaattacctcaatcaagaataaatgaacgaaatattaccagtgaaatgcgtgaatcatttttagattatgcgatgagtgttatcgttgctcgtgcattgccagatgttcgtgacggtttaaaaccagtacatcgtcgtatactatatggattaaatgaacaaggtatgacaccggataaatcatataaaaaatcagcacgtatcgttggtgacgtaatgggtaaatatcaccctcatggtgactcatctatttatgaagcaatggtacgtatggctcaagatttcagttatcgttatccgcttgttgatggccaaggtaactttggttcaatggatggagatggcgcagcagcaatgcgttatactgaagcgcgtatgactaaaatcacacttgaactgttacgtgatattaataaagatacaatagattttatcgataactatgatggtaatgaaagagagccgtcagtcttacctgctcgattccctaatttattagccaatggtgcatcaggtatcgcggtaggtatggcaacgaatattccaccacataacttaacagaattaatcaatggtgtacttagcttaagtaagaaccctgatatttcaattgctgagttaatggaagatattgaaggtcctgatttcccaactgctggacttattttaggtaagagtggtattagacgtgcatatgaaacaggtcgtggttcaattcaaatgcgttctcgtgcagttattgaagaacgtggaggcggacgtcaacgtattgttgtcactgaaattcctttccaagtgaataaggctcgtatgattgaaaaaattgcagagctcgttcgtgacaagaaaattgacggtatcactgatttacgtgatgaaacaagtttacgtactggtgtgcgtgtcgttattgatgtgcgtaaggatgcaaatgctagtgtcattttaaataacttatacaaacaaacacctcttcaaacatcatttggtgtgaatatgattgcacttgtaaatggtagaccgaagcttattaatttaaaagaagcgttggtacattatttagagcatcaaaagacagttgttagaagacgtacgcaatataacttacgtaaagctaaagatcgtgcccatattttagaagggttacgtatcgcacttgaccatatcgatgaaattatttcaacgattcgtgagtcagatacagataaagttgcaatggaaagcttgcaacaacgcttcaaactttctgaaaaacaagctcaagctattttagacatgcgtttaagacgtctaacaggtttagagagaaacaaaattgaagctgaatataatgagttattaaattatattagtgaattagaagccatcttagctgatgaagaagtgttattacagttagttagagatgaattgactgaaattagagatcgtttcggtgatgagcgtcgtacagaaattcaattaggtggatttgaagacttagaggacgaagacttaattccagaagaacaaatagtaattactttgagccataataactacattaaacgtttgccggtatctacatatcgtgctcaaaaccgtggtggtcgtggtgttcaaggtatgaatacattggaagaagattttgtcagtcaattggtaactttaagtacacatgaccatgtattgttctttactaacaaaggtcgtgtatacaaactaaaaggttatgaagtgcctgagttatcaagacagtctaaaggtattcctgtagtgaatgctattgaacttggaaatgatgaagtcattagtacaatgattgctgttaaagaccttgaaagtgaagacaacttcttagtgtttgcaactaaacgtggtgttgttaaacgttcagcattaagtaacttctcaagaataaatagaaatggtaagattgcgatttcgttcagagaagatgatgagttaattgcagttcgtttaacaagtggtcaagaagatatcttgattggtacatcacatgcatcattaattcgattccctgaatcaacattacgtcctttaggccgtacagcaacgggtgtgaaaggtattacacttcgtgaaggtgacgaagttgtagggcttgatgtagctcatgcaaacagtgttgatgaagtattagtagttactgaaaatggttatggtaaacgtacgccagttaatgactatcgtttatcaaatcgtggtggtaaaggtattaaaacagctacgattactgagcgtaatggtaatgttgtatgtatcactacagtaactggtgaagaagatttaatgattgttactaatgccggtgtcattattcgactagatgttgcagatatttctcaaaatggtcgtgcagcacaaggtgttcgcttaattcgcttaggcgatgatcaatttgtttcaacggttgctaaagtaaaagaggatgcagatgaagtaaatgaagatgaacaatctactgtatctgaagatggtactgaacaacaacgtgaagcggttgtaaatgatgaaacaccaggaaatgcaattcatactgaagtgattgattcagaagaaaatgatgaagatggacgtattgaagtaagacaagatttcatggatcgtgttgaagaagatatacaacaatcatcagatgaagatgaagaataa

SEQ ID NO: 1300 - DNA, 2628 bp, Escherichia coli
  strain K12
atgagcgaccttgcgagagaaattacaccggtcaacattgaggaagagctgaagagctcctatctggattatgcgatgtcggtcattgttggccgtgcgctgccagatgtccgagatggcctgaagccggtacaccgtcgcgtactttacgccatgaacgtactaggcaatgactggaacaaagcctataaaaaatctgcccgtgtcgttggtgacgtaatcggtaaataccatccccatggtgactcggcggtctatgacacgatcgtccgcatggcgcagccattctcgctgcgttatatgctggtagacggtcagggtaacttcggttctatcgacggcgactctgcggcggcaatgcgttatacggaaatccgtctggcgaaaattgcccatgaactgatggccgatctcgaaaaagagacggtcgatttcgttgataactatgacggcacggaaaaaattccggacgtcatgccaaccaaaattcctaacctgctggtgaacggttcttccggtatcgccgtaggtatggcaaccaacatcccgccgcacaacctgacggaagtcatcaacggttgtctggcgtatattgatgatgaagacatcagcattgaagggctgatggaacacatcccggagccggacttcccgacggcggcaatcattaacggtcgtcgcggtattgaagaagcttaccgtaccggtcgcggcaaggtgtatatccgcgctcgcgcagaagtggaagttgacgccaaaaccggtcgtgaaaccattatcgtccacgaaattccgtatcaggtaaacaaagcgcgcctgatcgagaagattgcggaactggtaaaagaaaaacgcgtggaaggcatcagcgcgctgcgtgacgagtctgacaaagacggtatgcgcatcgtgattgaagtgaaacgcgatgcggtcggtgaagttgtgctcaacaacctctactcccagacccagttgcaggtttctttcggtatcaacatggtggcattgcaccatggtcagccgaagatcatgaacctgaaagacatcatcgcggcgtttgttcgtcaccgccgtgaagtggtgacccgtcgtactattttcgaactgcgtaaagctcgcgatcgtgctcatatccttgaagcattagccgtggcgctggcgaacatcgacccgatcatcgaactgatccgtcatgcgccgacgcctgcagaagcgaaaactgcgctggttgctaatccgtggcagctgggcaacgttgccgcgatgctcgaacgtgctggcgacgatgctgcgcgtccggaatggctggagccagagttcggcgtgcgtgatggtctgtactacctgaccgaacagcaagctcaggcgattctggatctgcgtttgcagaaactgaccggtcttgagcacgaaaaactgctcgacgaatacaaagagctgctggatcagatcgcggaactgttgcgtattcttggtagcgccgatcgtctgatggaagtgatccgtgaagagctggagctggttcgtgaacagttcggtgacaaacgtcgtactgaaatcaccgccaacagcgcagacatcaacctggaagatctgatcacccaggaagatgtggtcgtgacgctctctcaccagggctacgttaagtatcagccgctttctgaatacgaagcgcagcgtcgtggcgggaaaggtaaatctgccgcacgtattaaagaagaagactttatcgaccgactgctggtggcgaacactcacgaccatattctgtgcttctccagccgtggtcgcgtctattcgatgaaagtttatcagttgccggaagccactcgtggcgcgcgcggtcgtccgatcgtcaacctgctgccgctggagcaggacgaacgtatcactgcgatcctgccagtgaccgagtttgaagaaggcgtgaaagtcttcatggcgaccgctaacggtaccgtgaagaaaactgtcctcaccgagttcaaccgtctgcgtaccgccggtaaagtggcgatcaaactggttgacggcgatgagctgatcggcgttgacctgaccagcggcgaagacgaagtaatgctgttctccgctgaaggtaaagtggtgcgctttaaagagtcttctgtccgtgcgatgggctgcaacaccaccggtgttcgcggtattcgcttaggtgaaggcgataaagtcgtctctctgatcgtgcctcgtggcgatggcgcaatcctcaccgcaacgcaaaacggttacggtaaacgtaccgcagtggcggaatacccaaccaagtcgcgtgcgacgaaaggggttatctccatcaaggttaccgaacgtaacggtttagttgttggcgcggtacaggtagatgactgcgaccagatcatgatgatcaccgatgccggtacgctggtacgtactcgcgtttcggaaatcagcatcgtgggccgtaacacccagggcgtgatcctcatccgtactgcggaagatgaaaacgtagtgggtctgcaacgtgttgctgaaccggttgacgaggaagatctggataccatcgacggcagtgccgcggaaggggacgatgaaatcgctccggaagtggacgttgacgacgagccagaagaagaataa

SEQ ID NO: 1301 - DNA, 23 bp, Artificial Sequence
  Synthetic DNA Sequence
  modified_base (3): i
  modified_base (6): i
  modified_base (9): i
  modified_base (12): i
  modified_base (15): i
  modified_base (18): i
gtnmgnawnmgnccngsnatgta

SEQ ID NO: 1302 - DNA, 23 bp, Artificial Sequence
  Synthetic DNA Sequence
  modified_base (3): i
  modified_base (6): i
  modified_base (9): i
  modified_base (12): i
  modified_base (15): i
  modified_base (18): i
tanadnggnggnkkngcnatrta

SEQ ID NO: 1303 - DNA, 20 bp, Artificial Sequence
  Synthetic DNA Sequence
  modified_base (3): i
  modified_base (6): i
  modified_base (9): i
  modified_base (12): i
  modified_base (15): i
ggngangandynmgngargg

SEQ ID NO: 1304 - DNA, 19 bp, Artificial Sequence
  Synthetic DNA Sequence
  modified_base (2): i
  modified_base (8): i
  modified_base (11): i
  modified_base (14): i
cnaryttnkynttngtytg

SEQ ID NO: 1305 - DNA, 22 bp, Artificial Sequence
  Synthetic DNA Sequence
atggtgactgcattgtcagatg

SEQ ID NO: 1306 - DNA, 22 bp, Artificial Sequence
  Synthetic DNA Sequence
gtctacggttttctacaacgtc

SEQ ID NO: 1307 - DNA, 1923 bp, Staphylococcus aureus
atggtgactgcattgtcagatgtaaacaacacggataattatggtgctgggcaaatacaagtattagaaggtttagaagcagtacgtaaaagaccaggtatgtatataggatcgactcagagagagttgcacattagtgtggaaattgtcgataatagtatcgatgaagcattagctggttatgcaaataaaattgaagttgttattgaaaaagataactggattaaagtaacggataacggacgtggtatcccagttgatattcaagaaaaaatgggacgtccagctgtcgaagttattttaactgttttacatgctggtggtaaattcggcggtggcggatacaaagtatctggtggtttacatggtgttggttcatcagttgtaaacgcattgtcacaagacttagaagtatatgtacacagaaatgagactatatatcatcaagcatataaaaaaggtgtacctcaatttgacttaaaagaagttggcacaactgataagacaggtactgtcattcgttttaaagcagatggagaaatcttcacagagacaactgtatacaactatgaaacattacagcagcgtattagagagcttgctttcttaaacaaaggaattcaaatcacattaagagatgaacgtgatgaagaaaacgttagagaagactcctatcactatgagggcggtattaaatcgtacgttgagttattgaacgaaaataaagaacctattcatgatgagccaatttatattcatcaatctaaagatgatattgaagtagaaattgcgattcaatataactcaggatatgccacaaatcttttaacttacgcaaataacattcatacgtacgaaggtggtacgcatgaagacggattcaaacgtgcattaacgcgtgtcttaaatagttatggtttaagtagcagatatgaagaagaaaagatagcttctggtgaagatacacgagaaggtatgacagcaattatatctatcaaacatggtgatcctcaattcgaaggtcaaacgaagacaaaattaggtaattctgaagtgcgtcaagttgtagataaattattctcagagcactttgaacgatttttatatgaaaatccacaagtcgcacgtacagtggttgaaaaaggtattatggcggcacgtgcacgtgttgctgcgaaaaaagcgcgtgaagtaacacgtcgtaaatcagcgttagatgtagcaagtcttccaggtaaattagccgattgctctagtcaaagtcctgaagaatgtgagattttcttagtcgaaggggactctgccggagggtctacaaaatctggtcgtgactctagaacgcaggcgattttaccattacgaggtaagatattaaatgttgaaaaagcacgattagatagaattttgaataacaatgaaattcgtcaaatgatcacagcatttggtacaggaatcggtggcgactttgatctagcgaaagcaagatatcacaaaatcgtcattatgactgatgccgatgtggatggagcgcatattagaacattgttattaatattcttctatcgatttatgagaccgttaattgaagcaggctatgtgtatattgcacagccaccgttgtataaactgacacaaggtaaacaaaagtattatgtatacaatgatagggaacttgataaacttaaatctgaattgaatccaacaccaaaatggtctattgcgctatacaaaggtcttggagaaatgaatgcagatcaattatgggaaacaacaatgaaccctgagcaccgcgctcttttacaagtaaaacttgaagatgcgattgaagcggaccaaacatttgaaatgttaatgggtgacgttgtagaaaaccgtagacaatttatagaagataatgcagtttatgcaaacttagacttctaa

SEQ ID NO: 1308 - DNA, 23 bp, Artificial Sequence
  Synthetic DNA Sequence
  modified_base (9): i
  modified_base (12): i
  modified_base (21): i
atgtaygtnatnatggaymgngc

SEQ ID NO: 1309 - DNA, 23 bp, Artificial Sequence
  Synthetic DNA Sequence
  modified_base (3): i
  modified_base (12): i
  modified_base (18): i
atnatyttrttnccyttnccytt

SEQ ID NO: 1310 - DNA, 20 bp, Artificial Sequence
  Synthetic DNA Sequence
  modified_base (3)
  modified_base (6): i
  modified_base (9): i
  modified_base (12): i
atnatntsnatnacytcrtc

SEQ ID NO: 1311 - DNA, 23 bp, Artificial Sequence
  Synthetic DNA Sequence
  modified_base (12): i
  modified_base (15): i
  modified_base (18): i
garatgaaratnmgnggngarca

SEQ ID NO: 1312 - DNA, 23 bp, Artificial Sequence
  Synthetic DNA Sequence
  modified_base (9): i
  modified_base (12): i
  modified_base (21): i
aartayatnatncargarmgngc

SEQ ID NO: 1313 - DNA, 23 bp, Artificial Sequence
  Synthetic DNA Sequence
  modified_base (3): i
  modified_base (6): i
  modified_base (12): i
  modified_base (15): i
  modified_base (18): i
amnaynckrtgnggnttnttytt

SEQ ID NO: 1314 - DNA, 23 bp, Artificial Sequence
  Synthetic DNA Sequence
  modified_base (3): i
  modified_base (6): i
  modified_base (12): i
  modified_base (15): i
  modified_base (18): i
tanganttyacngansmncargc

SEQ ID NO: 1315 - DNA, 23 bp, Artificial Sequence
  Synthetic DNA Sequence
  modified_base (3): i
  modified_base (6): i
  modified_base (9): i
  modified_base (12): i
  modified_base (18): i
acnatngcntcngcytgnksytc

SEQ ID NO: 1316 - DNA, 22 bp, Artificial Sequence
  Synthetic DNA Sequence
gtgagtgaaataattcaagatt

SEQ ID NO: 1317 - DNA, 22 bp, Artificial Sequence
  Synthetic DNA Sequence
caccaaaatcatctgtatctac

SEQ ID NO: 1318 - DNA, 26 bp, Artificial Sequence
  Synthetic DNA Sequence
acctaytcsatgtacgtratcatgga

SEQ ID NO: 1319 - DNA, 23 bp, Artificial Sequence
  Synthetic DNA Sequence
  modified_base (9): i
agrtcgtcnaccatcggyagytt

SEQ ID NO: 1320 - DNA, 2259 bp, Escherichia coli
  strain K-12 MG1655
atgagcgatatggcagagcgccttgcgctacatgaatttacggaaaacgcctacttaaactactccatgtacgtgatcatggaccgtgcgttgccgtttattggtgatggtctgaaacctgttcagcgccgcattgtgtatgcgatgtctgaactgggcctgaatgccagcgccaaatttaaaaaatcggcccgtaccgtcggtgacgtactgggtaaataccatccgcacggcgatagcgcctgttatgaagcgatggtcctgatggcgcaaccgttctcttaccgttatccgctggttgatggtcaggggaactggggcgcgccggacgatccgaaatcgttcgcggcaatgcgttacaccgaatcccggttgtcgaaatattccgagctgctattgagcgagctggggcaggggacggctgactgggtgccaaacttcgacggcactttgcaggagccgaaaatgctacctgcccgtctgccaaacattttgcttaacggcaccaccggtattgccgtcggcatggcgaccgatattccaccgcataacctgcgtgaagtggctcaggcggcaatcgcattaatcgaccagccgaaaaccacgctcgatcagctgctggatatcgtgcaggggccggattatccgactgaagcggaaattatcacttcgcgcgccgagatccgtaaaatctacgagaacggacgtggttcagtgcgtatgcgcgcggtgtggaagaaagaagatggcgcggtggttatcagcgcattgccgcatcaggtttcaggtgcgcgcgtactggagcaaattgctgcgcaaatgcgcaacaaaaagctgccgatggttgacgatctgcgcgatgaatctgaccacgagaacccgacccgcctggtgattgtgccgcgttccaaccgcgtggatatggatcaggtgatgaaccacctcttcgctaccaccgatctggaaaagagctatcgtattaaccttaatatgatcggtctggatggtcgtccggcggtgaaaaacctgctggaaatcctctccgaatggctggtgttccgccgcgataccgtgcgccgccgactgaactatcgtctggagaaagtcctcaagcgcctgcatatcctcgaaggtttgctggtggcgtttctcaatatcgacgaagtgattgagatcattcgtaatgaagatgaaccgaaaccggcgctgatgtcgcggtttggccttacggaaacccaggcggaagcgatcctcgaactgaaactgcgtcatcttgccaaactggaagagatgaagattcgcggtgagcagagtgaactggaaaaagagcgcgaccagttgcagggcattttggcttccgagcgtaaaatgaataacctgctgaagaaagaactgcaggcagacgcgcaagcctacggtgacgatcgtcgttcgccgttgcaggaacgcgaagaagcgaaagcgatgagcgagcacgacatgctgccgtctgaacctgtcaccattgtgctgtcgcagatgggctgggtacgcagcgctaaaggccatgatatcgacgcgccgggcctgaattataaagcgggtgatagcttcaaagcggcggtgaaaggtaagagcaaccaaccggtagtgtttgttgattccaccggtcgtagctatgccattgacccgattacgctgccgtcggcgcgtggtcagggcgagccgctcaccggcaaattaacgttgccgcctggggcgaccgttgaccatatgctgatggaaagcgacgatcagaaactgctgatggcttccgatgcgggttacggtttcgtctgcacctttaacgatctggtggcgcgtaaccgtgcaggtaaggctttgatcaccttaccggaaaatgcccatgttatgccgccggtggtgattgaagatgcttccgatatgctgctggcaatcactcaggcaggccgtatgttgatgttcccggtaagtgatctgccgcagctgtcgaagggcaaaggcaacaagattatcaacattccatcggcagaagccgcgcgtggagaagatggtctggcgcaattgtacgttctgccgccgcaaagcacgctgaccattcatgttgggaaacgcaaaattaaactgcgcccggaagagttacagaaagtcactggcgaacgtggacgccgcggtacgttgatgcgcggtttgcagcgtatcgatcgtgttgagatcgactctcctcgccgtgccagcagcggtgatagcgaagagtaa

SEQ ID NO: 1321 - DNA, 2403 bp, Staphylococcus aureus
  strain KMP9
gtgagtgaaataattcaagatttatcacttgaagatgttttaggtgatcgctttggaagatatagtaaatatattattcaagagcgtgcattgccagatgttcgtgatggtttaaaaccagtacaacgtcgtattttatatgcaatgtattcaagtggtaatacacacgataaaaatttccgtaaaagtgcgaaaacagtcggtgatgttattggtcaatatcatccacatggagacttctcagtgtacaaagcaatggtccgtttaagtcaagactggaagttacgacatgtcttaatagaaatgcatggtaataatggtagtatcgataatgatccgccagcggcaatgcgttacactgaagctaagttaagcttactagctgaagagttattacgtgatattaataaagagacagtttctttcattccaaactatgatgatacgacactcgaaccaatggtattgccatcaagatttcctaacttactagtgaatggttctacaggtatatctgcaggttacgcgacagatataccaccacataatttagctgaagtgattcaagcaacacttaaatatattgataatccggatattacagtcaatcaattaatgaaatatattaaaggtcctgattttccaactggtggtattattcaaggtattgatggtattaaaaaagcttatgaatcaggtaaaggtagaattatagttcgttctaaagttgaagaagaaactttacgcaatggacgtaaacagttaattattactgaaattccatatgaagtgaacaaaagtagcttagtaaaacgtatcgatgaattacgtgctgacaaaaaagtcgatggtatcgttgaagtacgtgatgaaactgatagaactggtttacgaatagcaattgaattgaaaaaagatgtgaacagtgaatcaatcaaaaattatctttataaaaactctgatttacagatttcatataatttcaacatggtcgctattagtgatggtcgtccaaaattgatgggtattcgtcaaattatagatagttatttgaatcatcaaattgaggttgttgcaaatagaacgaagtttgaattagataatgctgaaaaacgtatgcatatcgttgaaggtttgattaaagcgttgtcaattttagataaagtaattgaattgattcgtagctctaaaaacaagcgtgacgctaaagaaaaccttatcgaagtattcgagttcacagaagaacaggctgaagcaattgtaatgttacagttatatcgtttaacaaacactgacatagttgcgcttgaaggtgaacataaagaacttgaagcattaatcaaacaattacgtcatattcttgataaccatgatgcattattgaatgtcataaaagaagaattgaatgaaattaaaaagaaattcaaatctgaacgactgtctttaattgaagcagaaattgaagaaattaaaattgacaaagaagttatggtgcctagtgaagaagttattttaagtatgacacgtcatggatatattaaacgtacttctattcgtagctttaatgctagcggtgttgaggatattggtttaaaagatggtgacagtttacttaaacatcaagaagtaaatacgcaagataccgtactagtatttacaaataaaggtcgttatctatttataccggttcataaattagcagatattcgttggaaagaattggggcaacatgtatcacaaatagttcctatcgaagaagatgaagtggttattaatgtctttaatgaaaaggactttaatacagatgcattttatgtttttgcgactcaaaatggcatgattaagaaaagtacagtgcctctatttaaaacaacgcgttttaataaacctttaattgctactaaagttaaagaaaatgatgatttgattagtgttatgcgctttgaaaaagatcaattaattaccgtcattactaataaaggtatgtcattaacgtataatacaagtgaactatcagataccggattaagggcagctggtgttaaatcaataaatcttaaagctgaagatttcgttgttatgacagaaggtgtttctgaaaatgatactatattgatggccacacaacgcggctcgttaaaacgtattagttttaaaatcttacaagttgctaaaagagcacaacgtggaataactttattaaaagaattaaagaaaaatccacatcgtattgtagctgcacatgtagtgacaggtgaacatagtcaatatacattatattcaaaatcaaatgaagaacatggtttaattaatgatattcataaatctgaacaatatacaaatggctcattcattgtagatacagatgattttggtgaagtaatagacatgtatattagctaa

SEQ ID NO: 1322 - DNA, 22 bp, Artificial Sequence
  Synthetic DNA Sequence
  modified_base (3): i
  modified_base (6): i
  modified_base (10): i
  modified_base (12): i
  modified_base (15): i
rtnganaaynsngtngaygarg

SEQ ID NO: 1323 - DNA, 22 bp, Artificial Sequence
  Synthetic DNA Sequence
  modified_base (3): i
  modified_base (9): i
  modified_base (12): i
  modified_base (15): i
  modified_base (18): i
acnawrsanggnggnacncayg

SEQ ID NO: 1324 - DNA, 20 bp, Artificial Sequence
  Synthetic DNA Sequence
  modified_base (3): i
  modified_base (6): i
  modified_base (9): i
  modified_base (15): i
ccnccngcnswrtcnccytc

SEQ ID NO: 1325 - DNA, 21 bp, Artificial Sequence
  Synthetic DNA Sequence
  modified_base (10): i
  modified_base (13): i
  modified_base (16): i
rttcatytcnccnarnccytt

SEQ ID NO: 1326 - DNA, 22 bp, Artificial Sequence
  Synthetic DNA Sequence
tgattcaatacaggttttagag

SEQ ID NO: 1327 - DNA, 22 bp, Artificial Sequence
  Synthetic DNA Sequence
ctagatttcctcctcatcaaat

SEQ ID NO: 1328 - DNA, 1992 bp, Staphylococcus aureus
  strain RN4220
atgaataaacaaaataattattcagatgattcaatacaggttttagaggggttagaagcagttcgtaaaagacctggtatgtatattggatcaactgataaacggggattacatcatctagtatatgaaattgtcgataactccgtcgatgaagtattgaatggttacggtaacgaaatagatgtaacaattaataaagatggtagtatttctatagaagataatggacgtggtatgccaacaggtatacataaatcaggtaaaccgacagtcgaagttatctttactgttttacatgcaggaggtaaatttggacaaggcggctataaaacttcaggtggtcttcacggtgttggtgcttcagttgtaaatgcattgagtgaatggcttgaagttgaaatccatcgagatggtaatatatatcatcaaagttttaaaaacggtggttcgccatcttctggtttagtgaaaaaaggtaaaactaagaaaacaggtaccaaagtaacatttaaacctgatgacacaatttttaaagcatctacatcatttaattttgatgttttaagtgaacgactacaagagtctgcgttcttattgaaaaatttaaaaataacgcttaatgatttacgcagtggtaaagagcgtcaagagcattaccattatgaagaaggaatcaaagagtttgttagttatgtcaatgaaggaaaagaagttttgcatgacgtggctacattttcaggtgaagcaaatggtatagaggtagacgtagctttccaatataatgatcaatattcagaaagtattttaagttttgtaaataatgtacgtactaaagatggtggtacacatgaagttggttttaaaacagcaatgacacgtgtatttaatgattatgcacgtcgtattaatgaacttaaaacaaaagataaaaacttagatggtaatgatattcgtgaaggtttaacagctgttgtgtctgttcgtattccagaagaattattgcaatttgaaggacaaacgaaatctaaattgggtacttctgaagctagaagtgctgttgattcagttgttgcagacaaattgccattctatttagaagaaaaaggacaattgtctaaatcacttgtgaaaaaagcgattaaagcacaacaagcaagggaagctgcacgtaaagctcgtgaagatgctcgttcaggtaagaaaaacaagcgtaaagacactttgctatctggtaaattaacacctgcacaaagtaaaaacactgaaaaaaatgaattgtatttagtcgaaggtgattctgcgggaggttcagcaaaacttggacgagaccgcaaattccaagcgatattaccattacgtggtaaggtaattaatacagagaaagcacgtctagaagatatttttaaaaatgaagaaattaatacaattatccacacaatcggggcaggcgttggtactgactttaaaattgaagatagtaattataatcgtgtaattattatgactgatgctgatactgatggtgcgcatattcaagtgctattgttaacattcttcttcaaatatatgaaaccgcttgttcaagcaggtcgtgtatttattgctttacctccactttataaattggaaaaaggtaaaggcaaaacaaagcgagttgaatacgcttggacagacgaagagcttaataaattgcaaaaagaacttggtaaaggcttcacgttacaacgttacaaaggtttgggtgaaatgaaccctgagcaattatgggaaacgacgatgaacccagaaacacgaactttaattcgtgtacaagttgaagatgaagtgcgttcatctaaacgtgtaacaacattaatgggtgacaaagtacaacctagacgtgaatggattgaaaagcatgttgagtttggtatgcaagaggaccaaagtattttagataattctgaagtacaagtgcttgaaaatgatcaatttgatgaggaggaaatctag

SEQ ID NO: 1329 - DNA, 25 bp, Artificial Sequence
  Synthetic DNA Sequence
tgtagagcgcggtatcatcaaagta

SEQ ID NO: 1330 - DNA, 22 bp, Artificial Sequence
  Synthetic DNA Sequence
agattcgaacttggtgtgcggg

SEQ ID NO: 1331 - DNA, 30 bp, Artificial Sequence
  Synthetic DNA Sequence
gcccttgaggtacagaatggtaatgaagtt

SEQ ID NO: 1332 - DNA, 20 bp, Artificial Sequence
  Synthetic DNA Sequence
gaccgcggcgcagaccatca

SEQ ID NO: 1333 - DNA, 23 bp, Artificial Sequence
  Synthetic DNA Sequence
tcatggtgacttatctatttatg

SEQ ID NO: 1334 - DNA, 23 bp, Artificial Sequence
  Synthetic DNA Sequence
catctatttataaagcaatggta

SEQ ID NO: 1335 - DNA, 19 bp, Artificial Sequence
  Synthetic DNA Sequence
ctatttatggagcaatggt

SEQ ID NO: 1336 - DNA, 17 bp, Artificial Sequence
  Synthetic DNA Sequence
tggagactactcagtgt

SEQ ID NO: 1337 - DNA, 17 bp, Artificial Sequence
  Synthetic DNA Sequence
tggagacttctcagtgt

SEQ ID NO: 1338 - DNA, 15 bp, Artificial Sequence
  Synthetic DNA Sequence
gtgtacggagcaatg

SEQ ID NO: 1339 - DNA, 15 bp, Artificial Sequence
  Synthetic DNA Sequence
ccagcggaaatgcgt

SEQ ID NO: 1340 - DNA, 25 bp, Artificial Sequence
  Synthetic DNA Sequence
gaacaaggtatgacaccggataaat

SEQ ID NO: 1341 - DNA, 25 bp, Artificial Sequence
  Synthetic DNA Sequence
gataactgaaatcctgagccatacg

SEQ ID NO: 1342 - DNA, 24 bp, Artificial Sequence
  Synthetic DNA Sequence
gatgttattggtcaatatcatcca

SEQ ID NO: 1343 - DNA, 29 bp, Artificial Sequence
  Synthetic DNA Sequence
aagaaactgtctctttattaatatcacgt

SEQ ID NO: 1344 - DNA, 24 bp, Artificial Sequence
  Synthetic DNA Sequence
agcagcaacgatgttacgcagcag

SEQ ID NO: 1345 - DNA, 23 bp, Artificial Sequence
  Synthetic DNA Sequence
cccgccgagcatttcaactattg

SEQ ID NO: 1346 - DNA, 22 bp, Artificial Sequence
  Synthetic DNA Sequence
gatgttacgcagcagggcagtc

SEQ ID NO: 1347 - DNA, 24 bp, Artificial Sequence
  Synthetic DNA Sequence
accaagcaggttcgcagtcaagta

SEQ ID NO: 1348 - DNA, 750 bp, Unknown Organism
  Description of Unknown Organism: Unidentified bacterium
atgcgctcacgcaactggtccagaaccttgaccgaacgcagcggtggtaacggcgcagtggcggttttcatggcttgttatgactgtttttttgtacagtctatgcctcgggcatccaagcagcaagcgcgttacgccgtgggtcgatgtttgatgttatggagcagcaacgatgttacgcagcagggcagtcgccctaaaacaaagttaggccgcatggacacaacgcaggtcacattgatacacaaaattctagctgcggcagatgagcgaaatctgccgctctggatcggtgggggctgggcgatcgatgcacggctagggcgtgtaacacgcaagcacgatgatattgatctgacgtttcccggcgagaggcgcggcgagctcgaggcaatagttgaaatgctcggcgggcgcgtcatggaggagttggactatggattcttagcggagatcggggatgagttacttgactgcgaacctgcttggtgggcagacgaagcgtatgaaatcgcggaggctccgcagggctcgtgcccagaggcggctgagggcgtcatcgccgggcggccagtccgttgtaacagctgggaggcgatcatctgggattacttttactatgccgatgaagtaccaccagtggactggcctacaaagcacatagagtcctacaggctcgcatgcacctcactcggggcggaaaaggttgaggtcttgcgtgccgctttcaggtcgcgatatgcggcctaa

SEQ ID NO: 1349 - DNA, 24 bp, Artificial Sequence
  Synthetic DNA Sequence
cagccgaccaatgagtatcttgcc

SEQ ID NO: 1350 - DNA, 24 bp, Artificial Sequence
  Synthetic DNA Sequence
taatcagggcagttgcgactccta

SEQ ID NO: 1351 - DNA, 531 bp, Pseudomonas aeruginosa
  strain Stone 130
atgttatggagcagcaacgatgttacgcagcagggcagtcgccctaaaacaaagttaggtggctcaatgagcatcattgcaaccgtcaagatcggccctgacgaaatttcagccatgagggctgtgctcgatctcttcggcaaagagtttgaggacattccaacctactctgatcgccagccgaccaatgagtatcttgccaatcttctgcacagcgagacgttcatcgcgctcgctgcttttgaccgcggaacagcaataggtgggctcgccgcctacgttctacccaagttcgagcaagcgcgaagcgagatctacatttatgacttggcagtcgcttccagccatcgaaggctaggagtcgcaactgccctgattagccacctgaagcgtgtggcggttgaacttggcgcgtatgtaatctatgtgcaagcagactacggtgacgatccggcagtcgctctctacacaaagcttggagttcgggaagacgtcatgcacttcgacattgatccaagaaccgccacctaa

SEQ ID NO: 1352 - DNA, 22 bp, Artificial Sequence
  Synthetic DNA Sequence
ccacgctgacagagccgcaccg

SEQ ID NO: 1353 - DNA, 22 bp, Artificial Sequence
  Synthetic DNA Sequence
ggccagctcccatcggaccctg

SEQ ID NO: 1354 - DNA, 21 bp, Artificial Sequence
  Synthetic DNA Sequence
cacgctgacagagccgcaccg

SEQ ID NO: 1355 - DNA, 24 bp, Artificial Sequence
  Synthetic DNA Sequence
atgccgttgctgtcgaaatcctcg

SEQ ID NO: 1356 - DNA, 810 bp, Serratia marcescens
atgaacacgatcgaatcgatcacggcggacctgcacggactgggcgtccggcccggcgacctgatcatggtccatgcatcgctgaaagccgtcggcccggtcgagggaggtgcggcctcggtggtgtcggcccttcgcgccgcggtcgggtccgcagggaccctgatgggttatgcctcatgggaccgctcgccctatgaggagacgctgaacggcgcgcggatggacgaagaactgcgccgccggtggccacccttcgatctggccacatccggtacctatcccggcttcggcctgctcaaccggtttctgcttgaggcgcccgacgcacggcgcagcgcgcatcccgacgcctccatggtcgcggtcggcccccttgccgccacgctgacagagccgcaccggcttgggcaggcgctgggcgaaggctcgccgctggagcgcttcgtcgggcatggcggaaaggtcctgcttctgggagcgccgctcgactccgtcaccgtgctgcattacgccgaggccatcgcccccatcccgaacaaacgccgcgtgacctatgaaatgccgatgctcggcccggatggcagggtccgatgggagctggccgaggatttcgacagcaacggcattctcgattgcttcgcggtcgatgggaagccggatgccgtcgagacgatcgccaaggcttatgtcgaactgggccggcatcgggaaggcatcgtcggtcgcgcaccctcctatctgtttgaagcgcaggatatcgtctcgttcggcgtcacctatctcgaacagcatttcggcgcgccctga

SEQ ID NO: 1357 - DNA, 20 bp, Artificial Sequence
  Synthetic DNA Sequence
gcccatccatttgcctttgc

SEQ ID NO: 1358 - DNA, 24 bp, Artificial Sequence
  Synthetic DNA Sequence
gcgtaccaacttgccatcctgaag

SEQ ID NO: 1359 - DNA, 19 bp, Artificial Sequence
  Synthetic DNA Sequence
tgcccctgccacctcactc

SEQ ID NO: 1360 - DNA, 24 bp, Artificial Sequence
  Synthetic DNA Sequence
cgtaccaacttgccatcctgaaga

SEQ ID NO: 1361 - DNA, 786 bp, Escherichia coli
gtgcaatacgaatggcgaaaagccgagctcatcggtcagcttctcaaccttggggttacccccggcggtgtgctgctggtccacagctccttccgtagcgtccggcccctcgaagatgggccacttggactgatcgaggccctgcgtgctgcgctgggtccgggagggacgctcgtcatgccctcgtggtcaggtctggacgacgagccgttcgatcctgccacgtcgcccgttacaccggaccttggagttgtctctgacacattctggcgcctgccaaatgtaaagcgcagcgcccatccatttgcctttgcggcagcggggccacaggcagagcagatcatctctgatccattgcccctgccacctcactcgcctgcaagcccggtcgcccgtgtccatgaactcgatgggcaggtacttctcctcggcgtgggacacgatgccaacacgacgctgcatcttgccgagttgatggcaaaggttccctatggggtgccgagacactgcaccattcttcaggatggcaagttggtacgcgtcgattatctcgagaatgaccactgctgtgagcgctttgccttggcggacaggtggctcaaggagaagagccttcagaaggaaggtccagtcggtcatgcctttgctcggttgatccgctcccgcgacattgtggcgacagccctgggtcaactgggccgagatccgttgatcttcctgcatccgccagagggcgggatgcgaagaatgcgatgccgctcgccagtcgattggctgagctcatga

SEQ ID NO: 1362 - DNA, 22 bp, Artificial Sequence
  Synthetic DNA Sequence
cgccgccatcgcccaaagctgg

SEQ ID NO: 1363 - DNA, 24 bp, Artificial Sequence
  Synthetic DNA Sequence
cggcataatggagcgcggtgactg

SEQ ID NO: 1364 - DNA, 24 bp, Artificial Sequence
  Synthetic DNA Sequence
tttctcgcccacgcaggaaaaatc

SEQ ID NO: 1365 - DNA, 22 bp, Artificial Sequence
  Synthetic DNA Sequence
catcctcgacgaatatgccgcg

SEQ ID NO: 1366 - DNA, 900 bp, Enterobacter cloacae
atgactgatccccgcaaaaacggcgatttgcacgaacccgcgacggcacccgcgacgccctggtccaaaagcgagctggtccggcaattgcgcgacctcggcgtgcgctcaggcgatatggtgatgccgcatgtgtcgttgcgcgccgtcgggccgctggcggacggaccgcagacacttgtcgatgcgctgatcgaggccgtcggccccaccgggaatattctcgccttcgtctcgtggcgcgattcgccctatgaacagacgctgggtcatgatgcgccgcccgccgccatcgcccaaagctggcctgcgttcgaccccgaccatgcgcccgcctaccccggctttggcgcgatcaacgaatttatccgaacctatccggggtgtcggcgcacggcccatcccgacgcatcgatggcggcgatcgggcccgatgcggcgtggctggtggcgccgcacgagatgggcgccgcttatggcccccgctcgccgatcgcgcgttttctcgcccacgcaggaaaaatcctgtcgatcggcgccgggcccgatgcagtcaccgcgctccattatgccgaagcggtggcgcggatcgagggcaagcgccgcgtcacttattcgatgcccttactgcgcgaaggcaagcgcgtctgggtcaccacgtccgactgggattcgaacggcatcctcgacgaatatgccgcgcccgacggccccgacgcggtcgaacggatcgcccgcgactatctcgcccgcaccagggttgcgcaaggcccggtcggcggcgcgcaatcccggctgatcgacgcggccgatatcgtttccttcggcatcgaatggctcgaggcgcgccacgccgcgccagcggcggcagcgctgaagccgaaacaacgccgcgactga

SEQ ID NO: 1367 - DNA, 24 bp, Artificial Sequence
  Synthetic DNA Sequence
caaatatactaacagaagcgttca

SEQ ID NO: 1368 - DNA, 22 bp, Artificial Sequence
  Synthetic DNA Sequence
aggatcttgccaatacctttat

SEQ ID NO: 1369 - DNA, 24 bp, Artificial Sequence
  Synthetic DNA Sequence
aaacctttgtttcggtctgctaat

SEQ ID NO: 1370 - DNA, 24 bp, Artificial Sequence
  Synthetic DNA Sequence
aagcgattccaataataccttgct

SEQ ID NO: 1371 - DNA, 558 bp, Citrobacter diversus
atgaattatcaaattgtgaatattgcggaatgcagcaattatcagttagaagcagcaaatatactaacagaagcgttcaatgatcttggtaacaattcatggccagatatgacgagtgcaacaaaagaagtaaaagaatgtattgagagtccaaacctttgtttcggtctgctaataaataactccttagttggctggataggcttaaggccaatgtacaaggaaacctgggaattgcatccattggttgtcagaccagattatcaaaataaaggtattggcaagatcctgcttaaggaattagaaaacagagctagagagcaaggtattattggaatcgctttaggaacagatgatgaatactatagaacaagtctctctttaataactataacagaagataatatatttgattcaataaaaaatattaaaaatattaataaacatccatatgagttttatcagaagaatggttattatattgttggaataattccaaatgccaatggtaaaaacaaaccagatatttggatgtggaaaagtttaatcaaagagtaa

SEQ ID NO: 1372 - DNA, 24 bp, Artificial Sequence
  Synthetic DNA Sequence
gctttcgttgcctttgccgaggtc

SEQ ID NO: 1373 - DNA, 23 bp, Artificial Sequence
  Synthetic DNA Sequence
cacccctgttgcttcgcccactc

SEQ ID NO: 1374 - DNA, 24 bp, Artificial Sequence
  Synthetic DNA Sequence
agatattggcttcgccgcaccaca

SEQ ID NO: 1375 - DNA, 23 bp, Artificial Sequence
  Synthetic DNA Sequence
ccctgttgcttcgcccactcctg

SEQ ID NO: 1376 - DNA, 441 bp, Serratia marcescens
atgatcgtcatctgcgaccacgacaacctcgacgcctggctggcgctgcgcaccgcgctgtggccctccggctcgcctgaagatcaccgcgcggaaatgcgcgagatattggcttcgccgcaccacaccgcgtttatggcgcgggggctggacggcgctttcgttgcctttgccgaggtcgcgctgcgctacgattacgtcaacggctgcgaatcgtcgccggtggcgtttttggaaggaatttataccgccgaacgcgcccgccgccagggctgggccgcgcgcctgatcgcgcaggtgcaggagtgggcgaagcaacaggggtgcagcgagctggcgtcggataccgatatcgccaatctggactcccagcgcctgcatgcggcgctgggctttgccgaaacggagcgagtagtgttttaccgcaaaacgctgggctga

SEQ ID NO: 1377 - DNA, 24 bp, Artificial Sequence
  Synthetic DNA Sequence
gccgtgggtcgatgtttgatgtta

SEQ ID NO: 1378 - DNA, 24 bp, Artificial Sequence
  Synthetic DNA Sequence
gctcgatgacgccaactacctctg

SEQ ID NO: 1379 - DNA, 24 bp, Artificial Sequence
  Synthetic DNA Sequence
agcagcaacgatgttacgcagcag

SEQ ID NO: 1380 - DNA, 24 bp, Artificial Sequence
  Synthetic DNA Sequence
cgctcgatgacgccaactacctct

SEQ ID NO: 1381 - DNA, 972 bp, Escherichia coli
gtggtaacggcgcagtggcggttttcatggcttcttgttatgacatgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataa

SEQ ID NO: 1382 - DNA, 24 bp, Artificial Sequence
  Synthetic DNA Sequence
tagatatgataggcggtaaaaagc

SEQ ID NO: 1383 - DNA, 23 bp, Artificial Sequence
  Synthetic DNA Sequence
cccaaattcgagtaagaggtatt

SEQ ID NO: 1384 - DNA, 22 bp, Artificial Sequence
  Synthetic DNA Sequence
gatatgataggcggtaaaaagc

SEQ ID NO: 1385 - DNA, 22 bp, Artificial Sequence
  Synthetic DNA Sequence
tcccaaattcgagtaagaggta

SEQ ID NO: 1386 - DNA, 477 bp, Staphylococcus aureus
atgaaagaaagatatggaacagtatataaaggctctcagaggctcatagacgaggaaagtggagaagtaatagaggtagataagctataccgtaaacaaacgtctggtaactttgtaaaagcgtatatcgtccaattaataagtatgttagatatgataggcggtaaaaagctcaagattgttaattatatattagataatgtacatctaagtaataacacaatgatagcaactgttagagaaatagcagaaggaacaaatacaagcacgaaaaccgtaaatacaacgcttaaaatcttagaagaaggaaatatcattaaaagaagaactggagcattaatgctaaacccagagctactcatgagaggcgatgaccaaaaacaaaaatacctcttactcgaatttgggaactttgagcaagaggacgaccaaaagcaagaaaatgctttatcagaatattattctttcaaggagtag

SEQ ID NO: 1387 - DNA, 24 bp, Artificial Sequence
  Synthetic DNA Sequence
ttatgcctcttccgaccatcaagc

SEQ ID NO: 1388 - DNA, 24 bp, Artificial Sequence
  Synthetic DNA Sequence
tacgctcgtcatcaaaatcactcg

SEQ ID NO: 1389 - DNA, 24 bp, Artificial Sequence
  Synthetic DNA Sequence
gaataacggtttggttgatgcgag

SEQ ID NO: 1390 - DNA, 24 bp, Artificial Sequence
  Synthetic DNA Sequence
atggcaagatcctggtatcggtct

SEQ ID NO: 1391 - DNA, 816 bp, Escherichia coli
atgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaa

SEQ ID NO: 1392 - DNA, 24 bp, Artificial Sequence
  Synthetic DNA Sequence
tgggtggagaggctattcggctat

SEQ ID NO: 1393 - DNA, 23 bp, Artificial Sequence
  Synthetic DNA Sequence
cagtcccttcccgcttcagtgac

SEQ ID NO: 1394 - DNA, 24 bp, Artificial Sequence
  Synthetic DNA Sequence
gacgttgtcactgaagcgggaagg

SEQ ID NO: 1395 - DNA, 24 bp, Artificial Sequence
  Synthetic DNA Sequence
cttggtggtcgaatgggcaggtag

SEQ ID NO: 1396 - DNA, 795 bp, Escherichia coli
atgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctga

SEQ ID NO: 1397 - DNA, 22 bp, Artificial Sequence
  Synthetic DNA Sequence
gtgggagaaaatgaaaacctat

SEQ ID NO: 1398 - DNA, 20 bp, Artificial Sequence
  Synthetic DNA Sequence
atggagtgaaagagcctgat

SEQ ID NO: 1399 - DNA, 24 bp, Artificial Sequence
  Synthetic DNA Sequence
acctatgatgtggaacgggaaaag

SEQ ID NO: 1400 - DNA, 23 bp, Artificial Sequence
  Synthetic DNA Sequence
cgatggagtgaaagagcctgatg

SEQ ID NO: 1401 - DNA, 795 bp, Enterococcus faecalis
atggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttag

SEQ ID NO: 1402 - DNA, 24 bp, Artificial Sequence
  Synthetic DNA Sequence
tattcaacaatttatcggaaacag

SEQ ID NO: 1403 - DNA, 23 bp, Artificial Sequence
  Synthetic DNA Sequence
tcagagagccaactcaacatttt

SEQ ID NO: 1404 - DNA, 24 bp, Artificial Sequence
  Synthetic DNA Sequence
aaacagcgttttagagccaaataa

SEQ ID NO: 1405 - DNA, 24 bp, Artificial Sequence
  Synthetic DNA Sequence
ttctcagagagccaactcaacatt

SEQ ID NO: 1406 - DNA, 780 bp, Acinetobacter baumannii
  strain BM2580
atggaattgcccaatattattcaacaatttatcggaaacagcgttttagagccaaataaaattggtcagtcgccatcggatgtttattcttttaatcgaaataatgaaactttttttcttaagcgatctagcactttatatacagagaccacatacagtgtctctcgtgaagcgaaaatgttgagttggctctctgagaaattaaaggtgcctgaactcatcatgacttttcaggatgagcagtttgaattcatgatcactaaagcgatcaatgcaaaaccaatttcagcgctttttttaacagaccaagaattgcttgctatctataaggaggcactcaatctgttaaattcaattgctattattgattgtccatttatttcaaacattgatcatcggttaaaagagtcaaaattttttattgataaccaactccttgacgatatagatcaagatgattttgacactgaattatggggagaccataaaacttacctaagtctatggaatgagttaaccgagactcgtgttgaagaaagattggttttttctcatggcgatatcacggatagtaatatttttatagataaattcaatgaaatttattttttagatcttggtcgtgctgggttagcagatgaatttgtagatatatcctttgttgaacgttgcctaagagaggatgcatcggaggaaactgcgaaaatatttttaaagcatttaaaaaatgatagacctgacaaaaggaattattttttaaaacttgatgaattgaattga

SEQ ID NO: 1407 - DNA, 24 bp, Artificial Sequence
  Synthetic DNA Sequence
ccctgtaatagaaaagcaagtagg

SEQ ID NO: 1408 - DNA, 22 bp, Artificial Sequence
  Synthetic DNA Sequence
ttgtcgtatccctcaaatcacc

SEQ ID NO: 1409 - DNA, 23 bp, Artificial Sequence
  Synthetic DNA Sequence
tgggattacaatggcaatcagcg

SEQ ID NO: 1410 - DNA, 25 bp, Artificial Sequence
  Synthetic DNA Sequence
ggggaataggtcacaagatctgctt

SEQ ID NO: 1411 - DNA, 912 bp, Pseudomonas aeruginosa
atgcttttatataaaatgtgtgacaatcaaaattatggggttacttacatgaagtttttattggcattttcgcttttaataccatccgtggtttttgcaagtagttcaaagtttcagcaagttgaacaagacgttaaggcaattgaagtttctctttctgctcgtataggtgtttccgttcttgatactcaaaatggagaatattgggattacaatggcaatcagcgcttcccgttaacaagtacttttaaaacaatagcttgcgctaaattactatatgatgctgagcaaggaaaagttaatcccaatagtacagtcgagattaagaaagcagatcttgtgacctattcccctgtaatagaaaagcaagtagggcaggcaatcacactcgatgatgcgtgcttcgcaactatgactacaagtgataatactgcggcaaatatcatcctaagtgctgtaggtggccccaaaggcgttactgattttttaagacaaattggggacaaagagactcgtctagaccgtattgagcctgatttaaatgaaggtaagctcggtgatttgagggatacgacaactcctaaggcaatagccagtactttgaataaacttttatttggttccgcgctatctgaaatgaaccagaaaaaattagagtcttggatggtgaacaatcaagtcactggtaatttactacgttcagtattgccggcgggatggaacattgcggatcgctcaggtgctggcggatttggtgctcggagtattacagcagttgtgtggagtgagcatcaagccccaattattgtgagcatctatctagctcaaacacaggcttcaatggcagagcgaaatgatgcgattgttaaaattggtcattcaatttttgacgtttatacatcacagtcgcgc

SEQ ID NO: 1412 - DNA, 21 bp, Artificial Sequence
  Synthetic DNA Sequence
gagaaaacgctccagcagggc

SEQ ID NO: 1413 - DNA, 21 bp, Artificial Sequence
  Synthetic DNA Sequence
catgaggctttcactgcgggg

SEQ ID NO: 1414 - DNA, 21 bp, Artificial Sequence
  Synthetic DNA Sequence
tatcgttaatcgcaccatcac

SEQ ID NO: 1415 - DNA, 21 bp, Artificial Sequence
  Synthetic DNA Sequence
atgcagtaatgcggctttatc

SEQ ID NO: 1416 - DNA, 1146 bp, Klebsiella pneumoniae
  strain HEL-1
atgatgaaaaaatcgttatgctgcgctctgctgctgacagcctctttctccacatttgctgccgcaaaaacagaacaacagattgccgatatcgttaatcgcaccatcaccccgttgatgcaggagcaggctattccgggtatggccgttgccgttatctaccagggaaaaccctattatttcacctggggtaaagccgatatcgccaataaccacccagtcacgcagcaaacgctgtttgagctaggatcggttagtaagacgtttaacggcgtgttgggcggcgatgctatcgcccgcggcgaaattaagctcagcgatccggtcacgaaatactggccagaactgacaggcaaacagtggcagggtatccgcctgctgcacttagccacctatacggcaggcggcctaccgctgcagatccccgatgacgttagggataaagccgcattactgcatttttatcaaaactggcagccgcaatggactccgggcgctaagcgactttacgctaactccagcattggtctgtttggcgcgctggcggtgaaaccctcaggaatgagttacgaagaggcaatgaccagacgcgtcctgcaaccattaaaactggcgcatacctggattacggttccgcagaacgaacaaaaagattatgcctggggctatcgcgaagggaagcccgtacacgtttctccgggacaacttgacgccgaagcctatggcgtgaaatccagcgttattgatatggcccgctgggttcaggccaacatggatgccagccacgttcaggagaaaacgctccagcagggcattgcgcttgcgcagtctcgctactggcgtattggcgatatgtaccagggattaggctgggagatgctgaactggccgctgaaagctgattcgatcatcaacggcagcgacagcaaagtggcattggcagcgcttcccgccgttgaggtaaacccgcccgcccccgcagtgaaagcctcatgggtgcataaaacgggctccactggtggatttggcagctacgtagccttcgttccagaaaaaaaccttggcatcgtgatgctggcaaacaaaagctatcctaaccctgtccgtgtcgaggcggcctggcgcattcttgaaaagctgcaataa

SEQ ID NO: 1417 - DNA, 25 bp, Artificial Sequence
  Synthetic DNA Sequence
tggttaactayaatccsattgcgga

SEQ ID NO: 1418 - DNA, 22 bp, Artificial Sequence
  Synthetic DNA Sequence
atgctttacccagcgtcagatt

SEQ ID NO: 1419 - DNA, 24 bp, Artificial Sequence
  Synthetic DNA Sequence
cgatgaataagctgatttctcacg

SEQ ID NO: 1420 - DNA, 24 bp, Artificial Sequence
  Synthetic DNA Sequence
tgctttacccagcgtcagattacg

SEQ ID NO: 1421 - DNA, 24 bp, Artificial Sequence
  Synthetic DNA Sequence
aattagagcggcagtcgggaggaa

SEQ ID NO: 1422 - DNA, 24 bp, Artificial Sequence
  Synthetic DNA Sequence
gaaatcagcttattcatcgccacg

SEQ ID NO: 1423 - DNA, 876 bp, Escherichia coli
  strain GRI-1
atggttaaaaaatcactgcgtcagttcacgctgatggcgacggcaaccgtcacgctgttgttaggaagtgtgccgctgtatgcgcaaacggcggacgtacagcaaaaacttgccgaattagagcggcagtcgggaggaagactgggtgtggcattgattaacacagcagataattcgcaaatactttatcgtgctgatgagcgctttgcgatgtgcagcaccagtaaagtgatggccgtggccgcggtgctgaagaaaagtgaaagcgaaccgaatctgttaaatcagcgagttgagatcaaaaaatctgacttggttaactataatccgattgcggaaaagcacgtcgatgggacgatgtcactggctgagcttagcgcggccgcgctacagtacagcgataacgtggcgatgaataagctgatttctcacgttggcggcccggctagcgtcaccgcgttcgcccgacagctgggagacgaaacgttccgtctcgaccgtaccgagccgacgttaaacaccgccattccgggcgatccgcgtgataccacttcacctcgggcaatggcgcaaactctgcgtaatctgacgctgggtaaagcattgggtgacagccaacgggcgcagctggtgacatggatgaaaggcaataccaccggtgcagcgagcattcaggctggactgcctgcttcctgggttgtgggggataaaaccggcagcggtgactatggcaccaccaacgatatcgcggtgatctggccaaaagatcgtgcgccgctgattctggtcacttacttcacccagcctcaacctaaggcagaaagccgtcgcgatgtattagcgtcggcggctaaaatcgtcaccaacggtttgtaa

SEQ ID NO: 1424 - DNA, 23 bp, Artificial Sequence
  Synthetic DNA Sequence
gttaacggtgatggcgacgctac

SEQ ID NO: 1425 - DNA, 24 bp, Artificial Sequence
  Synthetic DNA Sequence
gaattatcggcggtgttaatcagc

SEQ ID NO: 1426 - DNA, 22 bp, Artificial Sequence
  Synthetic DNA Sequence
cacgctcaataccgccattcca

SEQ ID NO: 1427 - DNA, 24 bp, Artificial Sequence
  Synthetic DNA Sequence
ttatcgcccactacccatgatttc

SEQ ID NO: 1428 - DNA, 876 bp, Salmonella typhimurium
  strain CAS-5
atgatgactcagagcattcgccgctcaatgttaacggtgatggcgacgctacccctgctatttagcagcgcaacgctgcatgcgcaggcgaacagcgtgcaacagcagctggaagccctggagaaaagttcgggaggtcggcttggcgttgcgctgattaacaccgccgataattcgcagattctctaccgtgccgatgaacgttttgcgatgtgcagtaccagtaaggtgatggcggccgcggcggtgcttaaacagagcgagagcgataagcacctgctaaatcagcgcgttgaaatcaagaagagcgacctggttaactacaatcccattgcggagaaacacgttaacggcacgatgacgctggctgagcttggcgcagcggcgctgcagtatagcgacaatactgccatgaataagctgattgcccatctgggtggtcccgataaagtgacggcgtttgctcgctcgttgggtgatgagaccttccgtctggacagaaccgagcccacgctcaataccgccattccaggcgacccgcgtgataccaccacgccgctcgcgatggcgcagaccctgaaaaatctgacgctgggtaaagcgctggcggaaactcagcgggcacagttggtgacgtggcttaagggcaatactaccggtagcgcgagcattcgggcgggtctgccgaaatcatgggtagtgggcgataaaaccggcagcggagattatggcaccaccaacgatatcgcggttatctggccggaaaaccacgcaccgctggttctggtgacctactttacccaaccggagcagaaggcggaaagccgtcgggatattctggctgcggcggcgaaaatcgtaacccacggtttctga

SEQ ID NO: 1429 - DNA, 25 bp, Artificial Sequence
  Synthetic DNA Sequence
tttacggctaaagatactgaaaagt

SEQ ID NO: 1430 - DNA, 26 bp, Artificial Sequence
  Synthetic DNA Sequence
gtttaataaaacaaccaccgaataat

SEQ ID NO: 1431 - DNA, 25 bp, Artificial Sequence
  Synthetic DNA Sequence
taattgacactccatttacggctaa

SEQ ID NO: 1432 - DNA, 26 bp, Artificial Sequence
  Synthetic DNA Sequence
accgaataatattttcctttcaggca

SEQ ID NO: 1433 - DNA, 741 bp, Pseudomonas aeruginosa
atgagcaagttatctgtattctttatatttttgttttgcagcattgctaccgcagcagagtctttgccagatttaaaaattgaaaagcttgatgaaggcgtttatgttcatacttcgtttgaagaagttaacgggtggggcgttgttcctaaacatggtttggtggttcttgtaaatgctgaggcttacctaattgacactccatttacggctaaagatactgaaaagttagtcacttggtttgtggagcgtggctataaaataaaaggcagcatttcctctcattttcatagcgacagcacgggcggaatagagtggcttaattctcgatctatccccacgtatgcatctgaattaacaaatgaactgcttaaaaaagacggtaaggttcaagccacaaattcatttagcggagttaactattggctagttaaaaataaaattgaagttttttatccaggcccgggacacactccagataacgtagtggtttggttgcctgaaaggaaaatattattcggtggttgttttattaaaccgtacggtttaggcaatttgggtgacgcaaatatagaagcttggccaaagtccgccaaattattaaagtccaaatatggtaaggcaaaactggttgttccaagtcacagtgaagttggagacgcatcactcttgaaacttacattagagcaggcggttaaagggttaaacgaaagtaaaaaaccatcaaaaccaagcaactaa

SEQ ID NO: 1434 - DNA, 25 bp, Artificial Sequence
  Synthetic DNA Sequence
cacaatcaagaccaagatttgcgat

SEQ ID NO: 1435 - DNA, 25 bp, Artificial Sequence
  Synthetic DNA Sequence
gaaagggcagctcgttacgatagag

SEQ ID NO: 1436 - DNA, 24 bp, Artificial Sequence
  Synthetic DNA Sequence
cagcatcaacatttaagatcccca

SEQ ID NO: 1437 - DNA, 26 bp, Artificial Sequence
  Synthetic DNA Sequence
ctccacttgattaactgcggaaattc

SEQ ID NO: 1438 - DNA, 828 bp, Escherichia coli
atggcaatccgaatcttcgcgatacttttctccattttttctcttgccactttcgcgcatgcgcaagaaggcacgctagaacgttctgactggaggaagtttttcagcgaatttcaagccaaaggcacgatagttgtggcagacgaacgccaagcggatcgtgccatgttggtttttgatcctgtgcgatcgaagaaacgctactcgcctgcatcgacattcaagatacctcatacactttttgcacttgatgcaggcgctgttcgtgatgagttccagatttttcgatgggacggcgttaacaggggctttgcaggccacaatcaagaccaagatttgcgatcagcaatgcggaattctactgtttgggtgtatgagctatttgcaaaggaaattggtgatgacaaagctcggcgctatttgaagaaaatcgactatggcaacgccgatccttcgacaagtaatggcgattactggatagaaggcagccttgcaatctcggcgcaggagcaaattgcatttctcaggaagctctatcgtaacgagctgccctttcgggtagaacatcagcgcttggtcaaggatctcatgattgtggaagccggtcgcaactggatactgcgtgcaaagacgggctgggaaggccgtatgggttggtgggtaggatgggttgagtggccgactggctccgtattcttcgcactgaatattgatacgccaaacagaatggatgatcttttcaagagggaggcaatcgtgcgggcaatccttcgctctattgaagcgttaccgcccaacccggcagtcaactcggacgctgcgcgataa

SEQ ID NO: 1439 - DNA, 801 bp, Pseudomonas aeruginosa
atgaaaacatttgccgcatatgtaattatcgcgtgtctttcgagtacggcattagctggttcaattacagaaaatacgtcttggaacaaagagttctctgccgaagccgtcaatggtgtcttcgtgctttgtaaaagtagcagtaaatcctgcgctaccaatgacttagctcgtgcatcaaaggaatatcttccagcatcaacatttaagatccccaacgcaattatcggcctagaaactggtgtcataaagaatgagcatcaggttttcaaatgggacggaaagccaagagccatgaagcaatgggaaagagacttgaccttaagaggggcaatacaagtttcagctgttcccgtatttcaacaaatcgccagagaagttggcgaagtaagaatgcagaaataccttaaaaaattttcctatggcaaccagaatatcagtggtggcattgacaaattctggttggaaggccagcttagaatttccgcagttaatcaagtggagtttctagagtctctatatttaaataaattgtcagcatctaaagaaaaccagctaatagtaaaagaggctttggtaacggaggcggcacctgaatatctagtgcattcaaaaactggtttttctggtgtgggaactgagtcaaatcctggtgtcgcatggtgggttgggtgggttgagaaggagacagaggtttactttttcgcctttaacatggatatagacaacgaaagtaagttgccgctaagaaaatccattcccaccaaaatcatggaaagtgagggcatcattggtggctaa

SEQ ID NO: 1440 - DNA, 26 bp, Artificial Sequence
  Synthetic DNA Sequence
agaccgttatcgtaaacagggctaag

SEQ ID NO: 1441 - DNA, 26 bp, Artificial Sequence
  Synthetic DNA Sequence
ttttttgctcaaactttttcaggatc

SEQ ID NO: 1442 - DNA, 927 bp, Pseudomonas aeruginosa
  strain RNL-1
atgaatgtcattataaaagctgtagttactgcctcgacgctactgatggtatcttttagttcattcgaaacctcagcgcaatccccactgttaaaagagcaaattgaatccatagtcattggaaaaaaagccactgtaggcgttgcagtgtgggggcctgacgatctggaacctttactgattaatccttttgaaaaattcccaatgcaaagtgtatttaaattgcatttagctatgttggtactgcatcaggttgatcagggaaagttggatttaaatcagaccgttatcgtaaacagggctaaggttttacagaatacctgggctccgataatgaaagcgtatcagggagacgagtttagtgttccagtgcagcaactgctgcaatactcggtctcgcacagcgataacgtggcctgtgatttgttatttgaactggttggtggaccagctgctttgcatgactatatccagtctatgggtataaaggagaccgctgtggtcgcaaatgaagcgcagatgcacgccgatgatcaggtgcagtatcaaaactggacctcgatgaaaggtgctgcagagatcctgaaaaagtttgagcaaaaaacacagctgtctgaaacctcgcaggctttgttatggaagtggatggtcgaaaccaccacaggaccagagcggttaaaaggtttgttaccagctggtactgtggtcgcacataaaactggtacttcgggtatcaaagccggaaaaactgcggccactaatgatttaggtatcattctgttgcctgatggacggcccttgctggttgctgtttttgtgaaagactcagccgagtcaagccgaaccaatgaagctatcattgcgcaggttgctcagactgcgtatcaatttgaattgaaaaagctttctgccctaagcccaaattaa

SEQ ID NO: 1443 - DNA, 23 bp, Artificial Sequence
  Synthetic DNA Sequence
cttctgctctgctgatgcttggc

SEQ ID NO: 1444 - DNA, 26 bp, Artificial Sequence
  Synthetic DNA Sequence
ggcgaccaggtattttgtaatactgc

SEQ ID NO: 1445 - DNA, 927 bp, Salmonella typhimurium
  strain JMC
atgaatgtcatcacaaaatgtgttttcaccgcttctgctctgctgatgcttggcttaagttcatttgtagtatcagcccaatcccctttgttaaaagagcagattgaaaccatagtgacgggtaaaaaggccactgtaggtgtagcagtgtgggggcctgacgatctggaacctttgttgctgaatccatttgaaaagtttccgatgcaaagtgtgtttaaactgcatttagctatgttagttctgcatcaggtcgatcaggggaaactggatttaaatcagtctgttactgttaatcgtgctgcagtattacaaaatacctggtcgccaatgatgaaagatcatcagggcgatgaatttactgttgcagtacagcagttactgcagtattcggtgtcacacagcgacaatgtggcctgcgatttgttatttgaactggtgggcgggccgcaagctttgcatgcttatatccagtctttaggcgttaaagaagctgccgtggtagcaaatgaagcgcaaatgcatgcggatgatcaggtgcaatatcaaaactggacgtcgatgaaagccgcagcacaagttctgcaaaagtttgaacagaaaaagcagttgtctgaaacctctcaggccttgttatggaaatggatggttgaaaccaccacaggaccacagcggttaaaaggcttgttacctgctggtactatagtggcgcataaaaccggtacttcgggcgtcagagcaggaaaaactgcggcgactaatgatgcgggcgtcattatgttgcctgatggacggcctttattggtggcggtatttgtcaaggattcggctgaatcagaacgaaccaatgaagctattattgcgcaggttgcgcaagcggcttatcagtttgagctgaaaaaactctctgcagtgagtccggattga

SEQ ID NO: 1446 - DNA, 27 bp, Artificial Sequence
  Synthetic DNA Sequence
ggcctgygatttgttatttgaactggt

SEQ ID NO: 1447 - DNA, 23 bp, Artificial Sequence
  Synthetic DNA Sequence
cgctstggtcctgtggtggtttc

SEQ ID NO: 1448 - DNA, 26 bp, Artificial Sequence
  Synthetic DNA Sequence
gatcaggtgcartatcaaaactggac

SEQ ID NO: 1449 - DNA, 26 bp, Artificial Sequence
  Synthetic DNA Sequence
agcwggtaacaayccttttaaccgct

SEQ ID NO: 1450 - DNA, 26 bp, Artificial Sequence
  Synthetic DNA Sequence
accactgggaatacacttgtaatggc

SEQ ID NO: 1451 - DNA, 26 bp, Artificial Sequence
  Synthetic DNA Sequence
atctacctggtcaatcattgcttcgt

SEQ ID NO: 1452 - DNA, 486 bp, Staphylococcus epidermidis
  strain BM10393
atgacattatcaataattgtcgctcacgataaacaaagagtcattgggtaccaaaatcaattaccttggcacttaccaaatgatttaaagcatattaaacaactgaccactgggaatacacttgtaatggcacggaaaacttttaattctatagggaagccattgccaaatagacgtaacgtcgtactcactaaccaagcttcatttcaccatgaaggggtagatgttataaactctcttgatgaaattaaagagttatctggtcatgtttttatatttggaggacaaacgttatacgaagcaatgattgaccaggtagatgatatgtatatcacagtaatagatggaaagtttcaaggagacacattctttccaccatacacattcgaaaactgggaagtcgaatcttcagtagaaggtcaactagatgaaaaaaatactataccgcatacattcttacatttagtgcgtagaaaagggaaatag

SEQ ID NO: 1453 - DNA, 26 bp, Artificial Sequence
  Synthetic DNA Sequence
atcgaagaatggagttatcggraatg

SEQ ID NO: 1454 - DNA, 25 bp, Artificial Sequence
  Synthetic DNA Sequence
cctaaaaytrctggggatttcwgga

SEQ ID NO: 1455 - DNA, 24 bp, Artificial Sequence
  Synthetic DNA Sequence
caggtggtggggagatatacaaaa

SEQ ID NO: 1456 - DNA, 26 bp, Artificial Sequence
  Synthetic DNA Sequence
tatgttagasrcgaagtcttggktaa

SEQ ID NO: 1457 - DNA, 22 bp, Artificial Sequence
  Synthetic DNA Sequence
caaaggtgaacagctcctgttt

SEQ ID NO: 1458 - DNA, 27 bp, Artificial Sequence
  Synthetic DNA Sequence
tccgttattttctttaggttggttaaa

SEQ ID NO: 1459 - DNA, 20 bp, Artificial Sequence
  Synthetic DNA Sequence
aaggtgaacagctcctgttt

SEQ ID NO: 1460 - DNA, 22 bp, Artificial Sequence
  Synthetic DNA Sequence
gatcactacgttctcattgtca

SEQ ID NO: 1461 - DNA, 474 bp, Escherichia coli
gtgaaactatcactaatggtagctatatcgaagaatggagttatcgggaatggccctgatattccatggagtgccaaaggtgaacagctcctgtttaaagctattacctataaccaatggctgttggttggacgcaagacttttgaatcaatgggagcattacccaaccgaaagtatgcggtcgtaacacgtccaagttttacatctgacaatgagaacgtagtgatctttccatcaattaaagatgctttaaccaacctaaagaaaataacggatcatgtcattgtttcaggtggtggggagatatacaaaagcctgatcgatcaagtagatacactacatatatctacaatagacatcgagccggaaggtgatgtttactttcctgaaatccccagcaattttaggccagtttttacccaagacttcgcctctaacataaattatagttaccaaatctggcaaaagggttaa

SEQ ID NO: 1462 - DNA, 23 bp, Artificial Sequence
  Synthetic DNA Sequence
gcactcccyaataggaaatacgc

SEQ ID NO: 1463 - DNA, 23 bp, Artificial Sequence
  Synthetic DNA Sequence
agtgttgctcaaaaacaacttcg

SEQ ID NO: 1464 - DNA, 23 bp, Artificial Sequence
  Synthetic DNA Sequence
acgttygaatctatgggmgcact

SEQ ID NO: 1465 - DNA, 23 bp, Artificial Sequence
  Synthetic DNA Sequence
gtcgataagtggagcgtagaggc

SEQ ID NO: 1466 - DNA, 23 bp, Artificial Sequence
  Synthetic DNA Sequence
aagcattgacctacaatcagtgt

SEQ ID NO: 1467 - DNA, 27 bp, Artificial Sequence
  Synthetic DNA Sequence
aatacaactacattgtcatcatttgat

SEQ ID NO: 1468 - DNA, 26 bp, Artificial Sequence
  Synthetic DNA Sequence
cgttacccgctcaggttggacatcaa

SEQ ID NO: 1469 - DNA, 23 bp, Artificial Sequence
  Synthetic DNA Sequence
catccccctctggctcgatgtcg

SEQ ID NO: 1470 - DNA, 474 bp, Escherichia coli
ttgaaagtatcattgatagctgcgaaacgaaaaaacggcgtgattggttgcggtccagacataccgtggtccgcgaaaggggagcagctactttttaaagcattgacctacaatcagtgtcttctggtgggtcgcaagacgtttgaatctatgggcgcactccccaataggaaatacgcggtcgttacccgctcaggttggacatcaaatgatgacaatgtagttgtatttcagtcaatcgaagaggccatggacaggctagctgaattcaccggtcacgttatagtgtctggtggcggagaaatttaccgagaaacattacccatggcctctacgctccacttatcgacgatcgacatcgagccagagggggatgttttcttcccgagtattccaaataccttcgaagttgtttttgagcaacactttacttcaaacattaactattgctatcaaatttggaaaaagggttaa

SEQ ID NO: 1471 - DNA, 26 bp, Artificial Sequence
  Synthetic DNA Sequence
gataatgacaacgtaatagtattccc

SEQ ID NO: 1472 - DNA, 23 bp, Artificial Sequence
  Synthetic DNA Sequence
gctcaatatcaatcgtcgatata

SEQ ID NO: 1473 - DNA, 26 bp, Artificial Sequence
  Synthetic DNA Sequence
ttaaagccttgacgtacaaccagtgg

SEQ ID NO: 1474 - DNA, 26 bp, Artificial Sequence
  Synthetic DNA Sequence
tgggcaatgtttctctgtaaatctcc

SEQ ID NO: 1475 - DNA, 474 bp, Escherichia coli
gtgaaagtatcattaatggctgcaaaagcgaaaaacggagtgattggttgcggtccacacataccctggtccgcgaaaggagagcagctactctttaaagccttgacgtacaaccagtggcttttggtgggccgcaagacgttcgaatctatgggagcactccctaataggaaatacgcggtcgttactcgctcagcctggacggccgataatgacaacgtaatagtattcccgtcgatcgaagaggccatgtacgggctggctgaactcaccgatcacgttatagtgtctggtggcggggagatttacagagaaacattgcccatggcctctacgctccatatatcgacgattgatattgagccggaaggagatgttttctttccgaatattcccaataccttcgaagttgtttttgagcaacactttagctcaaacattaactattgctatcaaatttggcaaaagggttaa

SEQ ID NO: 1476 - DNA, 22 bp, Artificial Sequence
  Synthetic DNA Sequence
ggcgagcagctcctattcaaag

SEQ ID NO: 1477 - DNA, 25 bp, Artificial Sequence
  Synthetic DNA Sequence
taggtaagctaatgccgattcaaca

SEQ ID NO: 1478 - DNA, 26 bp, Artificial Sequence
  Synthetic DNA Sequence
gagaatggagtaattggctctggatt

SEQ ID NO: 1479 - DNA, 25 bp, Artificial Sequence
  Synthetic DNA Sequence
gcgaaatacacaacatcagggtcat

SEQ ID NO: 1480 - DNA, 474 bp, Proteus mirabilis
  strain J120
atgaaaatatctcttatggcagctgtttccgagaatggagtaattggctctggattggatataccttggcatgtacaaggcgagcagctcctattcaaagccatgacttacaatcaatggcttctagttggtcgtaaaaccttcgactcaatgggtaaacttccgaatagaaaatatgcagtggttactcgttctaaaattatctcgaatgaccctgatgttgtgtatttcgcaagtgttgaatcggcattagcttacctaaacaatgcgacagcacatatctttgtttctggtggtggtgaaatatataaagctttaatcgatcaagcagatgttatccatctttcagtgattcacaagcatatctctggcgatgtgttttttcctccagttccacagggcttcaagcaaacatttgagcaaagtttcagttcaaatattgattacacgtaccaaatttgggcaaagggctaa

SEQ ID NO: 1481 - DNA, 24 bp, Artificial Sequence
  Synthetic DNA Sequence
rttacagatcatktatatgtctct

SEQ ID NO: 1482 - DNA, 26 bp, Artificial Sequence
  Synthetic DNA Sequence
taatttatattagacawaaaaaactg

SEQ ID NO: 1483 - DNA, 23 bp, Artificial Sequence
  Synthetic DNA Sequence
carygtcagaaaatggcgtaatc

SEQ ID NO: 1484 - DNA, 26 bp, Artificial Sequence
  Synthetic DNA Sequence
tkcaaagcrwtttctattgaaggaaa

SEQ ID NO: 1485 - DNA, 23 bp, Artificial Sequence
  Synthetic DNA Sequence
aaaatggcgtaatcggtaatggc

SEQ ID NO: 1486 - DNA, 26 bp, Artificial Sequence
  Synthetic DNA Sequence
catttgagcttgaaattcctttcctc

SEQ ID NO: 1487 - DNA, 26 bp, Artificial Sequence
  Synthetic DNA Sequence
aatcgaaaatatgcagtagtgtcgag

SEQ ID NO: 1488 - DNA, 24 bp, Artificial Sequence
  Synthetic DNA Sequence
agactattgtagatttgaccgcca

SEQ ID NO: 1489 - DNA, 474 bp, Escherichia coli
  strain VA292
ttgaaaatttcattgatttctgcaacgtcagaaaatggcgtaatcggtaatggccctgatatcccatggtcagcaaaaggtgagcagttactctttaaagcgctcacatataatcagtggctccttgttggaaggaaaacatttgactctatgggtgttcttccaaatcgaaaatatgcagtagtgtcgaggaaaggaatttcaagctcaaatgaaaatgtattagtctttccttcaatagaaatcgctttgcaagaactatcgaaaattacagatcatttatatgtctctggtggcggtcaaatctacaatagtcttattgaaaaagcagatataattcatttgtctactgttcacgttgaggttgaaggtgatatcaattttcctaaaattccagagaatttcaatttggtttttgagcagttttttttgtctaatataaattacacatatcagatttggaaaaaaggctaa

SEQ ID NO: 1490 - DNA, 25 bp, Artificial Sequence
  Synthetic DNA Sequence
gacctatgagagcttgcccgtcaaa

SEQ ID NO: 1491 - DNA, 26 bp, Artificial Sequence
  Synthetic DNA Sequence
tcgccttcgtacagtcgcttaacaaa

SEQ ID NO: 1492 - DNA, 26 bp, Artificial Sequence
  Synthetic DNA Sequence
cattttagctgccaccgccaatggtt

SEQ ID NO: 1493 - DNA, 25 bp, Artificial Sequence
  Synthetic DNA Sequence
gcgtcgctgacgttgttcacgaaga

SEQ ID NO: 1494 - DNA, 510 bp, Escherichia coli
  strain BL26A
atgatcgagcttcatgccattttagctgccaccgccaatggttgcattgggaaggacaacgcacttccctggccaccactaaaaggcgatctggccagattcaaaaaattgaccatggggaaggtggtcattatggggcgcaagacctatgagagcttgcccgtcaaattagaaggtcgcacctgcatcgttatgacgcgccaagcgctggagcttccgggtgttcgtgacgctaacggcgctatcttcgtgaacaacgtcagcgacgccatgcggttcgctcaagaagagagcgtgggcgatgtggcctacgtcattggtggcgctgagatattcaagcgacttgccttgatgatcacgcagattgaattgacctttgttaagcgactgtacgaaggcgacacctacgttgatctggccgaaatggtcaaagactacgagcagaatggcatggaagaacatgaccttcacacttacttcacttaccgtaaaaaggagcttacagaatga

SEQ ID NO: 1495 - DNA, 24 bp, Artificial Sequence
  Synthetic DNA Sequence
tctctaaacatgattgtcgctgtc

SEQ ID NO: 1496 - DNA, 24 bp, Artificial Sequence
  Synthetic DNA Sequence
cagtgaggcaaaagtttttctacc

SEQ ID NO: 1497 - DNA, 25 bp, Artificial Sequence
  Synthetic DNA Sequence
cggacgacttcatgtggtagtcagt

SEQ ID NO: 1498 - DNA, 26 bp, Artificial Sequence
  Synthetic DNA Sequence
tttgttttcagtaatggtcgggacct

SEQ ID NO: 1499 - DNA, 534 bp, Escherichia coli
atggcttctctaaacatgattgtcgctgtcaataagacaggaggtatcggatttgaaaatcagattccgtggcatgaaccagaagatttaaaacacttcaaagctgttacaatgaactcagttttgattatgggtagaaaaacttttgcctcactgcctaaagtgctgcccggacgacttcatgtggtagtcagtaaaacagtaccacccacccagaacactgatcaagttgtgtatgtaagtacataccagatcgcagtaagaactgcaagcttgttggttgacaaaccagagtattctcaaatttttgtaattggtgggaagagtgcgtacgagaacttagctgcctacgtggacaaactctacttaactagagtacagctcaacacacaacaagacactgaactggatttatccctattcaagtcatggaaactcgtatctgaggtcccgaccattactgaaaacaaaacaaaacttattttccaaatttggattaaccctaaccctattagtgaggaacccacatgttag

SEQ ID NO: 1500 - DNA, 24 bp, Artificial Sequence
  Synthetic DNA Sequence
atcgggttattggcaatggtccta

SEQ ID NO: 1501 - DNA, 25 bp, Artificial Sequence
  Synthetic DNA Sequence
gcggtagttagcttggcgtgagatt

SEQ ID NO: 1502 - DNA, 22 bp, Artificial Sequence
  Synthetic DNA Sequence
gcgggcggagctgagatataca

SEQ ID NO: 1503 - DNA, 26 bp, Artificial Sequence
  Synthetic DNA Sequence
aacggagtgggtgtacggaattacag

SEQ ID NO: 1504 - DNA, 498 bp, Escherichia coli
  strain TKS84
atgaactcggaatcagtacgcatttatctcgttgctgcgatgggagccaatcgggttattggcaatggtcctaatatcccctggaaaattccgggtgagcagaagatttttcgcagactcactgagggaaaagtcgttgtcatggggcgaaagacctttgagtctatcggcaagcctctaccgaaccgtcacacattggtaatctcacgccaagctaactaccgcgccactggctgcgtagttgtttcaacgctgtcgcacgctatcgctttggcatccgaactcggcaatgaactctacgtcgcgggcggagctgagatatacactctggcactacctcacgcccacggcgtgtttctatctgaggtacatcaaaccttcgagggtgacgccttcttcccaatgctcaacgaaacagaattcgagcttgtctcaaccgaaaccattcaagctgtaattccgtacacccactccgtttatgcgcgtcgaaacggctaa

SEQ ID NO: 1505 - DNA, 24 bp, Artificial Sequence
  Synthetic DNA Sequence
atttttcgcaggctcaccgagagc

SEQ ID NO: 1506 - DNA, 27 bp, Artificial Sequence
  Synthetic DNA Sequence
cggatgagacaacctcgaattctgctg

SEQ ID NO: 1507 - DNA, 498 bp, Escherichia coli
  strain RA33.2
atgaacccggaatcggtccgcatttatctggtcgctgccatgggtgccaatcgggttattggcaatggtcccgatatcccctggaaaatcccaggtgagcagaagatttttcgcaggctcaccgagagcaaagtggtcgttatgggccgcaagacatttgagtccataggcaagcccttaccaaaccgccacacagtggtgctctcgcgccaagctggttatagcgctcctggttgtgcagttgtttcaacgctgtcacacgtatcgccatcgacagccgaacacggcaaagaactctacgtagcgcgcggagccgaggtatatgcgctggcgctaccgcatgccaacggcgtctttctatctgaggtacatcaaacctttgagggtgacgccttcttcccagtgcttaacgcagcagaattcgaggttgtctcatccgaaaccattcaaggcacaatcacgtacacgcactccgtctatgcgcgtcgtaacggctaa

SEQ ID NO: 1508 - DNA, 27 bp, Artificial Sequence
  Synthetic DNA Sequence
agaatgtattggtatttccatctatcg

SEQ ID NO: 1509 - DNA, 26 bp, Artificial Sequence
  Synthetic DNA Sequence
caatgtcgattgttgaaatatgtaaa

SEQ ID NO: 1510 - DNA, 22 bp, Artificial Sequence
  Synthetic DNA Sequence
tggagtgccaaaggggaacaat

SEQ ID NO: 1511 - DNA, 27 bp, Artificial Sequence
  Synthetic DNA Sequence
cagacacaatcacatgatccgttatcg

SEQ ID NO: 1512 - DNA, 474 bp, Escherichia coli
  strain UI14
gtgaaactatcactaatggcagcaatttcgaagaatggagttatcggaaatggcccagatattccatggagtgccaaaggggaacaattactcttcaaagcgattacctataatcagtggcttttggtaggccgaaagactttcgagtcaatgggggctttacccaaccgaaaatatgccgttgtaactcgttcaagcttcacttccagtgatgagaatgtattggtatttccatctatcgatgaagcgctaaatcatctgaagacgataacggatcatgtgattgtgtctggtggtggtgaaatatacaaaagcctgatcgataaagttgatactttacatatttcaacaatcgacattgagccagaaggtgatgtctattttccagaaatccccagtagttttaggccagtttttagccaagacttcgtgtctaacataaattatagttaccaaatctggcaaaagggttaa

SEQ ID NO: 1513 - DNA, 23 bp, Artificial Sequence
  Synthetic DNA Sequence
ttcaagctcaaatgaaaacgtcc

SEQ ID NO: 1514 - DNA, 25 bp, Artificial Sequence
  Synthetic DNA Sequence
gaaattctcaggcattatagggaat

SEQ ID NO: 1515 - DNA, 23 bp, Artificial Sequence
  Synthetic DNA Sequence
gtggtcagtaaaaggtgagcaac

SEQ ID NO: 1516 - DNA, 26 bp, Artificial Sequence
  Synthetic DNA Sequence
tctttcaaagcattttctattgaagg

SEQ ID NO: 1517 - DNA, 474 bp, Escherichia coli
  strain EC107
ttgaaaatatcattgatttctgcagtgtcagaaaatggcgtaatcggtagtggtcctgatatcccgtggtcagtaaaaggtgagcaactactctttaaagcgctcacatataatcaatggctccttgtcggaagaaaaacatttgactctatgggtgttcttccaaatcgcaaatatgcagtagtgtcaaagaacggaatttcaagctcaaatgaaaacgtcctagtttttccttcaatagaaaatgctttgaaagagctatcaaaagttacagatcatgtatatgtctctggcgggggtcaaatctataatagccttattgaaaaagcagatataattcatttgtctactgttcacgttgaagtcgaaggtgatatcaaattccctataatgcctgagaatttcaatttggtttttgaacagttttttatgtctaatataaattatacataccagatttggaaaaaaggctaa

SEQ ID NO: 1518 - DNA, 125 bp, Acinetobacter lwoffi
  strain CDCF 3697
ctatgtctcaaggccgtgcaacatactctatggaatttgctaaatatgctgaaactccacgtaacgtggctgaaggcatcatttctaaatttcagtctggcggtaaaaaaggtgacgacgagtaa

SEQ ID NO: 1519 - DNA, 93 bp, Acinetobacter lwoffii
  strain CDCF 3697
tctttcgattactataagcccaaactaattcatagttaaaaaccaagtgctcatgcagtgatcctgcatgagtagtttaaaaaggaagatctc

SEQ ID NO: 1520 - DNA, 1106 bp, Acinetobacter lwoffii
  strain CDCF 3697
atggctaaggctaagtttgaacgtaataagccacacgttaacgtgggcacaatcggtcacgttgaccatggtaaaacaactttaacagctgcaattgcaactgtatgtgcgaagaaattcggtggcgaagcgaaagactacgctgcaattgactctgcaccagaagaaaaagcacgtggtattacaattaatacttcacacgtagaatacgattctccaactcgtcactacgcacacgtagactgcccgggccacgccgattatgttaaaaacatgattactggtgctgctcagatggacggcgcgatccttgtatgtgctgcgactgatggtccaatgccacagactcgtgaacacatccttctttctcgtcaggttggtgtaccttacattcttgtattccttaacaagtgtgaccttgttgatgatgaagaacttcttgagctagtggaaatggaagttcgtgaacttctttctacttatgacttcccaggtgatgacactccagttatccgtggttcagctcttcttgcacttaacggtgacgctggtcagtatggcgaagaagcagttgttgcgcttgttgacgcacttgacacttacattccagagccagtacgtgcaatcgaccaagcattcttaatgccaatcgaagacgtattctctatttctggtcgtggtacagtagtaactggccgtgtagaaactggtattgtgaaagtaggcgaatcagttgaaatcgttggtatccgtgatactcaagtaactacagttactggcgtagaaatgttccgtaaattgcttgacgaaggtcgtgcgggcgagaactgtggtgttcttctacgtggtactaagcgtgaagacgtacaacgtggtcaagtacttgctaaaccaggtgcaatcaagccacacactaaattcgatgcagaagtatacgtactttctaaagaagaaggtggtcgtcacactccattccttaacggttaccgtccacagttctacttccgtacaactgacgtaactggcgcgatcaaattacaagatggcgttgaaatggttatgcctggtgacaacgtagaaatgtcagtagaattaatccacccaat

SEQ ID NO: 1521 - DNA, 100 bp, Haemophilus influenzae
  ref <308>: DATABASE ACCESSION NUMBER: ATCC 9006
acaaactcaaggtcgtgcatcttactcaatggaaccgttaaaatatgctgaagctccaacaagtgttgcggctgcagtaattgaagcgcgtaaaaaataa

SEQ ID NO: 1522 - DNA, 64 bp, Haemophilus influenzae
  ref <308>: DATABASE ACCESSION NUMBER: ATCC 9006
tttttgtaaaccagcggtgtaaaatatgattgttttataccgcacttcttaggaaacattagaa

SEQ ID NO: 1523 - DNA, 1098 bp, Haemophilus influenzae
  ref <308>: DATABASE ACCESSION NUMBER: ATCC 9006
atgtctaaagaaaaatttgaacgtacaaaaccgcacgtaaacgtgggtacaatcggccacgttgaccacggtaaaacaactttaacagcagcaattacaaccgtattagcaaaacactacggtggtgcagcgcgtgcatttgaccaaatcgataacgcgccagaagaaaaagcgcgtggtattaccatcaacacttcacatgttgaatacgatacaccaactcgccactatgcacacgtagactgtccaggacacgccgactatgttaaaaacatgattaccggtgcggcgcaaatggatggtgctattttagtagtagcagcaacagatggtcctatgccacaaactcgtgaacatatcttattaggtcgccaagtaggtgttccatacatcatcgtattcttaaacaaatgcgacatggtagatgatgaagagttattagaattagtagaaatggaagtgcgtgaacttctatctcaatatgacttcccaggtgacgatacaccaatcgtacgtggttcagcattacaagcattgaacggcgtagcagaatgggaagaaaaaatccttgaattagctggtcacttagatacttacatcccagaaccagaacgtgcgattgaccaaccgttccttcttccaattgaagacgtattctcaatttcaggtcgtggtacagtagtaactggtcgtgtagaacgtggtatcatccgtactggtgatgaagtagaaatcgtcggtatcaaagatacagcgaaaactactgtaacaggtgttgaaatgttccgtaaattacttgacgaaggtcgtgcaggtgaaaacatcggtgcattattacgtggtaccaaacgtgaagaaatcgaacgtggtcaagtattagcgaaaccaggttcaatcacaccacacactgattttgaatcagaagtatacgtattatcaaaagatgaaggtggtcgtcatactccattcttcaaaggttaccgtccacaattctatttccgtacaacagacgtaactggtacaattgaattaccagaaggcgtggaaatggtaatgccaggcgataacatcaagatgacagtaagcttaatccaccca

SEQ ID NO: 1524 - DNA, 77 bp, Proteus mirabilis
  ref <308>: DATABASE ACCESSION NUMBER: ATCC 25933
caatggagttcttgaagtacaacgaagcgcctagcaacgtcgctcaggctattatcgaagctcgtaaagcgaaataa

SEQ ID NO: 1525 - DNA, 67 bp, Proteus mirabilis
  ref <308>: DATABASE ACCESSION NUMBER: ATCC 25933
gatcctttcgagttcaatttagtttacgctccctctgtgagagggagcgatattaaggaatatagtc

SEQ ID NO: 1526 - DNA, 1112 bp, Proteus mirabilis
  ref <308>: DATABASE ACCESSION NUMBER: ATCC 25933
gtgtctaaagaaaaatttgaacgttcaaaaccgcacgttaacgttggtactatcggccacgttgaccacggtaaaacaactctgactgctgcaatcactacagttttagctaaaacttacggtggtgctgctcgtgcattcgaccaaatcgataatgcaccagaagaaaaagcgcgtggtatcaccatctctacttcacacgtagaatacgatactccaactcgccactacgcacacgtagactgcccaggtcacgccgactatgttaaaaacatgatcactggtgctgcgcaaatggacggcgctattctggtagtagcagcaactgatggtccaatgccacaaactcgtgagcacatcctgttaggtcgtcaggttggtgttccttacatcatcgtattcctgaacaaatgtgacatggtagatgatgaagagctgttagaattagttgaaatggaagttcgtgaacttctgtctcaatacgatttcccaggtgatgacactccagtaatccgtggttcagcgctgaaagcactggaaggcgaagcagagtgggaagcaaaaattgttgaattagcagaagcactggattcttatatcccagagccagagcgtgcaattgacaaaccattcctgttaccaatcgaagatgtattctcaatctcaggccgtggtacagtagttactggtcgtgtagagcgtggtatcatcaaagtaggtgatgaagttgagattgttggtatcaaagaaaccaccaaaacaacttgtactggcgttgaaatgttccgtaaattacttgacgaaggtcgtgcaggtgagaacgtaggtgttctgctgcgtggtacaaaacgtgaagaaatcgaacgtggacaagtactggcaaaaccaggctcaatcaacccacacaacaaatttgaatcagaagtttatattctgagcaaagatgaaggtggtcgtcacacaccattcttcaaaggctaccgtccacagttctacttccgtacaactgacgtaactggtactatcgaattaccagaaggcgtagaaatggtaatgccaggcgacaacgtgaacatgatcgttgaactgatccacccaatcgcaatggacga

SEQ ID NO: 1527 - DNA, 800 bp, Campylobacter curvus
  ref <308>: DATABASE ACCESSION NUMBER: ATCC 35224
atcaacgaagctatcgaggtttattttgaggttgagggcaagaaaaatagattgatcctggaggtcgcggctcacttgggtgataaccgcgtcagaacgatcgctatggatatgagtgaggggcttactcgcgggcttgaagctaccgctcttggtgcgcctattagtgtgccggttggcgagaaggttttgggaagaatttttaacgtcgtcggcgatctcatcgacgagggcgagggcgtaaattttgataaacattggtctatccaccgcgatccgccaccatttgaagaacaaagcacgaaaagtgaaatttttgaaaccggtataaaggttgtggatcttcttgcgccttacgcaaagggcggtaaggtcggactatttggcggtgcaggtgtcggtaaaacggtcatcatcatggagctcatccacaatgtcgccttcaaacacagcggatactctgtatttgcaggtgttggcgagaggacgcgcgaaggaaacgacctttatcacgagatgaaagaaagtaacgttttggataaagtcgccttgtgctacggacagatgaacgagccgccaggggcgagaaatcgtatcgcactgactggtctaacgatggctgagtatttccgcgatgagatgggacttgatgtgcttatgtttatcgacaacatcttccgcttctctcaatctggtgcagagatgtcggcactcctcggacgtatcccatcagccgttggttaccagccgacgctggcaagcgagatgggtaaatttcaagaaaggatcacatcgactaa

SEQ ID NO: 1528 - DNA, 26 bp, Artificial Sequence
  Synthetic DNA Sequence
aacttgagcgattttcggataccctg

SEQ ID NO: 1529 - DNA, 24 bp, Artificial Sequence
  Synthetic DNA Sequence
ttgccgatgaaataaccgccgact

SEQ ID NO: 1530 - DNA, 1035 bp, Escherichia coli
atgcgattggtttggaaatgtggggcgattcaggcatcccggttatctgaatggctcaactcaacagccggtgctcatgaacttgagcgattttcggataccctgaccttttctgtgtatggctcagtgctgatctggctgaaatcatatctccgcgaatcaggaagaaaactgcagttagtcggaatcgccttacccaacaccctgaacccaagggacgacctagcgcaattggccgaaattatccagctcatcgatcacctcatgaaaccgcacgttgatatgttgactcacttgttggcgtccattgatggccagtcggcggttatttcatcggcaaaatggggggagctagaaacggctcggcaggagaaagctatctcaggggtaaccagattgaagctccgcttggcgtcgcttgcccccgtcctgaaaaaacacgtcaacagcgatttgttccgaaaagcctctgatcgaatagagtcgatagagtatacgttggaaaccttgcgtataatgaaaactttcttcgatggtacctctcttgagggagatacttccgtacgtgactcgtatatggcgggcgtagtagatggaatggttcgagcgaatccggatgtgaagataattctgctggcgcacaacaatcatctacaaaaaactccagtctccttttcaggcgagcttacggctgttcccatggggcagcacctcgcagagagggtgaattaccgtgcgattgcattcacccatcttggacccaccgtgccggaaatgcatttcccatcgccaaaaagtcctcttggattctctgttgtgaccacgcctgccgatgcaatccgtgaggatagtatggaacagtatgtcatcgacgcctgtggtacggagaattcatgtctgacattgacagatgcccccatggaagcaaagcgaatgcggtctcaaagcgcctctgtagaaacgaaattgagcgaggcatttgatgccatcgtctgtgttacaagcgccggcaaggacagcctggttgccctatag

SEQ ID NO: 1531 - DNA, 25 bp, Artificial Sequence
  Synthetic DNA Sequence
tctttttgttacgacatacgctttt

SEQ ID NO: 1532 - DNA, 24 bp, Artificial Sequence
  Synthetic DNA Sequence
agtgcttctttatccgctgttcta

SEQ ID NO: 1533 - DNA, 26 bp, Artificial Sequence
  Synthetic DNA Sequence
cagcggataaagaagcactacacatt

SEQ ID NO: 1534 - DNA, 23 bp, Artificial Sequence
  Synthetic DNA Sequence
cctcctgaaataaagcccgacat

SEQ ID NO: 1535 - DNA, 1260 bp, Escherichia coli
  misc_feature (1)...(1260): n=a,t,c or g
atgaggttcgaagaatgggtcaaagataagcatattccttncaaacngaatcaccctgatgataattacgatgattttaagccattaagaaanataattggagatacccgagttgtagcattaggtgaaaattctcatttcataaaagaattctttttgttacgacatacgcttttgcgtttttttatcgaagatctaggttttactacgtttgcttttgaatttggttttgctgagggtcaaatcatcaataactggatacatggacaaggaactgacgatgaaataggcagattcttaaaacacttctattatccagaagagctcaaaaccacatttctatggctaagggagtacaataaagcagcaaaagaaaaaatcacatttcttggcattgatatacccagaaatggaggttcatacttaccaaatatggagatagtgcatgacttttttagaacagcggataaagaagcactacacattatcgatgatgcatttaatattgcaaaaaagattgattacttctccacatcacaggcagccttaaatttacatgagctaacagattctgagaaatgccgtttaactagccaattagctcgagtaaaagttcgccttgaagctatggctccaattcacattgaaaaatatgggattgataaatatgagacaattctgcattatgccaacggtatgatatacttggactataacattcaagctatgtcgggctttatttcaggaggcggaatgcagggcgatatgggtgcaaaagacaaatacatggcagattctgtgctgtggcatttaaaaaacccacaaagtgagcagaaagtgatagtagtagcacataatgcacatattcaaaaaacacccattctgtatgatggatttctaagttgcctaccaatgggccaaagacttaaaaatgccattggtgatgattatatgtctttaggtattacttcttatagtgggcatactgcagccctctatccggaagttgatacaaaatatggttttcgagttgataacttccaactgcaggaaccaaatgaaggttctgtcgagaaagctatttctggttgtggagttactaattcttttgtcttttttagaaatattcctgaagatttacaatccatcccgaacatgattcgatttgantctatttacatgaaagcagaactcgagaaagctttcgatggaatatttcaaattgaaaagtcatctgtatctgaggtcgtttatgaataa

SEQ ID NO: 1536 - DNA, 25 bp, Artificial Sequence
  Synthetic DNA Sequence
agatgtattaactggaaaacaacaa

SEQ ID NO: 1537 - DNA, 25 bp, Artificial Sequence
  Synthetic DNA Sequence
ctttgtaattagtttctgaaaacca

SEQ ID NO: 1538 - DNA, 28 bp, Artificial Sequence
  Synthetic DNA Sequence
ttagaagatataggatacaaaatagaag

SEQ ID NO: 1539 - DNA, 22 bp, Artificial Sequence
  Synthetic DNA Sequence
gaatgaaaaagaagttgagctt

SEQ ID NO: 1540 - DNA, 486 bp, Staphylococcus haemolyticus
atgaaaaataataatgtaacagaaaaagaattattttatattttagatttatttgaacacatgaaagtaacttattggttagatggtggctggggggtagatgtattaactggaaaacaacaaagagaacacagagatatagatatagattttgacgctcaacacactcaaaaagttatacaaaaattagaagatataggatacaaaatagaagttcattggatgccttcacgtatggaacttaagcatgaagaatatgggtatttagatattcatcctataaatctaaatgatgatggatcaattacccaagcaaacccagaaggtggtaattatgttttccaaaatgactggttttcagaaactaattacaaagatcgaaaaataccatgtatttcaaaagaagctcaacttctttttcattctggttatgatttaacagaaacagaccattttgatataaaaaatttaaaatcaataacataa

SEQ ID NO: 1541 - DNA, 25 bp, Artificial Sequence
  Synthetic DNA Sequence
tgataatcttatacgtggggaattt

SEQ ID NO: 1542 - DNA, 26 bp, Artificial Sequence
  Synthetic DNA Sequence
ataattttctaattgccctgtttcat

SEQ ID NO: 1543 - DNA, 26 bp, Artificial Sequence
  Synthetic DNA Sequence
gggcaattagaaaattatttatcaga

SEQ ID NO: 1544 - DNA, 26 bp, Artificial Sequence
  Synthetic DNA Sequence
ttttactcatgtttagccaattatca

SEQ ID NO: 1545 - DNA, 804 bp, Enterococcus faecium
atgttaaaacaaaaagaattaattgcaaacgttaagaatcttactgagtcagatgaacgaattacagcttgtatgatgtatggatcgtttaccaaaggagaaggtgaccaatactctgatatagagttctatatatttttgaaacatagtataacctcgaactttgattcatccaactggttgtttgacgtagctccgtacttgatgctttataaaaatgagtacggaacagaggtagttatttttgataatcttatacgtggggaatttcatttcctttctgaaaaagatatgaacataatcccctcgtttaaagattcaggttatattcctgatacgaaggctatgcttatttacgatgaaacagggcaattagaaaattatttatcagagataagtggtgcaagaccaaatagacttactgaagaaaatgctaattttttgttgtgtaatttctctaatctatggttgatgggaatcaacgttctaaaaagaggagaatatgctcgttcattagaactcttatcacaacttcaaaaaaatacactacaacttatacgtatggcagaaaaaaatgctgataattggctaaacatgagtaaaaaccttgaaaaagaaattagccttgaaaattataaaaaatttgcaaagaccactgctcgattagataaggtagaattatttgaagcctataaaaattctttgctattagttatggatttgcaaagtcaccttattgaacaatacaacttaaaagttacacatgacattttagaaagattgttgaattacattagtgaatag

SEQ ID NO: 1546 - DNA, 22 bp, Artificial Sequence
  Synthetic DNA Sequence
caagaaggaatggctgtactac

SEQ ID NO: 1547 - DNA, 27 bp, Artificial Sequence
  Synthetic DNA Sequence
taattcccaaataaccctaataataga

SEQ ID NO: 1548 - DNA, 1218 bp, Streptococcus pyogenes
atggaaaaatacaacaattggaaacttaagttttatacaatatgggcagggcaagcagtatcattaatcactagtgccatcttgcaaatggcgattattttttaccttacagaaaaaactggatccgcgatggtcttgtctatggcttcactattaggttttttaccctatgcggtctttggacctgcaattggtgtgctagtggatcgtcatgataggaagaagataatgattggtgctgatttaattatcgcagcagctggttcggtgcttactattgttgcattctatatggagctacctgtctggatggttatgatagtattgtttatccgtagcattggaacagcttttcacaccccggctctcaatgcggttacgccacttttagtaccagaagaacagcttacgaaatgtgcaggctatagtcagtctttgcagtctataagctatattgttagtccggcggttgcagcactcttatactccgtttgggaactaaatgctattattgccatcgatgtattgggtgctgtgattgcatctattacggtagcaattgtacgtattcctaagctgggtgatcgcgtgcaaagtttggacccaaatttcataagagaaatgcaagaaggaatggctgtactacggcaaaataaaggattatttgctttattactcgttggaacattatatatgtttgtttatatgccaattaatgcactattccctttaattagcatggattactttaatggaacacctgtgcatatttctattacggaaatttcctttgcatctggaatgttgatagggggtctattattagggttatttgggaattaccaaaagcgaatcttattaataacggcatccatttttatgatggggataagcttaaccatttcaggattacttccccaaagtggatttttcatttttgtagtctgctgtgcaataatggggctttctgttccgttttacagcggtgtgcaaacagctctttttcaggagaaaattaagcctgaatatttaggacgtgtattttctttaactggaagtatcatgtctcttgctatgccaattggattaattctttctgcactctttgctgatagaatcggtgtaaatcattggtttttactatcaggtactttaattatttgcattgcaatagtttgcccaatgataaatgagattagaaaattagatttaaaataa

SEQ ID NO: 1549 - DNA, 26 bp, Artificial Sequence
  Synthetic DNA Sequence
gcttattattaggaagattagggggc

SEQ ID NO: 1550 - DNA, 24 bp, Artificial Sequence
  Synthetic DNA Sequence
tagcaagtgacatgatacttccga

SEQ ID NO: 1551 - DNA, 1218 bp, Streptococcus pneumoniae
atggaaaaatacaacaattggaaacgaaaattttatgcaatatgggcagggcaagcagtatcattaatcactagtgccatcctgcaaatggcgattattttttaccttacagaaaaaacaggatctgcgatggtcttgtctatggcttcattagtaggttttttaccctatgcgattttgggacctgccattggtgtgctagtggatcgtcatgataggaagaagataatgattggtgccgatttaattatcgcagcagctggtgcagtgcttgctattgttgcattctgtatggagctacctgtctggatgattatgatagtattgtttatccgtagcattggaacagcttttcataccccagcactcaatgcggttacaccacttttagtaccagaagaacagctaacgaaatgcgcaggctatagtcagtctttgcagtctataagctatattgttagtccggcagttgcagcactcttatactccgtttgggatttaaatgctattattgccatcgacgtattgggtgctgtgattgcatctattacggtagcaattgtacgtatacctaagctgggtaatcaagtgcaaagtttagaaccaaatttcataagggagatgaaagaaggagttgtggttctgagacaaaacaaaggattgtttgccttattactcttaggaacactatatacttttgtttatatgccaatcaatgcactatttcctttaataagcatggaacactttaatggaacgcctgtgcatatttctattacggaaatttcctttgcatttgggatgctagcaggaggcttattattaggaagattagggggcttcgaaaagcatgtattactaataacaagttcattttttataatggggaccagtttagccgtttcgggaatacttcctccaaatggatttgtaatattcgtagtttgctgtgcaataatggggctttcggtgccattttatagcggtgtgcaaacagctctttttcaggagaaaattaagcctgaatatttaggacgtgtattttctttgatcggaagtatcatgtcacttgctatgccaattgggttaattctttctggattctttgctgataaaatcggtgtaaatcattggtttttactatcaggtattttaattattggcattgctatagtttgccaaatgataactgaggttagaaaattagatttaaaataa

SEQ ID NO: 1552 - DNA, 24 bp, Artificial Sequence
  Synthetic DNA Sequence
ggcaagcagtatcattaatcacta

SEQ ID NO: 1553 - DNA, 26 bp, Artificial Sequence
  Synthetic DNA Sequence
caatgctacggataaacaatactatc

SEQ ID NO: 1554 - DNA, 27 bp, Artificial Sequence
  Synthetic DNA Sequence
agaaaattaagcctgaatatttaggac

SEQ ID NO: 1555 - DNA, 25 bp, Artificial Sequence
  Synthetic DNA Sequence
tagtaaaaaccaatgatttacaccg

SEQ ID NO: 1556 - DNA, 25 bp, Artificial Sequence
  Synthetic DNA Sequence
actgtacgcacttgcagcccgacat

SEQ ID NO: 1557 - DNA, 24 bp, Artificial Sequence
  Synthetic DNA Sequence
gaacggcaggcgattcttgagcat

SEQ ID NO: 1558 - DNA, 22 bp, Artificial Sequence
  Synthetic DNA Sequence
gtggtggtgcatggcgatctct

SEQ ID NO: 1559 - DNA, 24 bp, Artificial Sequence
  Synthetic DNA Sequence
gccgcagcgaggtactcttcgtta

SEQ ID NO: 1560 - DNA, 906 bp, Escherichia coli
atgaccgtagtcacgaccgccgatacctcccaactgtacgcacttgcagcccgacatgggctcaagctccatggcccgctgactgtcaatgagcttgggctcgactataggatcgtgatcgccaccgtcgacgatggacgtcggtgggtgctgcgcatcccgcgccgagccgaggtaagcgcgaaggtcgaaccagaggcgcgggtgctggcaatgctcaagaatcgcctgccgttcgcggtgccggactggcgcgtggccaacgccgagctcgttgcctatcccatgctcgaagactcgactgcgatggtcatccagcctggttcgtccacgcccgactgggtcgtgccgcaggactcggaggtcttcgcggagagcttcgcgaccgcgctcgccgccctgcatgccgtccccatttccgccgccgtggatgcggggatgctcatccgtacaccgacgcaggcccgtcagaaggtggccgacgacgttgaccgcgtccgacgcgagttcgtggtgaacgacaagcgcctccaccggtggcagcgctggctcgacgacgattcgtcgtggccagatttctccgtggtggtgcatggcgatctctacgtgggccatgtgctcatcgacaacacggagcgcgtcagcgggatgatcgactggagcgaggcccgcgttgatgaccctgccatcgacatggccgcgcaccttatggtctttggtgaagaggggctcgcgaagctcctcctcacgtatgaagcggccggtggccgggtgtggccgcggctcgcccaccacatcgcggagcgccttgcgttcggggcggtcacctacgcactcttcgccctcgactcgggtaacgaagagtacctcgctgcggcgaaggcgcagctcgccgcagcggaatga

SEQ ID NO: 1561 - DNA, 1048 bp, Candida albicans
  ref <308>: DATABASE ACCESSION NUMBER: ATCC 18804
gatcatggtaaaactacattgactgctgctatcaccaaagttttagccgaacaaggtggtgccaacttcttggattayggttctattgatagagctccagaagaaagagctagaggtatcactatttccactgcccacgttgaatacgaaaccaagaacagacactatgcccacgttgattgtccaggacacgctgattatatcaaaaatatgattactggtgccgctcaaatggatggtgctatcattgttgttgctgccactgatggtcaaatgcctcaaaccagagaacatttgttattggccagacaagttggtgttcaagacttggttgtgtttgtcaacaaagtcgatactattgatgaccctgaaatgttggaattagtcgaaatggaaatgagagaattgttatccacctacggttttgatggtgacaacactccagttattatgggatctgctttaatggctttggaagacaagaaaccagaaattggtaaggaagctatcttgaaattgttagatgctgtcgatgaacacattccaactccatcaagagacttggaacaaccatttttgttaccagttgaagacgtgttctccatctccggtagaggaactgttgtcactggtagagttgaaagaggtgttttgaagaagggtgaagaaatcgaaattgttggtggttttgacaaaccttacaagactactgttaccggtattgaaatgttcaaaaaagaattagactctgctatggctggtgacaactgtggtgttttgttaagaggtgttaaaagagatgaaatcaagagaggtatggttttggccaaaccaggtactgccacttctcacaagaagttcttggcttccttgtatattttgacttccgaagaaggtggycgttccactccatttggtgaaggttacaagcctcaatgcttcttcagaactaacgatgtcactaccacattttcattcccagaaggagaaggtgttgaccattctcaaatgatcatgccaggtgacaacattgaaatggttggtgaat

SEQ ID NO: 1562 - DNA, 1074 bp, Candida dubliniensis
  strain NCPF 3949
tgatcacggtaaaaccacattaactgctgccattaccaaagtattagctgaacaaggtggtgccaactttttggattacggttccattgatagagctccagaagaaagagccagaggtatcactatttccactgcccacgttgaatacgaaaccaagaacagacactatgcccacgttgattgtccaggacacgctgattatatcaaaaacatgattactggtgctgctcaaatggatggtgctatcattgttgttgctgctactgacggtcaaatgccacaaaccagagaacatttattgttggcaagacaagttggtgttcaagacttggttgtctttgtcaacaaagttgatactattgatgaccctgagatgttggaattagtcgaaatggaaatgagagaattgttgtccacctacggttttgatggtgacaacactcctgttattatgggatctgctttaatggccttggaaggcaaaaaaccagaaattggtaaggaagctattttgagattgttagatgctgtcgatgaacacattccaactccatcaagagacttggaacaaccatttttgttgccagttgaagacgtgttctccatctctggtagaggaactgttgtcaccggtagagttgaaagaggtgtcttgaagaagggtgaagaaatcgaaattgttggtggttttgacaaaccatacaagaccactgttactggtattgaaatgttcaaaaaggaattagattctgctatagctggtgacaactgtggtgttttgttgagaggtgttaaaagagatgaaatcaagagaggtatggttttggccaagccaggtactgctacttctcacaagaaatttttagcatctttgtatattttgacttcagaagaaggtggtcgttccactccatttggagaaggttacaagcctcaatgtttcttcagaactaatgacgtcactaccacattttcattcccagaaggagaaggtgttgaccactcccaaatggtcatgccaggtgataacattgaaatggttggtgaattgatcaaatcatgtccattggaagt

SEQ ID NO: 1563 - DNA, 1033 bp, Candida famata
  ref <308>: DATABASE ACCESSION NUMBER: ATCC 62894
gatcacgggaagactactttgaccgctgccatcaccaaagttttagccgaaaaaggtggtgctaacttcttggactacggttctatcgataaagctccagaagaaagagccagaggtattactatttctgctgcccatgttgaatacgaaactgacaagagacactatgcccatgttgattgtccaggtcacgcagattatatcaagaatatgattactggtgctgctcaaatggatggtgccattattgttgttgctgcttccgatggtcaaatgcctcaaaccagagaacatttgttattggccagacaagttggtgttcaacacttggttgttttcgtcaacaaggtcgacaccattgacgatccagaaatgttggaattggttgaaatggaaatgagagatttgttaactacttacggttttgatggtgataacaccccagttatcatgggatctgctttgtgtgctttggaatccagagaaccagaaattggtcaaaaagccattgaaaaattgttagatgccgtcgatgaatacattccaaccccagtcagagacttggaacaaccattcttgatgccagttgaagaagttttctccatttccggtagaggtaccgttgttgctggtagagtcgaaagaggtaccttgaagaagggtgaagaaatcgaaattgttggtggtttcgacaagccattcaaggccactgttactggtattgaaatgttcaagaaggaattggactccgctcttgctggtgacaactgtggtatcttgttgagaggtgtcaagagagacgaagttaagagaggtatggtcttgaccaagccaaacaccgtcacttcccacaagaagatcttggcctcgttgtatatcttgaccaaggaagaaggtggtagacactctccatttggagccaactacaagccccaattgttcatgagaaccaccgatgttaccggtaccatgaccttcccagaaggtgccgaccaatctgccatggtcatgccaggtgacaacgttgaaatgc

SEQ ID NO: 1564 - DNA, 1056 bp, Candida glabrata
  ref <308>: DATABASE ACCESSION NUMBER: ATCC 66032
gatcacggtaagactacattgacagctgctatcaccaagacattggccaagaacggtggtgctgatttcttggactactcttccattgacaaagctccagaggagagagcccgtggtatcactatctctactgcccatgtcgagtacgagaccgccaagagacattactcccacgtcgactgtccaggtcacgccgactacatcaagaacatgattactggtgctgcccaaatggacggtgctatcatcgttgtcgccgccaccgatggtcaaatgccacaaactagagagcatttgctgttggccagacaagtcggtgttcaacgtatcgttgtctttgtcaacaaggtggacaccatcgatgaccctgaaatgttggaattagtggaaatggaaatgagagaattgttgaacgaatacggttttgacggtgacaatgcccctatcattatgggttccgctttgtgtgccctagaaggtcgtcaacctgaaattggtgagcaagctatcatgaaactattggacgctgttgatgaatacattccaaccccagaaagagacttgaacaagccattcttgatgcctgttgaagacatcttctccatctctggtagaggtaccgtcgtcactggacgtgtcgaaagaggtaacttgaagaagggtgaagaagttgaaattgttggtcacaacactaccccattgaagaccaccgttactggtatcgaaatgttcagaaaggaattggaccaagctatggctggtgacaacgccggtatcctattgagaggtatcagaagagaccaattgaagagaggtatggtcatggccaagccaggtaccgtcaaggctcacaccaagattttggcttctttgtacatcttgtctaaggaagaaggtggtagacattctggtttcggtgaaaactacagacctcagatgtttatcagaaccgcagatgtcactgttgtgatgaagttcccagaatctgtggaagaccactctatgcaagttatgccaggtgacaacgtcgaaatggtctgtgaactagtccaccca

SEQ ID NO: 1565 - DNA, 1061 bp, Candida guilliermondii
  ref <308>: DATABASE ACCESSION NUMBER: ATCC 6260
gatcatggtaagaccactttgaccgctgctatcaccaaggttttgtcggaaaaaggaggtgctaatttcttggattacggctccatcgacagagctccagaagagagagccagaggtatcaccatttccactgcccatgttgagtaccaaactgataagagacattatgcccacgttgactgtccaggtcacgccgattacattaagaatatgattactggtgccgcccagatggacggtgccattattgttgttgctgccactgacggtcaaatgcctcagaccagagagcacttgttgttggccagacaagttggtgtgcaacacttggtagtttttgtgaacaaggtggacaccattgacgatcccgagatgttggaattggtcgagatggaaatgagagaattgttgagtcagtacggtttcgatggtgacaacaccccagttatcatgggatctgctttgtgtgctttggaaagtaagcagccagaaattggtgtgcaagccattgaaaaattgttggacgctgtcgatgagcacattcctactcctacccgtgacttggaacagccattcttgttgcctgttgaagatgtgttctccatttctggtagaggaactgtggttactggtagagtcgaaagaggttcgttgaagaagggtgaggaaatcgagattgttggtgactttgacaagccattcaagaccactgtgactggaattgaaatgttcaagaaggaattggatgctgctatggctggtgacaatgctggtatcttgttgagaggtgtcaagagagacgatgtcaagagaggtatggttttggccaagccttccaccgtcacttctcacaagaaggtgttggcttccttgtacatcttgagtaaggaagaaggtggccgtcactctccttttggtgagaactacaagcctcaattgttcatcagaactactgacgttaccggtactttaagattcccagccggcgagggtgtcgaccactcgcaaatggttatgccaggtgacaatgttgagatggaaattgagcttgtgagaaagac

SEQ ID NO: 1566 - DNA, 1073 bp, Candida haemulonii
  ref <308>: DATABASE ACCESSION NUMBER: ATCC 22991
gatcacggtaagactaccttgactgctgctatcaccaaggttttggcttctaagggtggtgctagcttcttggactatggttccattgacagagccccagaggagagagctagaggtattactatttctactgcccacgttgagtaccaaaccgaaaagagacactacgcccacgtcgactgtccaggtcacgctgattacattaagaatatgattactggtgccgcccagatggacggtgctatcattgttgttgctgcttctgatggtcagatgcctcagaccagagagcaccttttgttggccagacaggttggtgttcagaacttggttgttttcgttaacaaggttgacaccattgacgaccctgaaatgttggaattggttgagatggaaatgagagaattgttgactacttacggttttgacggtgatgagactcctgttatcatgggttctgctttgtgcgctttggaagagaagcaaccagagattggtgagcaggctatcatgaagttgttggacgctgtcgatgagtacattccaaccccacagcgtgacttggagcagccattcttgatgcctgttgaggatgttttctccatttctggtagaggtactgtcgttactggtagagttgagagaggttctttgaagaagggtgaggaaatcgagattgtcggtgacttcgccaagactttcaaggctaccgttactggtattgagatgttcaagaaggaattggatgctgctatggctggtgacaacgccggtatcttgttgagaggtgtcaagagagatgagatctcccgtggtgatgtcttggccaagccaggtactgttactccacacaagaagatcttggcttctttgtacgttttgaccaaggaagaaggtggtcgtcacaacccattcgctgagaactacaagccacagttgttcctcagaaccaccaacgtcactggtaccatgagattcccagaaggtgaagatgttgaccactctgccatggttaacccaggtgacaacgttgagatggaaatcgagttgggtagaaaggccccacttgagtt

SEQ ID NO: 1567 - DNA, 1062 bp, Candida kefyr
  ref <308>: DATABASE ACCESSION NUMBER: ATCC 28838
catggtaagaccactttgactgctgccatcaccaagactctagctgaacgtggtggtgctgactttttggactactcttctattgacaaggctccagaagaaagagcyagaggtatcactatttctactgctcatgttgaatacgagactgaaaagagacattactcccacgttgactgtccaggtcacgctgattacatcaagaacatgattactggtgctgctcaaatggacggtgctattattgttgttgctgctactgatggtcaaatgcctcaaaccagagagcatttgttgttggccagacaagttggtgtccaacacattgttgttttcgttaacaaggttgacaccatcgatgatccagaaatgttggaattggttgaaatggaaatgagagaattrttgactcaatatggctttgacggtgacaacactccagtgatcatgggttctgctttgtgtgccttggaaggtaagcaaccagaaattggtgagcaagccatcatgaagttgttggacgctgttgacgaatacatcccaaccccagcccgtgacttggaaaavccattcttgatgcctgttgaagatatcttctccatttccggtagaggtactgtcgtcactggtagagttgaacgtggtaacttgaagaagggtgaagaaatcgaaattgttggtcacaacaccactcctttcaagactactgttactggtattgaaatgttcagaaaggaattggaccaagccatggctggtgacaacgctggtgtccttttgagaggtgtcagaagagaccaattgaagagaggtatggttttggctaagccaggtactgttaaggcccacaccaagttcttggcttccttgtacattttgaccaaggaagaaggtggtagacactccggtttcggtgaaaactacagaccacaaatctacgtcagaactgctgacgttaccgtdgtcttgaagttcccagaatctgttgaagaccattccatgcaagtcatgccaggtgacaatgtcgaaatggagtgtgaattggttcacccaactccattg

SEQ ID NO: 1568 - DNA, 1062 bp, Candida lusitaniae
  ref <308>: DATABASE ACCESSION NUMBER: ATCC 66035
cggaaagaccaccttgaccgccgccattaccaaggttttggctgacaagggtggcgccaacttcttggactacggtgccattgacaaggctcctgaagaaagagcacgtggtatcaccatttccactgcccacgttgaatacgagaccgacaacagacactacgcccacgttgactgtccaggtcacgccgattacatcaagaacatgatcacgggtgccgctcaaatggacggtgccattattgttgttgcagccaccgacggccaaatgcctcaaaccagagagcacttgttgttggccagacaagttggtgtgcaacacttggttgttttcgtgaacaaggttgataccatcgacgacccagaaatgttggaattggttgaaatggaaatgagagaattgttgactcaatacggatttgacggcgatgaaacccctgttgttatgggctctgctctttgcgctttggaaggtagagaaccagagattggtgagcaagccatcaccaagttgttggaggctgttgacgagtacatcccaaccccacaacgtgacttggaacaaccattcttgatgcctgttgaagatgttttctccatttctggtagaggtactgttgtcactggtagagtggagagaggttccttgaagaagggtgaggagatcgagattgttggtgactttgacaagcctttcaagactactgttactggtattgagatgttcaagaaggaattggacgctgctatggctggtgacaatgctggtatcttgttgagaggtgtcaagagagaacaagtttcccgtggtatggttttggccaagccaggcactgtgacctcgcacaagaaggttttggcttctttgtacattttgtctaaggaagaaggtggtcgtcactctccatttggcgagaactacaagcctcaattgttccttagaactaccgatgtcactggtactttgagattcccagcaggtgaggacgttgaccactccgctatggtttctccaggtgacaatgtcgagatggaaatcgagttggtcagaaagactcctct

SEQ ID NO: 1569 - DNA, 990 bp, Candida sphaerica
  ref <308>: DATABASE ACCESSION NUMBER: ATCC 2504
tcaccaagactttggctgaacgtggtggtgctgatttcttggactactcttccattgacaaggctccagaagaaagagcragaggtatcactatttctactgcacatgttgaatatgaaactgacaagagacattactctcacgtcgactgtccaggtcatgctgattacatcaagaatatgattactggtgctgcccaaatggatggtgctatcattgttgttgctgctacagatggtcaaatgcctcaaaccagagaacatttgttgttggctagacaagttggtgttcaacayatcgttgttttcgttaacaaggttgacactatcgatgaccctgaaatgttagaattggttgaaatggaaatgagagaattattgacccaatacggtttcgatggtgacaacactccagtcatcatgggttctgctttgtgtgctttagaaggtaagcaaccagaaattggtgaacaagcaatcatgaagttattggacgctgttgacgaatacatcccaactccagctcgtgatttggaaaagcctttcttgatgcctgttgaagatatcttctccatctccggtagaggtaccgtcgtaactggtagagttgaacgtggtaacttgaakaagggtraagaaatcgaaatcgttggtcacaacaccactccattcaagaccactgttactggtattgaaatgttcagaaaggaattggaccaagctatggctggtgataacgctggtgtcwtgttgagaggtgtcagaagagaccaattaaagagaggtatggtcttggccaagccaggtactgtcaaggctcacaccraattcttggcctctttgtatatcttgaccaaggaagaaggtggtagacattccggtttcggtgaaaattacagacctcaaatctacgttagaactgctgatgtcaccgttgttttgaagttcccagaagctgttgaagatcactctatgcaagtcatgccaggtg

SEQ ID NO: 1570 - DNA, 1184 bp, Candida tropicalis
  ref <308>: DATABASE ACCESSION NUMBER: ATCC 750
gatcatggtaaaaccactttgactgctgccattactaaagtcttggctgataaaggtcaagctaacttcttagattacggttctattgatagagctccagaagaaagagccagaggtatcaccatctctactgcccacgttgaatatgaaaccgaaaaaagacattacgcccatgttgagtatgtatacttttttttgttgtgtaattgttttaaagattttctttaaagctgaagaagtcaaatcagttctttgataacttctattaaaaaaagggaaaaattaacaagatatactaacactataacagttgtcctggacatcaagattatatcaagaatatgattaccggtgccgctcaaatggatggtgctattattgttgttgctgccactgatggtcaaatgccacaaaccagagaacatttgttgttggctagacaagtcggtgttcaagatttggttgtctttgttaacaaagtcgacactattgatgacccagaaatgttggaattggttgaaatggaaatgagagaattattgactacttacggttttgatggtgataacactcctgttatcatgggttctgctttgatggccttgcaaggtaaacaaccagaaattggtgaacaagctatcatgaaattgatggacgctattgatgaacacattccaaccccaaccagagacttggaacaatctttcttgatgccagttgaagatgttttctccatttctggtagaggtactgttgttactggtagagtcgaaagaggtgtcttaaagaagggtgaagaaattgaaattgttggtggtttcgaaaaaccattcaagaccactgttactggtattgaaatgttcaagaaagaattagatgctgctatggctggtgacaactgtggtgtcttgttgagaggtgtcaagagagacgaaatcaagagaggtatggttttggctaaaccaggtactgctacttcccacaagaaattcttggcttccatgtatatcttaactgctgaagaaggtggtcgttccactccattcggtgaaggttacaagccacaatgtttcttcagaactaacgatgttaccacttccttctctttcccagaaggtgaaggtgttgaccactcccaaatggttatgccaggtgacaacattgaaatggtcggtgaattgatt

SEQ ID NO: 1571 - DNA, 1071 bp, Candida viswanathii
  ref <308>: DATABASE ACCESSION NUMBER: ATCC 28269
cgatcacggtaagaccaccttgaccgccgccatcaccaaggtcttggccgacaagggtcaggctaacttcttggactacggatccattgacagagcccctgaagaaagagcaagaggtatcactatctccactgcccacgttgaatacgagactgataagagacactatgcccacgttgattgcccgggccatcaagattatatcaagaatatgatcactggtgctgcccaaatggacggtgctatcattgttgttgctgctactgacggtcagatgccacaaaccagagaacacttgttgttggctagacaagttggtgtccaagacttggttgttttcgttaacaaggttgacactatcgatgacccagaaatgttggaattggttgaaatggaaatgagagaattattatcttcttayggctttgacggtgacaacaccccagttgtcatgggttccgctttgatggctttgcaaggtaagcaaccagaaattggtgaacaagctattattaagttgatggacgctattgatgaacacatyccaaccccaaccagagacttggaacaaccattcttgttgccagttgaagatgtcttttctatttccggtagaggtaccgtcgtcactggtagagtcgaaagaggtgtcttgaagaagggtgaagaaattgaaattgtcggtaactttgaaaagccattcaagaccaccgttactggtattgaaatgttcaagaaggaattggatgctgctatggctggtgacaactgtggtgtcttgttgagaggtgtcaagagagacgaaatcagcagaggtatggttttggccaagccaggtaccgtcacttcccacaagaagttcttggcctccatgtacatcttgactggtgaagaaggtggtcgtcgtaccccattcggtgaaggttacaagccacaatgtttcttcagaaccaatgacatcaccaccactttcactttcccagaaggtgaaggtgtcgaccactcccaaatggttatgccaggtgacaacatcgaaatggttggtgaattgtacaaggcttgtccttggaa

SEQ ID NO: 1572 - DNA, 817 bp, Alcaligenes faecalis subsp. faecalis
  ref <308>: DATABASE ACCESSION NUMBER: ATCC 8750
tatcttggttwgctcggccgctgacggcccaatgcctcagactcgcgagcacatcctgctgagccgtcaggttggcgttccttacatcatcgtgttcctgaacaaggccgacatggttgatgacgaagagctgatcgaactggttgaaatggaagttcgcgagctgttgtccaagtacgacttccctggcgacgacaccccgatcatcaagggttcggccaaactggctctggaaggcgacgaaggcccactgggcagccaagccgttctggctctggccgaagcgctggacaactacattcctacgcctgagcgtgccgttgacggtacgttcctgatgcctgttgaagacgtgttctcgatctccggccgtggtacggttgtgaccggtcgtattgagcgcggcatcatcaaggtcggcgaagaaatcgaaatcgtgggtatcaaagacacggtcaagaccatttgtaccggcgttgaaatgttccgcaaactgctggaccagggcgaagctggcgataacgtcggtctgctgctgcgtggtaccaagcgtgaagacgtggaacgtggtcaagttctggccaagccaggctcgatcaagccacacactgacttcgacgccgaggtgtacattctgtccaaagaagaaggtggtcgtcacactcctttcttcaagggctaccgtcctcagttctacttccgtacaactgacgtgaccggcaccatcgagctgccagaagacaaggaaatggttctgccaggcgacaacatttcgatgaaagtgtccctgatcgctcctatcgccatggaagaaggt

SEQ ID NO: 1573 - DNA, 796 bp, Prevotella buccalis
  ref <308>: DATABASE ACCESSION NUMBER: ATCC 35310
tatccttgtagttgctgctactgatggtcctatgccacagacacgtgagcacgtgcttttggctcgtcaggtaaacgttcctcgtttggttgtgttcatgaacaagtgtgacttggtagaagacgaagagatgcttgaactcgttgaaatggagttgcgcgaacttcttgagcaatacgaattcgaagaggatactccaatcgttcgtggttctgcactgggtgcattgaatggtgttgacaagtgggttgacagcgtgatgacgttgatggacactgttgacgagtggattcaagagccagagcgtgaccttgacaaacctttcttgatgccagtagaggacgtgttctctatcacaggtcgtggtaccgttgtaacaggacgtattgagactggtaaggtaaaggttggcgacgagattcagttgctcggtcttggtgaggacaagaagtctgttgtaacaggcgttgaaatgttccgtaagattctttctgaaggtgaagcaggtgataacgtaggacttttgctccgcggtatcgataaggatgaagtaaagcgtggtatggttgttgtacacccaggtgccatcactcctcacgatcacttcaaggcttccatctatgtattgaagaaggaagagggtggacgtcatactccattcggaaacaagtatcgtcctcagttctatctccgtacaatggactgtacaggtgagatcactttgccagaaggcgtagagatggtgatgcctggtgacaacgtagagattgaggttaccttgatttacaaggttgcc

SEQ ID NO: 1574 - DNA, 820 bp, Succinivibrio dextrinosolvens
  ref <308>: DATABASE ACCESSION NUMBER: ATCC 19716
gctattctagtagtagcagcaactgatggtcctatgccacagacccgtgagcacatcctattagcacgtcaggtaggcgtaccatacatcatcgtattcctaaacaagtgcgatatggttgacgacgaggaattattagagttagttgagatggacgtacgtgatctattaaatcagtaccagttcccaggcgacgacactccaatcatccgtggttcagcactaggtgcattaaacggcgaagagaagtggaaagaggcaatctatcagttagcagacactctagattcatacattccagagccaaagcgtgatatcgatgatccattcctattaccaatcgaagatatcttctcaatctcaggtcgtggtactgtagtaaccggccgtgtagagcgtggtattgtacacgtaggtgacgaagttgaaatcgttggtattcgtccaaccaccaagaccactgtaactggcgttgaaatgttccgtaagttactagacgaaggtcgtgcaggtgataacgttggtgttctactacgtggtaccaagcgtgatgaggttgagcgtggtcaggttctagctgctccaggcacaatcactccacacaccaagttcactggtcaggtttacgtactaagcaaggatgaaggtggtcgtcacactccattcttcaagggctaccgtccacagttcttcttccgtacaaccgatattaccggttctatcgatctgaaagagggcgtagagatggtaatgccaggtgataacaccgacatgaccgtaaccctaatccacccagtagctatggctgaaggcgagagat

SEQ ID NO: 1575 - DNA, 803 bp, Tetragenococcus halophilus
  ref <308>: DATABASE ACCESSION NUMBER: ATCC 33315
ggtagtgtctgcagctgacggcccaatgccacaaactcgtgaacatatcctattgtcacgtaacgttggtgtaccatacatcgttgtattcttaaacaaaatggatatggttgacgatgaagaattacttgaattagttgaaatggaagtacgtgatctattaactgaatacgacttcccaggtgatgatactcctgttatttctggttcagctttgaaagctttagaaggcgacgaagaatatgaacaaaaagtcttagacttaatggcagctgtagatgatttcatcccaactcctgaacgtgaccatgacaaaccgttcatgatgccgattgaagatgttttctcaatcactggtcgtggaactgttgctacaggtcgtgttgaacgtggaactattaaagtcggtgatgaagttgatatcatcggtattcatgaaaatgttaaaaagacaactgttacgggtgtagaaatgttccgtaaattgttggattacgctgaagctggcgataacatcggtacattattgcgtggtgtttctcgtgatgatatcgaacgtggtcaagtgttggctaaaccaggcacaatcacaccacatacaaaattctcagctgaagtttatgtattaacaaaagaagaaggcggacgtcatactccattcttctcaaactatcgcccacaattttacttccgtacaactgacatcactggtgtcattgaattgccagaaggtactgaaatggttatgccaggtgataacgtagcaatggaagttgaattaattcaccctgttgctattgaaa

SEQ ID NO: 1576 - DNA, 805 bp, Campylobacter jejuni subsp. jejuni
  ref <308>: DATABASE ACCESSION NUMBER: ATCC 33292
ttaatgaagcaattgttgtaaattttgaaagcgaaggaaaaaaacataaacttgttttagaagtagcagctcatttaggagataatagagttagaactattgctatggatatgacagatggtttggtaaggggcttaaaagctgaggctttaggtgctcctattagtgttcctgttggtgagaaagttttaggaagaattttcaatgttactggagatttgatcgatgaaggtgaagaaatttcttttgataaaaaatgggcaattcatagagatccgccagcttttgaagatcaaagcacaaaaagtgagatttttgaaacagggattaaagttgtagatttgcttgctccttatgcaaaaggtggtaaagtaggtctttttggtggtgcaggtgttggtaaaactgttattattatggagcttattcacaatgttgcatttaagcatagcggctattctgtatttgcaggtgtgggtgagagaactcgtgaaggaaatgacctttataatgaaatgaaagaaagtaatgttttagacaaagttgctctatgttatggacaaatgaatgaaccaccaggagcaagaaatcgtattgctttaacaggtttaacaatggctgagtattttagagatgaaatgggtcttgatgtgcttatgtttattgataatatctttagattttcacaatcaggttctgaaatgtcagcacttttaggaagaattccatcagctgtgggttatcaaccaaccctagcaagtgaaatgggtaaattccaagaaagaattacttcaactaaaaaagg

SEQ ID NO: 1577 - DNA, 809 bp, Campylobacter rectus
  ref <308>: DATABASE ACCESSION NUMBER: ATCC 33238
atttacccaagatcaacgaagccgtcgaagtaaatttcgaggttgagggcaagcaaaacagacttgtgttagaggttgccgcacaccttggcgataaccgcgtaagaacgatcgctatggatatgagcgaaggcttaaccagaggccttgaggctacggctcttggcgcgcctattagcgttccggtcggcgaaaaagttttgggaaggatttttaacgtcgtcggcgatctgatcgacgagggtgaaggcatagaatttgataaaaaatggtctatccaccgcgatcctccgccgtttgaagagcaaagcacgaagagtgaaatttttgaaacgggtataaaagtggtcgatcttctagccccttatgcaaaaggcggtaaggtcggattattcggcggtgccggcgtcggtaagacggttattatcatggagcttatccacaacgttgcatttaagcatagcggttattccgtgtttgccggcgtgggcgagcgaacccgcgaaggaaacgacctttatcacgagatgaaagagagtaacgttttggacaaagtcgccttgtgctacggccagatgaacgagccgccgggagcaagaaaccgcatcgctctaacaggcctaacgatggctgaatacttccgcgacgagatgggacttgacgttttgatgtttatagacaacatcttccgtttctctcagtctggcgctgagatgtcggcgcttcttggacgtatcccgtcagccgttggttatcagccgactttggcgagcgaaatgggcaaattccaagagagaattacatcaacc

SEQ ID NO: 1578 - DNA, 1671 bp, Enterococcus casseliflavus
  ref <308>: DATABASE ACCESSION NUMBER: ATCC 25788
aatcgaagtgcaacgttcattgcgtgtacttgatggtgctgtaactgtgttggactcacaatcaggtgtagaacctcaaacagaaacagtttggcgtcaagcgacagattaccgcgtaccgcgtgttgtattctgtaacaaaatggacaaaattggtgcagacttcttatactctgtatcaactttacatgatcgtttacaagcaaatgctcacccaatccaattaccaattggtgcggaagatgactttactggtattatcgacttagtaaaaatgaaagctgaaatctacacaaatgacttaggaactgaaatccaagagactgaaattcctgaagaatacgtagaattagctgaagaatggcgcgaaaaattaattgaagctgttgctgatactgatgaagaactaatgatgaaattcttggaaggtgaagaaatcactgaagaagaattgaaagctggtattcgtcaagcaacattgactgttgactttttccctgttctttgcggatctgcctttaaaaacaaaggggttcaattgatgttggatgcagtcatcgactacttgccttcaccacttgatgttcctgcgattaaagggatcaatcctaaaacagacgaagaaactgatcgtccggctgacgatgaagcaccatttgcttcattagcatttaaagtaatgactgacccattcgtargtcgtttgacattcttycgtgtgtattcargtatcttgaactctggatcatacgtattgaatgcttcaaaaggcaaacgcgaacgtatcggtcggatcctacaaatgcacgccaacactcgtgctgaaatccaaacagtatactcaggcgatatcgccgctgctgttggtttgaaagacacaacaactggggatccactatgtgatgaaaaatccccagtaatccttgaatcaatcgaattcccagaaccagttatcgaagtcgctgttgagcttaaatcaaaagctgaccaagataaaatgggggttgctttacaaaaacttgctgaagaagatccatcattccgtgtggaamcaaacgctgaaacaggcgaaactgttatcgctggtatgggagaacttcacttggacgtcttagttgaccgtatgcgtcgcgaatttaaagttgaagcaaacgtaggtgcgcctcaagtttcttatcgtgaaacattccgtgcagcaacacaagcggaaggtaaatttgtacgtcagtctggtggtaaaggtcaatacggtcacgtatgggtcgaatttacaccaaacgaagaaggtaaaggcttcgaattcgaaaacgcgattgtcggtggtgtggttcctcgtgaatacatcccagcagttgaaaaaggacttgaagaatcaatggcgaacggtgtcttagccggttacccattagtagacatcaaagcaaaactttatgatggttcataccatgatgtcgattcaagtgaaactgccttccgtgttgcagcttctatggctttacgtgctgcagcgaagaaagcaaacccagtaattcttgaaccaatgatgaaagtagttatcactgtaccagaagattacttaggtgatgttatgggtcacgtaactgctcgtcgtggacgcgtagaaggaatggaagcacwcggtaactcacaaatcgtgaacgcaatcgtgcc

SEQ ID NO: 1579 - DNA, 1662 bp, Enterococcus gallinarum
  ref <308>: DATABASE ACCESSION NUMBER: ATCC 49573
gaagtacaacgttcactacgggttcttgacggwgctgtaacagtattggactcacaatctggtgtagaaccacaaactgaaacagtttggcgtcaagcgacagattaccgcgtaccacgtatcgtattctgtaacaaaatggataaaatcggtgcagacttcttatactctgtatctactttacatgatcgcttgcaagcaaatgctcatccaatccaattaccaattggtgcggaagatgactttactggtatcatcgatctagtaaaaatgaaagctgagatctatacaaacgatttaggaacagagattcaagaaactgaaattcctgaagagtacaaagaattagctgaagaatggcgcgaaaaattagttgaagctgttgcagatactgacgaagagctaatgatgaaattcttggaaggtgaagaaatcactgaagaagaattgaaagctggtatccgtcaagcgacattgactgttgaatttttcccagttctttgtggttcagccttcaaaaacaaaggggttcaattgatgttggatgcagtcatcgactaccttccttcaccacttgatgttcctgcaatcaaagggatcaatcctaaaactgacgaagaaactgatcgtcctgctgacgatgaagcgccttttgcttcactagcatttaaagtaatgactgacccattcgtaggtcgtttgacattcttccgtgtgtattcaggtgtcttgaactctggatcatatgtcttgaatgcttcaaaagacaaacgcgaacgtatcggtcgtattctgcaaatgcacgcgaacacttgtgcagaaatccaaacagtttattcaggcgatatcgctgcagctgttggtttgaaagattccacaacaggggatacattgtgtgcgaaaaatcacccagtaatccttgaatcaatcgaattcccagamccagttatcgaagtagctgttgaacytaaatcaaaagctgaccaagataaaatgggtgtggctttacaaaaacttgctgaagaagatccttcattccgtgtagaamcaaacgctgaaactggcgaaactgttatcgcagggatgggtgaacttcacttggacgtccttgttgaccgtatgcgtcgcgaatttaaagttgaagcaaacgttggtgcgcctcaagtttcttaccgcgaaacattccgtgcttctacgcaagccgaaggtaaatttgtacgtcagtctggtggtaaaggtcaatacggtcacgtatggatcgaatttacaccaaacgaagaaggtaaaggcttcgaattcgaaaacgcaattgtcggtggtgtggttccacgtgaatacatcccagcagttgaaaaaggacttgaagactcaatggctaacggtgttctagctggttatccattggttgacatcaaagccaagctttacgatggttcataccatgatgtcgattcaagtgaaacagccttccgtgtggcagcttcaatggctttacgtgctgcagcgaagaaagctaatccagtgattcttgaaccaatgatgaaagttgttatcactgttcctgaagattacttaggtgatattatgggacacgtaactgctcgtcgtggacgtgttgaaggtatggaagcgcatggtaactcacaaatcgttaacgcgatt

SEQ ID NO: 1580 - DNA, 1669 bp, Streptococcus mitis
  ref <308>: DATABASE ACCESSION NUMBER: ATCC 49456
caatcgaagtacaacgttctcttcgtgtattggatggtgctgttaccgttcttgactcacaatcaggtgttgagcctcaaactgaaacagtttggcgtcaagcaactgagtatggagttccacgtatcgtatttgccaacaaaatggacaaaatcggtgctgacttcctttactctgtaagcacacttcacgatcgtcttcaagcaaatgcacacccaatccaattgccaatcggttctgaagatgacttccgtggtatcatcgacttgatcaagatgaaagctgaaatctatactaacgaccttggtacagatatccttgaagaagacatcccagctgaataccttgaccaagctcaagaataccgtgaaaaattgatcgaagcagttgctgaaactgacgaagaattgatgatgaaatacctcgaaggtgaagaaatcactaacgaagaattgaaagctggtatccgtaaagcgactatcaacgttgaattcttcccagtattgtgtggctctgccttcaagaacaaaggtgttcaattgatgcttgatgcggttattgactaccttccaagcccacttgacatcccagcgatcaaaggtatcaacccagatwcagatgaagaagaaactcgtccagcatctgatgaagagccatttgcagctcttgccttcaagatcatgacagacccattcgtaagtcgtttgacattcttccgtgtttactcargtgktcttcaatcaggttcatacgtattgaacacttctaaaggkaaacgtgagcgtatcggacgtatccttcaaatgcacgccaacagccgtcaagaaattgacactggttactcaagagatatcgctgctgccgttggtttgaaagatactccaactggtgactcattgccagatgaaaaagctaaaatcattcttgagtcaatcaacgttccagamccagttatccaattgatggttgagccaaaatctaaagctgaccaagccaagatgggtatcgcccttcaaaaattggctgaagaagatccaacattccgcgttgaamcaaacgttgaaactggtgaamcagttatctctggtatgggtgagcttcaccttgacgtccttgttgaccgtatgcgtcgtgagttcaaagttgaagcaaacgtaggtgctcctcaagtatcttaccgtgaaacattccgcgcttctactcaagcacgtggattcttcaaacgtcagtctggtggtaaaggtcaattcggtgatgtatggattgaatttactccaaacgaagaaggtaaaggattcgaattcgaaaacgcaatcgtcggtggtgtggttcctcgtgaatttatcccagcggttgaaaaaggtttggtagaatctatggctaacggtgtacttgcaggttacccaatggttgacgttaaagctaagctttacgatggttcataccacgatgtcgactcatctgaaactgccttcaagattgcggcttcacttgctcttaaagaagctgctaaatcagcacaaccagctatccttgagccaatgatgcttgtaacaatcactgttccagaagaaaaccttggtgatgttatgggtcacgtaactgctcgtcgtggacgtgtagatggtatggaagcacwcggtaacagccaaatcgttcgtgcttacgt

SEQ ID NO: 1581 - DNA, 26 bp, Artificial Sequence
  Synthetic DNA Sequence
aattggggactacacctattatgatg

SEQ ID NO: 1582 - DNA, 23 bp, Artificial Sequence
  Synthetic DNA Sequence
ggcaaatcagtcagttcaggagt

SEQ ID NO: 1583 - DNA, 23 bp, Artificial Sequence
  Synthetic DNA Sequence
cgattggcaacaatacactcctg

SEQ ID NO: 1584 - DNA, 26 bp, Artificial Sequence
  Synthetic DNA Sequence
tcacctatttttacgcctggtaggac

SEQ ID NO: 1585 - DNA, 645 bp, Enterococcus faecium
atgactatacctgacgcaaatgcaatctatcctaactcagccatcaaagaggttgtctttatcaagaacgtgatcaaaagtcccaatattgaaattggggactacacctattatgatgacccagtaaatcccaccgattttgagaaacacgttacccatcactatgaatttctaggcgacaaattaatcatcggtaaattttgttctatcgccagtggcattgaatttatcatgaacggtgccaaccacgtaatgaaaggtatttcgacttatccatttaatattttaggtggcgattggcaacaatacactcctgaactgactgatttgccgttgaaaggtgatactgtagtcggaaatgacgtgtggtttgggcaaaatgtgaccgtcctaccaggcgtaaaaataggtgacggtgccattatcggagcaaatagtgttgtaacaaaagacgtcgctccatatacaattgtcggtggcaatccaattcaactcatcggaccaagatttgaaccggaagttattcaagcattagaaaatctggcatggtggaataaagatattgaatggataactgctaatgttcctaaactaatgcaaacaacacccacacttgaattgataaacagtttaatggaaaaataa

SEQ ID NO: 1586 - DNA, 26 bp, Artificial Sequence
  Synthetic DNA Sequence
attcccacaatcttttttatcaataa

SEQ ID NO: 1587 - DNA, 24 bp, Artificial Sequence
  Synthetic DNA Sequence
cattgttcagattcggtaaagttc

SEQ ID NO: 1588 - DNA, 25 bp, Artificial Sequence
  Synthetic DNA Sequence
gtttttgaagttaaatagtgttctt

SEQ ID NO: 1589 - DNA, 21 bp, Artificial Sequence
  Synthetic DNA Sequence
cttccatttgtactttcccta

SEQ ID NO: 1590 - DNA, 1920 bp, Unknown Organism
  Description of Unknown Organism: Cloning vector pFW16
atgaaaattattaatattggagttttagctcatgttgatgcaggaaaaactaccttaacagaaagcttattatataacagtggagcgattacagaattaggaagcgtggacaaaggtacaacgaggacggataatacgcttttagaacgtcagagaggaattacaattcagacaggaataacctcttttcagtgggaaaatacgaaggtgaacatcatagacacgccaggacatatggatttcttagcagaagtatatcgttcattatcagttttagatggggcaattctactgatttctgcaaaagatggcgtacaagcacaaactcgtatattatttcatgcacttaggaaaatggggattcccacaatcttttttatcaataagattgaccaaaatggaattgatttatcaacggtttatcaggatattaaagagaaactttctgccgaaattgtaatcaaacagaaggtagaactgtatcctaatgtgtgtgtgacgaactttaccgaatctgaacaatgggatacggtaatagagggaaacgatgaccttttagagaaatatatgtccggtaaatcattagaagcattggaactcgaacaagaggaaagcataagatttcagaattgttctctgttccctctttatcatggaagtgcaaaaagtaatatagggattgataaccttatagaagttattactaataaattttattcatcaacacatcgaggtccgtctgaactttgcggaaatgttttcaaaattgaatatacaaaaaaaagacaacgtcttgcatatatacgcctttatagtggagtactacatttacgagattcggttagagtatcagaaaaggaaaaaataaaagttacagaaatgtatacttcaataaatggtgaattatgtaagattgatagagcttattctggagaaattgttattttgcaaaatgagtttttgaagttaaatagtgttcttggagatacaaaactattgccacagagaaaaaagattgaaaatccgcaccctctactacaaacaactgttgaaccgagtaaacctgaacagagagaaatgttgcttgatgcccttttggaaatctcagatagtgatccgcttctacgatattacgtggattctacgacacatgaaattatactttctttcttagggaaagtacaaatggaagtgattagtgcactgttgcaagaaaagtatcatgtggagatagaaataacagagcctacagtcatttatatggagagaccgttaaaaaatgcagaatataccattcacatcgaagtgccgccaaatcctttctgggcttccattggtctatctgtatcaccgcttccgttgggaagtggaatgcagtatgagagctcggtttctcttggatacttaaatcaatcatttcaaaatgcagttatggaagggatacgctatggttgtgaacaaggattgtatggttggaatgtgacggactgtaaaatctgttttaagtatggcttatactatagccctgttagtaccccagcagattttcggatgcttgctcctattgtattggaacaagtcttaaaaaaagctggaacagaattgttagagccatatcttagttttaaaatttatgcgccacaggaatatctttcacgagcatacaacgatgctcctaaatattgtgcgaacatcgtagacactcaattgaaaaataatgaggtcattcttagtggagaaatccctgctcggtgtattcaagaatatcgtagtgatttaactttctttacaaatggacgtagtgtttgtttaacagagttaaaagggtaccatgttactaccggtgaacctgtttgccagccccgtcgtccaaatagtcggatagataaagtacgatatatgttcaataaaataacttag

SEQ ID NO: 1591 - DNA, 20 bp, Artificial Sequence
  Synthetic DNA Sequence
atgaggtaatagaacggatt

SEQ ID NO: 1592 - DNA, 21 bp, Artificial Sequence
  Synthetic DNA Sequence
cagtatttcagtaagcgtaaa

SEQ ID NO: 1593 - DNA, 36 bp, Artificial Sequence
  Synthetic DNA Sequence
  modified_base (29): i
ccgagcgatttaccggatacttggctgcncgctcgg

SEQ ID NO: 1594 - DNA, 1032 bp, Enterococcus faecium
  strain N97-330
atgtttagaattaaagttgcagttctgtttgggggctgttcagaggaacataatgtttcgataaaatctgcgatggagattgccgcaaacatagatacaaaaaagtatcagccttattatattggaatcacaaaatccggcgtttggaaaatgtgtgaaaaaccttgtttggagtgggaacaatatgcgggggatccggttgttttttcaccggacagaagtacgcatggtctgctgatacaaaaagacactgggtatgaaatccagcctgtggatgtgggattaccgatgattcatggcaagtttggcgaggatggctccatacaaggcttgcttgaattgtcaggcattccgtatgtgggatgcgatattcaaagctccgtgacctgcatggataaggcgcttgcatataccgttgtgaaaaatgcgggtatcgctgtgcctgggttccggatccttcaggagggggatcgcctggaaacagaggatttcgtatatcccgtttttgtaaagcctgcccgttccggctcatcctttggcgtaaacaaggtatgcaaggcagaagaactgcaggcagcaatcgaagatgcaagaaaatatgacagcaagattttgattgaagaggccgttaccgggagtgaggtaggctgcgccatactgggaaacggaaatgatctcatggctggcgaggtggatcagattgagctgagacacggcttttttaagattcatcaggaagcacagccggagaaaggatctgaaaatgcagtcatccgagttccagccgccttaccggatgaggtaatagaacggattcagaaaacagcaatgaagatttaccggatacttggctgcagaggattggcccgcattgacctgtttttgcgggaggacggctgcattgtgttgaatgaagtgaataccatgccgggttttacttcctacagccgttatccccgcatgatgacagcagccggttttacgcttactgaaatactggatcgcttgattgaactttcacttaggaggtaa

SEQ ID NO: 1595 - DNA, 25 bp, Artificial Sequence
  Synthetic DNA Sequence
aaataatgctccatcaatttgctga

SEQ ID NO: 1596 - DNA, 24 bp, Artificial Sequence
  Synthetic DNA Sequence
atagtcgaaaaagccatccacaag

SEQ ID NO: 1597 - DNA, 24 bp, Artificial Sequence
  Synthetic DNA Sequence
gatgaatttgcgaaaatacatgga

SEQ ID NO: 1598 - DNA, 23 bp, Artificial Sequence
  Synthetic DNA Sequence
cagccaatttctacccctttcac

SEQ ID NO: 1599 - DNA, 604 bp, Enterococcus faecalis
  strain BM4405
cagggagtatttgagttattagatattccatatgtaggttgtggtatcggagctgcagcaatttccatgaataaaataatgctccatcaatttgctgaaatagttggtgtaaaaagcactcctagtatgattatagaaaagggacaagacctacaaaaagtcgatgaatttgcgaaaatacatggatttcctttatatatcaaaccgaatgaggcaggctcatcaaaaggaattagcaaggtagaacaaaaaagtgatttatataaagcaatagacgaagcttcaaaatatgatagccgtattttaattcaaaaggaagtgaaaggggtagaaattggctgtgggattttagggaatgaacaattggtcgttggagaatgtgatcaaattagtcttgtggatggctttttcgactatgaagagaaatacaatttagtaacagcagaaattttgttaccagctaaactatcaatagacaaaaaagaagacatccagataaaagcaaaaaaactatacagactattagggtgcaaaggattagcgagaatcgactttttcttaacggatgacggagaaattttattaaatgagatcaacaccctcc

SEQ ID NO: 1600 - DNA, 805 bp, Campylobacter jejuni subsp. doylei
  ref <308>: DATABASE ACCESSION NUMBER: ATCC 49349
acctcaaattaatgaagcaattgttgtaaattttgaaagcgaaggaaaaaaacataaacttgttttagaagtagcagctcatttaggagataatagagttagaactattgctatggatatgacagatggtttggtaaggggcttaaaagctgaggctttaggtgctcctattagtgttcctgttggtgagaaagttttaggaagaattttcaatgttactggagatttgatcgatgaaggtgaagaaattccttttgataaaaaatgggcaattcatagagatccgccagcttttgaagatcaaagcacaaaaagtgagatttttgaaacagggattaaagttgtagatttacttgctccttatgcaaaaggtggtaaagtaggtctttttggtggtgcaggtgttggtaaaactgttattattatggagcttattcacaatgttgcatttaagcatagcggctattctgtatttgcaggtgtgggtgagagaactcgtgaaggaaatgacctttataatgaaatgaaagaaagtaatgttttagacaaagttgctctatgttatggacaaatgaatgaaccaccaggagcaagaaatcgtattgctttaacaggtttaacaatggctgagtattttagagatgaaatgggtcttgatgtgcttatgtttattgataatatctttagattttcacaatcaggttctgaaatgtcagcacttttaggaagaattccatcagctgtgggttatcaaccaaccctagcaagtgaaatgggtaaattccaagaaagaattacttcaact

SEQ ID NO: 1601 - DNA, 826 bp, Enterococcus sulfureus
  ref <308>: DATABASE ACCESSION NUMBER: ATCC 49903
ctccttaccagatatcaacaatgcgctggttgtatataaaaatgatgccaataaaacaaaagttgttttagaagcagcgttagaattaggtgacggaatcattcgtgcgattgcaatggaatcgactgatggattgcaacgtgggatggaagttgtcgatatgggagaatctatttctgtaccagttggaacagaaactttaggacgtgtgtttaatgtattaggagatacgattgacttagaagctccttttcctaaagatgcaccgcgtagtggaatccataaaaaagcccctaattttgatgaattaagtacaagcacagaaattctagaaacagggatcaaagtcatcgatctattagccccttatttaaaaggtggtaaagttggattgtttgggggagccggtgtaggaaaaacggtattgattcaagagttgattcacaatatcgcacaagaacacggtgggatttcggtctttactggtgttggtgagcgtacacgtgaaggaaacgatttgtattatgaaatgaaagattcaggagtcattgaaaaaacagcgatggtgtttggacaaatgaatgagccacctggtgcacggatgcgtgtagccttgactggattaacgattgctgaatatttccgtgatgttgaaggacaggatgtactgttgtttatcgacaatatcttccgttttacacaagctggttctgaagtgtctgccttgttaggtcgtatgccatcagctgtgggatatcaaccaacattagctaccgaaatggggcaattgcaagagcggatcacgtcaacgaaaaaaggatcgatc

SEQ ID NO: 1602 - DNA, 833 bp, Enterococcus solitarius
  ref <308>: DATABASE ACCESSION NUMBER: ATCC 49428
tgatactttaccagatattaataatgcattagtagtatataaaaaggacgaggacaagacacgcgttgtcttagaagccaccttggaacttggagatggcatgattcgtgcaatctctatgggatcgactgatggcttgcaacggggaatggaagttgtggacacacaagcacctatttctgttccagtaggaaatgaaaccttaggacgtgtttttaatgtcttaggagaaacgattgataaacaggcaccgtttcctgaagatgccaaaaaaagtggtattcataaaaaagcacccgcttttgatgaattaagtaccagttctgaaatattggaaaccgggattaaagtaatcgatttgctagctccttatttacgaggtggtaaagttggattatttggcggtgctggcgtgggtaaaacggtattaattcaagaattaattcataacgttgcccaagaacatgggggaatttctgtttttacgggtgtcggagagcgtactcgtgaaggaaatgacctatattatgaaatgcaggattcaggcgttattgaaaaaacggctatggtatttggacaaatgaacgaaccccctggtgcacgtatgcgtgtagcgttaactggtttgacacttgctgagtacttccgtgatgtacaaggtcaagacgtattattatttatagataatattttccgctttactcaagcaggaacagaagtatctgctttattaggacggatgccgtctgccgttggttaccaaccaactctagcaacggaaatgggacagttgcaagaacgaatcacatcgacagataaaggatcaattacct

SEQ ID NO: 1603 - DNA, 806 bp, Campylobacter sputorum subsp. sputorum
  ref <308>: DATABASE ACCESSION NUMBER: ATCC 35980
atcagcctaaaattaacgaagcaatagaagttaattatgaattagatggtaaaaaaataagacttattcttgaagtagctggacatcttggcgataatagagcaagaaccattgctatggatatgagtgatggtttacaaagaggattagaagttacggctcttggtgctcctataacagttcctgttggagataaagttttaggtagaatgtttaatgttgtaggtgacttaatagatgaaggtgaagtaacagattttgataaaagatgggctatccatagagatcctccttcgtttgaagatcaaagtacaaaaagtgaaatttttgaaacaggtataaaagtagttgatcttcttgcaccttatgcaaaaggtggtaaagttggcttatttggtggtgctggcgttggaaaaacagttatcataatggagcttatacataatgttgcatttaaacacagcggttattcaatttttgccggtgttggagagagaacaagagagggaaatgatctttataatgagatgaaagagtctggtgttttggataaagttgccttatgttatggacaaatgaatgaaccaccaggagcaagaaaccgtatagcattaacaggtcttacaatggctgaatatttccgtgatgaaatggggcttgatgtgttgatgtttatagataatatttttagattttctcaatcaggttctgaaatgtcagcgctgcttggtagaattccatctgctgttggttatcaaccaacattagcaagtgagatgggaaaacttcaagaaagaattacttcc

SEQ ID NO: 1604 - DNA, 738 bp, Enterococcus pseudoavium
  ref <308>: DATABASE ACCESSION NUMBER: ATCC 49372
ggtgttatccgcacaatcgctatggaatctacagatggattgcaacgggggatggaagttgtcgataccggcaaaccaatctctgttcctgtaggtaaagaaacattaggtcgtgtgtttaacgtattaggtgaaacgatcgacaaagaagcaccttttccagaagatgtagaaaagagcggtattcacaaaaaggcccccgcttttgaagaccttagcaccagtaatgagattttagaaactgggatcaaggttatcgacttattagccccttacttaaaaggtggtaaagttggactattcggtggtgccggtgttggtaaaaccgtcttaattcaagaactgattcataatatcgcccaagaacacggtgggatttctgtctttaccggggttggggaacggactcgtgaagggaacgacctttattatgaaatgaaagaatccggcgttattgaaaaaacagcgatggtcttcggacaaatgaatgagccaccaggtgcgcggatgcgcgttgccttgactggtttgacattagctgaatatttccgtgatgaagaaggtcaagatgtgttgctatttatcgataacattttccgcttcacacaagccggatcagaagtttcggcgctattaggtcggatgccatctgccgttggttatcaaccaaccttggcaacagaaatgggtcaattacaagaacgaatcacttcaacgaaaaaaggctcaattacatcg

SEQ ID NO: 1605 - DNA, 20 bp, Artificial Sequence
  Synthetic DNA Sequence
  modified_base (12): i
  modified_base (18): i
atyatygaartntaygcncc

SEQ ID NO: 1606 - DNA, 23 bp, Artificial Sequence
  Synthetic DNA Sequence
  modified_base (9): i
  modified_base (12): i
  modified_base (15): i
ccraacatnaynccnactttttc

SEQ ID NO: 1607 - DNA, 336 bp, Klebsiella ornithinolytica
  ref <308>: DATABASE ACCESSION NUMBER: ATCC 31898
ctggattatgcgatgtcggtcattgttggccgtgcgctgccggatgtccgagatggcctgaaaccggtacaccgtcgcgtactttacgccatgaacgtattgggcaatgactggaacaaagcctataaaaaatccgcccgtgtcgttggtgacgtaatcggtaaataccaccctcatggtgataccgccgtttatgacaccattgtacgtatggcacagccattctccttgcgttatatgctggtcgatggccagggtaacttcggttctgtcgatggcgactccgccgcagcgatgcgttatacggaaatccgtatgtcgaaaatcgcccacgag

SEQ ID NO: 1608 - DNA, 341 bp, Klebsiella oxytoca
  ref <308>: DATABASE ACCESSION NUMBER: ATCC 13182
ctatctggattatgcgatgtcggtcattgttggccgtgcgctgccggatgtccgagatggcctgaagccggtacaccgtcgcgtactatacgccatgaacgtattgggcaatgactggaacaaagcctataaaaaatctgcccgtgtcgtgggtgacgtcatcggtaaataccaccctcatggtgatactgccgtatacgacaccattgtacgtatggcgcagccattctccctgcgttacatgctggtagatggccagggtaactttggttcggtcgacggcgactccgccgcagcgatgcgttatacggaaatccgtatgtcgaagatcgcccatgaac

SEQ ID NO: 1609 - DNA, 22 bp, Artificial Sequence
  Synthetic DNA Sequence
gccctgatccaaatagcatata

SEQ ID NO: 1610 - DNA, 23 bp, Artificial Sequence
  Synthetic DNA Sequence
cctggcataacagtaacattctg

SEQ ID NO: 1611 - DNA, 22 bp, Artificial Sequence
  Synthetic DNA Sequence
tgggaaaaagcaactccatctc

SEQ ID NO: 1612 - DNA, 23 bp, Artificial Sequence
  Synthetic DNA Sequence
acaactgaattcgcagcaacaat

SEQ ID NO: 1613 - DNA, 639 bp, Staphylococcus aureus
atgaaatatggccctgatccaaatagcatatatccacatgaagaaataaaaagtgtttgttttattaaaaatacaattaccaatccaaatattatagttggagattatacttactattccgatgttaacggagctgaaaaatttgaagaacatgtgacacatcattatgaatttaggggtgataaacttgtaattggcaagttttgtgcaatagctgaaggtatagaatttattatgaatggagcaaaccatagaatgaattcaataacaacttatccttttaatataatgggaaatggttgggaaaaagcaactccatctcttgaagatttaccatttaagggagatactgttgttggaaatgatgtgtggattggtcagaatgttactgttatgccaggaattcaaataggagatggagcaattgttgctgcgaattcagttgttacaaaagatgtaccaccatatcgtattattggtggaaatccgagtagaattataaagaaaaggtttgaagatgaattgatagattatttattgcaaataaaatggtgggattggtcagcacaaaaaatattttctaatcttgaaacactttgtagctctgatttagagaaaataaaatctattcgagattag

SEQ ID NO: 1614 - DNA, 22 bp, Artificial Sequence
  Synthetic DNA Sequence
ccaatccagaagaaatataccc

SEQ ID NO: 1615 - DNA, 24 bp, Artificial Sequence
  Synthetic DNA Sequence
attagtttatccccaatcaattca

SEQ ID NO: 1616 - DNA, 26 bp, Artificial Sequence
  Synthetic DNA Sequence
ataatgaatggggctaatcatcgtat

SEQ ID NO: 1617 - DNA, 24 bp, Artificial Sequence
  Synthetic DNA Sequence
gccaacaactgaataaggatcaac

SEQ ID NO: 1618 - DNA, 639 bp, Staphylococcus cohnii
atgaaatggcaaaatcagcaaggccccaatccagaagaaatataccctatagaaggtaataaacatgttcaatttattaaaccatctataacaaagcccaatattttagttggggaatattcatattacgatagtaaagatggtgaatcttttgaaagccaagttctttatcactatgaattgattggggataaactaatattagggaagttttgttctattggacccggaacgacatttataatgaatggggctaatcatcgtatggatggttcaacatttccattcaatcttttcggaaatggttgggagaagcatacccctacattggaagaccttccttataagggtaacacggaaattgggaacgatgtttggattggacgagatgtgacaattatgcccggtgtaaaaataggaaacggggctattattgcagcaaaatcggttgtgacaaagaacgttgatccttattcagttgttggcggtaatccttcacgattaattaagataaggttttccaaggaaaaaatcgcagcattactaaaagtaaggtggtgggacctagagatagagacgataaatgaaaatattgattgcatcctgaatggtgatataaaaaaggttaaaagaagttag

SEQ ID NO: 1619 - DNA, 24 bp, Artificial Sequence
  Synthetic DNA Sequence
aaggcaaaataaaaggagcaaagc

SEQ ID NO: 1620 - DNA, 23 bp, Artificial Sequence
  Synthetic DNA Sequence
tgtacccgagacatcttcaccac

SEQ ID NO: 1621 - DNA, 26 bp, Artificial Sequence
  Synthetic DNA Sequence
aattgaaggacgggtattgtggaaag

SEQ ID NO: 1622 - DNA, 26 bp, Artificial Sequence
  Synthetic DNA Sequence
cgattttgacagatggcgataatgaa

SEQ ID NO: 1623 - DNA, 1569 bp, Staphylococcus aureus
atgaaaataatgttagagggacttaatataaaacattatgttcaagatcgtttattgttgaacataaatcgcctaaagatttatcagaatgatcgtattggtttaattggtaaaaatggaagtggaaaaacaacgttacttcacatattatataaaaaaattgtgcctgaagaaggtattgtaaaacaattttcacattgtgaacttattcctcaattgaagctcatagaatcaactaaaagtggtggtgaagtaacacgaaactatattcggcaagcgcttgataaaaatccagaactgctattagcagatgaaccaacaactaacttagataataactatatagaaaaattagaacaggatttaaaaaattggcatggagcatttattatagtttcacatgatcgcgcttttttagataacttgtgtactactatatgggaaattgacgagggaagaataactgaatataaggggaattatagtaactatgttgaacaaaaagaattagaaagacatcgagaagaattagaatatgaaaaatatgaaaaagaaaagaaacgattggaaaaagctataaatataaaagaacagaaagctcaacgagcaactaaaaaaccgaaaaacttaagtttatctgaaggcaaaataaaaggagcaaagccatactttgcaggtaagcaaaagaagttacgaaaaactgtaaaatctctagaaaccagactagaaaaacttgaaagcgtcgaaaagagaaacgaacttcctccacttaaaatggatttagtgaacttagaaagtgtaaaaaatagaactataatacgtggtgaagatgtctcgggtacaattgaaggacgggtattgtggaaagcaaaaagttttagtattcgcggaggagacaagatggcaattatcggatctaatggtacaggaaagacaacgtttattaaaaaaattgtgcatgggaatcctggtatttcattatcgccatctgtcaaaatcggttattttagccaaaaaatagatacattagaattagataagagcattttagaaaatgttcaatcttcttcacaacaaaatgaaactcttattcgaactattctagctagaatgcatttttttagagatgatgtttataaaccaataagtgtcttaagtggtggagagcgagttaaagtagcactaactaaagtattcttaagtgaagttaatacgttggtactagatgaaccaacaaactttcttgatatggaagctatagaggcgtttgaatctttgttaaaggaatataatggcagtataatctttgtatctcacgatcgtaaatttatcgaaaaagtagccactcgaataatgacaattgataataaagaaataaaaatatttgatggcacatatgaacaatttaaacaagctgaaaagccaacaaggaatattaaagaagataaaaaacttttacttgagacaaaaattacagaagtactcagtcgattgagtattgaaccttcggaagaattagaacaagagtttcaaaacttaataaatgaaaaaagaaatttggataaataa

SEQ ID NO: 1624 - DNA, 26 bp, Artificial Sequence
  Synthetic DNA Sequence
ttctttaatgctcgtagatgaaccta

SEQ ID NO: 1625 - DNA, 25 bp, Artificial Sequence
  Synthetic DNA Sequence
ttttcgtattcttcttgttgctttc

SEQ ID NO: 1626 - DNA, 26 bp, Artificial Sequence
  Synthetic DNA Sequence
aggaatgattaagcccccttcaaaaa

SEQ ID NO: 1627 - DNA, 26 bp, Artificial Sequence
  Synthetic DNA Sequence
ttacattgcgaccatgaaattgctct

SEQ ID NO: 1628 - DNA, 1658 bp, Staphylococcus aureus
atgcttaaaatcgacatgaagaatgtaaaaaaatattatgcagataaattaattttaaatataaaagaactaaagatttatagtggggataaaataggtattgtaggtaagaatggagttggcaaaacaacacttttaaaaataataaaaggactaatagagattgacgaaggaaatataattataagtgaaaaaacaactattaaatatatctctcaattagaagaaccacatagtaagataattgatggaaaatatgcttcaatatttcaagttgaaaataagtggaatgacaatatgagtggtggtgaaaaaactagatttaaactagcagagggatttcaagatcaatgttctttaatgctcgtagatgaacctacaagtaatttagatatcgaaggaatagagttgataacaaatacttttaaagagtaccgtgatacttttttggtagtatctcatgatagaatttttttagatcaagtttgtacaaaaatttttgaaattgaaaatggatatattagagaattcatcggtaattatacaaactatatagagcaaaaagaaatgcttctacgaaagcaacaagaagaatacgaaaagtataattctaaaagaaagcaattggagcaagctataaagctaaaagagaataaggcgcaaggaatgattaagcccccttcaaaaacaatgggaacatctgaatctagaatatggaaaatgcaacatgctactaaacaaaaaaagatgcatagaaatacgaaatcgttggaaacacgaatagataaattaaatcatgtagaaaaaataaaagagcttccttctattaaaatggatttacctaatagagagcaatttcatggtcgcaatgtaattagtttaaaaaacttatctataaaatttaataatcaatttctttggagagatgcttcatttgtcattaaaggtggagaaaaggttgctataattggtaacaatggtgtaggaaaaacaacattgttgaagctgattctagaaaaagtagaatcagtaataatatcaccatcagttaaaattggatacgtcagtcaaaacttagatgttctacaatctcataaatctatcttagaaaatgttatgtctacctccattcaagatgaaacaatagcaagaattgttctagcaagattacatttttatcgcaatgatgttcataaagaaataaatgttttgagtggtggagaacaaataaaggttgcttttgccaagctatttgttagcgattgtaatacattaattcttgatgaaccaacaaactatttggatatcgatgctgttgaggcattagaagaattgttaattacctatgaaggtgttgtgttatttgcttcccatgataaaaaatttatacaaaacctagctgaacaattgttaataatagaaaataataaagtgaaaaaattcgaaggaacatatatagaatatttaaaaattaaagataaaccaaaattaaatacaaatgaaaaagaactcaaagaaaaaaagatgatactagaaatgcaaatttcatcattattaagtaaaatctcaatggaagaaaatgaagaaaaaaacaaagaattagatgaaaagtacaaattgaaattaaaagaattgaaaagcctaaataaaaatattta

SEQ ID NO: 1629 - DNA, 26 bp, Artificial Sequence
  Synthetic DNA Sequence
aaggggaaagtttggattacacaaca

SEQ ID NO: 1630 - DNA, 24 bp, Artificial Sequence
  Synthetic DNA Sequence
gaaccacagggcattatcagaacc

SEQ ID NO: 1631 - DNA, 21 bp, Artificial Sequence
  Synthetic DNA Sequence
cgacgatgctttatggtttgt

SEQ ID NO: 1632 - DNA, 26 bp, Artificial Sequence
  Synthetic DNA Sequence
gttaatttgcctatcttgtcacactc

SEQ ID NO: 1633 - DNA, 900 bp, Staphylococcus aureus
atggaatttaaattacaagaattaaatcttactaaccaagatacaggaccatatggtataaccgtttcagataaggggaaagtttggattacacaacataaagcaaatatgataagttgcatcaatttagatggaaaaattacagagtacccactaccgacaccagatgcaaaagtcatgtgtttaactatatcctcagatggggaagtttggtttactgagaatgcagcaaacaaaatagggaggattacaaaaaaagggattattaaggaatatacattgcctaacccagattcagcaccctacggtattacagaaggaccaaatggagatatatggtttacagaaatgaatggcaaccgtattggacgtattacggacgacggtaaaattcgtgaatacgagctgcctaataaaggatcttacccttcttttatcactttgggttctgataatgccctgtggttcacagaaaatcaaaataatgctattggtagaattacagaaagtggggatattacagagtttaaaattcctacacctgcatcaggaccagttggtattacaaaggggaacgacgatgctttatggtttgtggaaattatcggtaataagatagggcgaataactcctctgggggaaattaccgaattcaaaattccaacgccaaacgctcgacctcatgcaattactgctggagcaggaattgatttatggtttactgaatggggggctaataaaataggaaggctgacaagcaataatataattgaggaatacccaattcaaatcaaaagtggtgaaccacatggcatttgtttcgatggtgaaacaatttggtttgcaatggagtgtgacaagataggcaaattaactctcattaaggataatatggagtga

SEQ ID NO: 1634 - DNA, 25 bp, Artificial Sequence
  Synthetic DNA Sequence
ttaacttgtctattcccgattcagg

SEQ ID NO: 1635 - DNA, 23 bp, Artificial Sequence
  Synthetic DNA Sequence
gctgtggcaatggatattctgta

SEQ ID NO: 1636 - DNA, 24 bp, Artificial Sequence
  Synthetic DNA Sequence
ttcctacccctgatgctaaagtga

SEQ ID NO: 1637 - DNA, 23 bp, Artificial Sequence
  Synthetic DNA Sequence
caaagtgcgttatccgaacctaa

SEQ ID NO: 1638 - DNA, 527 bp, Aspergillus fumigatus
  strain WSA-172
ggtggggaagactgtcttcatccaggaattgattgtgagtcgttccacatgctcacctagttttcgctcgatcttttcactaacgcaaaccatgtagaacaacattgccaaggcccacggtggttactccgtcttcactggtgttggtgagcgtactcgtgagggtaacgatctgtaccacgaaatgcaggagactggtgtcattcagctcgagggtgaatccaaggtcgcactggtgttcggacagatgaacgagccccccggtgcccgtgcccgtgtcgcccttaccggtctgaccattgccgagtacttccgtgacgaggagggtcaggacgtgctgctcttcattgacaacattttccgtttcacccaggccggttctgaggtgtctgcccttctcggtcgtatcccctctgccgtcggttaccagcccaccctggccgtcgacatgggtggtatgcaggagcgtatcaccaccaccaagaagggttctattacctccgtccargccgtctacgtccccgcga

SEQ ID NO: 1639 - DNA, 452 bp, Aspergillus fumigatus
  ref <308>: DATABASE ACCESSION NUMBER: ATCC 64746
actgtcttgattcaagaacttattaacaacattgctaaagcccatggtggttactctattttctgtggtgttggtgaacgtactcgtgaaggtaacgatttataccacgaaatgatggaaactggtgtcattaaacttgaaggtgactccaagtgtgctcttgtattcggtcaaatgaacgaacctcctggtgctcgtgcccgtgttgctttaactggtttaaccattgctgaatacttccgtgatgaagaaggtcaagatgtgttacttttcattgataacattttccgtttcactcaagctggttctgaagtatctgcccttttaggtcgtattccatctgctgtaggttaccaacccactttatctactgatatgggtggtatgcaagaacgtattactactaccaagaatggttccattacctctgtacargccgtctacgtccccgc

SEQ ID NO: 1640 - DNA, 783 bp, Bacillus mycoides
  ref <308>: DATABASE ACCESSION NUMBER: ATCC 6462
acgcccttacggtaaaacaaagcaacgaaaacggaagcatgaacttaacatttgaagttgcacttcatttaggtgatgatacagttcgtacagttgcgatgtcttccacagatggacttgttcgtggcacagaagtagaagatactggtaaagcaatctctgtaccagttggtgatgcaacacttggtcgtgtattcaacgtattaggtgatgcaattgacttagatggtgaacttcctgcggatgtacaccgtgatccaattcaccgtcaagcacctgcattcgaagaattatctactaaagtagaaattcttgaaactggtattaaagtagtagacttacttgctccttacattaagggtggtaagatcggcctattcggtggtgccggcgtaggtaaaacagtattaattcaagaattaattaacaacatcgcacaagagcacggtggtatctctgtattcgctggtgtaggtgagcgtactcgtgagggtaatgacttataccatgaaatgagcgattctggcgtaatcaagaaaactgcgatggtattcggacaaatgaatgagccacctggagcacgtcaacgtgttgcattaacaggtttaacaatggctgagcatttccgtgatgagcaaggacaagacgtacttctgttcatcgataacatcttccgtttcacgcaagcgggttctgaagtatctgcccttcttggtcgtatgccatctgcggtaggttaccaaccaacacttgcaacagaaatgggtcaattacaagagcgta

SEQ ID NO: 1641 - DNA, 823 bp, Bacillus mycoides
  NRRL NRS-319
atctacaacgcccttacggtaaaacaaagcaacgaaaacggagcaagcattaacttaacatttgaagttgcacttcatttaggtgatgacacagttcgtacagttgcaatgtcttccacagatggacttgttcgtggcacagaagtagaagatactggtaaagcaatctctgtaccagttggtgatgcaacacttggtcgtgtattcaacgtattaggtgatgcaattgacttagatggtgatgttcctgcggatgtacgtcgtgatccaattcaccgtcaagcacctgcattcgaagaactatctactaaagtagaaattcttgaaactggtattaaagtagtagacttacttgctccttacattaagggtggtaagatcggtctattcggtggtgccggtgtaggtaaaacagtattaattcaggaattaattaacaacatcgcacaagaacacggtggtatctctgtattcgctggtgtaggtgagcgtactcgtgagggtaacgacttataccatgaaatgagcgattctggcgtaattaagaaaactgcgatggtattcggacaaatgaatgagccacctggagcacgtcaacgtgttgcattaacaggtttaacaatggctgaacatttccgtgatgagcaaggacaagacgtactattgttcatcgataacatcttccgtttcacgcaagcaggttctgaagtatctgcccttcttggtcgtatgccatctgcggtaggttaccaaccaacacttgcaacagaaatgggtcaattacaagagcgtattacatctacaaataaaggatctatcacgt

SEQ ID NO: 1642 - DNA, 829 bp, Bacillus mycoides
  NRRL BD-15
gatggcggaaagctaccagaaatctacaacgcccttacggtaaaacaaagcaacgaaaacggagcaaacattaacttaacatttgaagttgcacttcatttaggtgatgatacagttcgtacagttgcgatgtcttccacagatggacttgttcgtggcacagaagtagaagatactggtaaagcaatctctgtaccagttggtgatgtaacacttggtcgtgtattcaacgtattaggtgatgcaattgacttagatggtgaagttcctgcggatgtacgtcgtgatccaattcaccgtcaagcacctgcattcgaagaattatctactaaagtagaaattcttgaaactggtattaaagtagtagacttacttgctccttacattaagggtggtaagattggtctattcggtggtgccggtgtaggtaaaacagtattaattcaggaattaattaacaacatcgcacaagaacacggtggtatctctgtattcgccggtgtaggtgagcgtactcgtgaaggtaacgacttataccacgaaatgagcgattctggcgtaattaagaaaactgcgatggtattcggacaaatgaacgagccacctggagcacgtcaacgtgttgcattaacaggtttaacaatggctgagcatttccgtgatgagcaaggacaagacgtactactgttcatcgataacatcttccgtttcacgcaagcaggttctgaagtatctgcccttcttggtcgtatgccatctgcggtaggttaccagccaacacttgcaacagaaatgggtcaattacaagagcgtattacatctacaaata

SEQ ID NO: 1643 - DNA, 823 bp, Bacillus pseudomycoides
  NRRL BD-10
aatctacaatgcccttacggtaaaacaaagcaacgaaaacggagcaagcattaacttaacatttgaagttgcacttcatttaggtgatgacacagttcgtacagttgcgatgtcttccacagatggacttgttcgtggcacagaagtagaagatactggtaaaccaatctctgtaccggttggtgatgcaacacttggtcgtgtatttaacgtattaggtgatgcaattgacttagatggtgaagttcctgcggatgtacgccgtgatccaattcaccgtcaagcacctgcgttcgaagagttatctacgaaagtagaaattcttgaaactggtattaaagtagtagacttacttgctccttacattaaaggtggtaaaatcggtctattcggtggtgccggtgtaggtaaaacagtattaatccaggaattaattaacaacatcgcacaagagcacggtggtatttctgtattcgctggtgtaggtgagcgtactcgtgaaggtaatgacttataccacgaaatgagcgattctggcgtaatcaagaaaacagcgatggtattcggacaaatgaacgagccacctggtgcacgtcaacgtgttgcattaacaggattaacaatggctgaacatttccgtgatgagcaaggacaagacgtactattgttcatcgataacatcttccgtttcacgcaagcgggttctgaagtatctgcccttcttggtcgtatgccatctgcggtaggttaccaaccaactcttgcaacagaaatgggtcaattacaagagcgtattacatctacaaataaaggatctatcacg

SEQ ID NO: 1644 - DNA, 708 bp, Bacillus pseudomycoides
  NRRL B-617
ggaaagctacctgaaatctacaatgcccttagaattaaacaagacgcagttaacttaactttagaagttgcacttcacttaggtgatgatacagttcgtacagttgcgatgtcttccacagacggacttgttcgtggtactgcagtagaagatactggcaaagcgatttctgttccagttggtgatgcaacacttggtcgtgtatttaacgtattaggtgatgcaattgacttagatggtgaggttccagcagatgtacgccgtgatccaattcaccgtcaagcacctgcattcgaagagttatctacaaaagtagaaattcttgaaactggtattaaagtagtagacttacttgctccttacattaaaggtggtaaaatcggtctattcggtggtgccggtgtaggtaaaacagtattaattcaggaattaattaacaacatcgcacaagagcacggtggtatctctgtattcgctggtgtaggtgagcgtactcgtgaaggtaacgacttataccatgaaatgagcgattctggcgtaatcaagaaaactgcgatggtattcggacaaatgaacgagccacctggtgcacgtcaacgtgttgcattaacaggtttaacaatggctgaacatttccgtgatgagcaaggacaagacgtactattgttcatcgataacatcttccgtttcacgcaagcgggttctgaa

SEQ ID NO: 1645 - DNA, 778 bp, Budvicia aquatica
  ref <308>: DATABASE ACCESSION NUMBER: ATCC 35567
gtacgatgcgcttgaagttcaaaacgatgtcaaactagtgctggaagttcaacagcagctcggtggtggtgtcgttcgttgtatcgctatgggtacctcagatggcctaagccgcggtctgaaagtacttgatttagaacaccctatcgaagttcctgtcggtgtggcaactctgggccgtattatgaacgtgcttggtgagcctatcgatatgaagggtgacattggtgaagaagagcgttgggctatccatcgcgctgcaccaagctacgaagatttatccagtgctaacgaactgctggaaacgggcatcaaggttatcgacctgatttgtccgtttgccaaaggcggtaaagttggtctgtttggtggtgccggcgtaggtaaaacggtaaacatgatggagctgattcgtaatattgcgactgagcactcaggttactctgtatttgccggcgttggtgagcgtactcgtgagggtaatgacttctaccacgaaatgacagaatctaacgtattagacaaagtatctctggtttatggccaaatgaatgagccaccgggaaaccgtctgcgcgttgcgttaaccggcctgaccatggcggaaaaattccgtgatgaaggccgtgacgttctgctgtttatcgataacatttatcgttataccttagccggtacagaagtatcagcactgttaggtcgtatgccatcagcggtaggttaccaaccaacgctggcggaagagatgggtacactgcaagaacgtatcacytcaacc

SEQ ID NO: 1646 - DNA, 806 bp, Buttiauxella agrestis
  ref <308>: DATABASE ACCESSION NUMBER: ATCC 33320
gatgccgtaccaaaagtgtacgacgctcttgaggttacaaatggtaaagaccgtctggtgctggaagttcagcaacagttaggtggtggcgtagtgcgtactatcgccatgggtacttctgatggtttgcgtcgtggtctggaagtttctaacctcgatcacccaattgaagtgccagtaggtaaagcaactctgggccgtatcatgaacgtcctgggcgagcctatcgacatgaaaggcgatatcggcgaagaagagcgttgggcgattcaccgtgctgctcctagctacgaagaactgtctagctcccaggatctgctggaaaccggcatcaaagtaatggacctgatttgcccgttcgctaagggtggtaaagtcggtctgttcggtggtgcgggtgtgggtaaaactgtaaacatgatggagctgatccgtaacatcgcgatcgagcactccggttactcagtgtttgcaggcgtgggggaacgtactcgtgagggtaacgacttctaccatgaaatgaccgattccaacgttctggacaaagtatcactggtttatggccagatgaacgagccaccaggtaaccgtctgcgcgttgcgttgaccggtctgaccatggctgagaagttccgtgacgaaggtcgtgacgttctgctgttcgttgataacatttaccgttataccctggccggtacagaagtatctgcgctgctgggtcgtatgccatctgcggtaggttaccagccaactctggcagaagagatgggtgttttgcaggagcgtattacctccaccaaaactgg

SEQ ID NO: 1647 - DNA, 1122 bp, Candida norvegica
  ref <308>: DATABASE ACCESSION NUMBER: ATCC 36586
gaaaccgttgttgacactggttccccaatcaccgtcccagttggtcgtgaaaccttgggtcgtatcattaacgttatcggtgaaccaatcgatgaacgtggtccaatcaacaccaagcaaagaaacccaatccatgctgatcctccttcatttgctgaacaatccacttctgctgaagttttagaaaccggtattaaagttgtcgatttattggctccttatgccagaggtggtaaaattggtttattcggtggtgccggtgtcggtaaaaccgtctttatccaagaattgattaacaacattgctaaagctcatggtggtttctcagtcttcaccggtgtcggtgaaagaaccagagaaggtaacgatttataccgtgaaatgaaagaaaccggtgtcattaacttggaaggtgactctaaagtcgctttagtcttcggtcaaatgaacgaacctccaggtgctagagcccgtgttgccttaaccggtctaaccattgctgaatacttcagagatgaagaaggtcaagatgtcttgttattcgttgataacattttcagattcacccaagctggttcagaagtctctgccttattaggtcgtattccatctgctgtcggttatcaaccaaccttggccactgatatgggtttgttgcaagaacgtatcaccaccaccagaaaaggttccgtcacttctgtccaagctgtttatgtcccagctgatgatttgactgatcctgccccagccaccactttcgcgcatttggatgctactactgtcttgtctcgtggtatctcagaattgggtatctacccagctgtcgatccattggattccaaatcaagattattagatgccgctgttgttggtcaagaacattacgatgttgctactcaagttcaacaaactttacaagcctacaaatctttacaagatattatcgctattttaggtatggatgaattatcagaacaagataaattgaccgttgaaagagctagaaagatccaacgtttcttatctcaaccatttgctgtcgctgaagttttcactggtattccaggtagattagttagattgaaagaaaccgttgcttcattcagagacgttttagctggt

SEQ ID NO: 1648 - DNA, 813 bp, Streptococcus pneumoniae
  ref <308>: DATABASE ACCESSION NUMBER: ATCC 700677
tacgtctcttaccctgacgatgatttgcaagtcgcatctacggtcgtagatgtttcaaatggtaaagtcatcgcccaacttggagctcgtcaccaagcaagtaacgtttcatttggtaccaaccaagctgtggaaaccaatcgtgactggggatcaactatgaaaccaatcacagactatgctcctgccttggagtacggtgtctacgattcaactgctactatcgttcacgatgagccctataactaccctgggacagatatccctctctataactgggatcgagcatatttcggtaatattactctgcaatatgcccttcaacaatctcgtaacgtacctgccgttgaaacactaaacaaggtcggtctagataaggctaaaaccttccttaatggtcttggtatcgactatccaagcatgcattatgcaaacgccatttcaagtaatacaactgaatccaacaaaaaatatggtgcaagtagtgaaaaaatagctaccgcctatgccgcattcgcaaatggtggtatttaccacaaaccaatgtacatcaataaagttgtctttagcgatggtagcgaaaaagaattttctgaccctggcacaagagccatgaaagaaacgactgcttacatgatgacagaaatgatgaaaacagtctggacgtacggaactggtcgtggtgcctacctgccttggcttcctcaagctggtaaaacaggtacctctaactatactgacgaagaaattgaaaagtatatcaagaacactggttacgtagctccagatgaaatgtttgtgggttatacccgt

SEQ ID NO: 1649 - DNA, 813 bp, Campylobacter lari
  ref <308>: DATABASE ACCESSION NUMBER: ATCC 43675
attaatgaagctattgttgttaattatgaattagaaggaaaagaatgcaagctagttcttgaagtagctgcacatttaggcgataataaagtaagaaccatcgctatggatatgacagatggtcttgttagaggtttaacagccgtcgcaactggaaatccaattagtgttccagtaggcgaaaaagttcttggaagaatttttaatgtaacgggtgatttgattgatgagggcgaagaaatcaattttgataagcactggtcaattcatagagatccacctccatttgaagaacaaagtacaaaaagcgaaatctttgaaacaggtataaaggttgttgatttgctagctccttatgctaaaggtggaaaagttggtctttttggtggtgcaggtgttggtaaaaccgttattattatggaattaattcacaatgttgcatttaaacatagcggatattctgtttttgcaggtgttggcgaaagaactcgtgagggtaatgacctttacaatgaaatgaaagaaagtaatgtattagataaagttgcattgtgttatggtcaaatgaatgaaccaccaggggcaagaaatcgtatagctttaacaggtcttactatggctgagtattttagagatgaaatgggacttgatgttttaatgattattgataatattttcagattttctcaatcaggctcagaaatgtcagcacttttaggaagaattccttcagctgttggttatcaaccaaccttagctagtgaaatgggtaagttccaagaaagaattacttcaaccaagaaaggatctatt

SEQ ID NO: 1650 - DNA, 570 bp, Coccidioides immitis
  strain WSA-222
ggtggggaagactgtgttcattcaggaattgattgtaagttctgttatcaactaaagccgacagcggttgctgatatgctctagaacaacattgctaaggctcacggtggttactccgtgttcactggtgtcggtgagcgtacccgtgagggtaacgatttgtaccatgaaatgcaagagacccgtgtcattcaactcgacggagagtccaaggtcgctcttgtcttcggtcaaatgaacgagccccctggtgcccgtgcccgtgttgcccttaccggtttgaccattgctgaatacttccgtgacgaggaaggccaagacggtaggcttcatgcttctatcgctaggggcgtgtgatacaggaggctaatcgcttttctagtgcttctctttattgacaacattttccgtttcactcaagctggttctgaagtgtctgccttgctcggtcgtattccttccgctgtcggttaccaacctactctcgccgtcgacatgggtgttatgcaggaacgtatcaccaccaccaccaagggatccattacttcagtgcargccgtctacgtcccc

SEQ ID NO: 1651 - DNA, 560 bp, Emmonsia parva
  ref <308>: DATABASE ACCESSION NUMBER: ATCC 10784
tgtcttcatccaggagttaattgtacgttttttgtctgcctactataatagacgaagaaatattttgatttatttttctaataattcaaatagaacaacattgccaaagcccacggtggttactctgtcttcactggtgttggcgagcggacccgtgaaggaaacgatctgtaccacgaaatgcaggagacccgtgtcatccagctcgatggcgagtccaaggtcgccctcgtcttcggtcaaatgaacgaaccccccggagcccgtgcccgtgttgccctcactggtctgaccgttgctgaatacttccgtgacgaggaaggtcaagatggtgcgtatatatatattcgccagtaatttgactcgaagctccactcacacatatattagtgctcctcttcatcgacaacattttccgcttcacccaggcaggttccgaagtgtccgccctgctcggccgtatcccctccgccgtcggttaccagcccaccctcgctgtcgacatgggtatgatgcaggaacgtatcaccaccaccaccaagggctccatcacctccgtg

SEQ ID NO: 1652 - DNA, 780 bp, Erwinia amylovora
  ref <308>: DATABASE ACCESSION NUMBER: ATCC 14976
ccacaagtgtacagcgcccttgaggttaaaaatggtgatgctcgtctggtgctggaagttcagcagcagctgggcggtggcgtggttcgtaccatcgccatgggttcttcagacggccttaagcgtggtctggaagccgttgaccttcagcacccaattgaagtaccggtaggtactgccacacttggccgtatcatgaacgtgctgggtgagccgatcgatatgaaaggcgacattggcgaagaagagcgctgggcgattcaccgctctgcaccttcttacgaagatcagtcgaactctcaggatctgctggaaaccggcatcaaggtgattgacctgatgtgtccgttcgccaagggcggtaaagtcggcttgttcggtggtgcgggcgtaggtaaaaccgtcaacatgatggagcttattcgtaacattgcggctgagcactcaggtttctcggtatttgccggtgtgggtgagcgtacccgtgaaggtaacgacttctaccacgaaatgaccgactccaacgttatcgacaaagtttcgctggtctatggtcagatgaacgagccaccgggtaaccgtctgcgcgttgcgctgaccggtctgaccatggcggagaagttccgtgacgaaggtcgtgacgtactgctgtttatcgataacatctatcgttacaccctggccggtactgaagtctccgctctgctgggtcgtatgccttctgcggtaggttaccagccaacgctggcggaagagatgggcgttctgcaggaacgtatc

SEQ ID NO: 1653 - DNA, 545 bp, Fonsecaea pedrosoi
  ref <308>: DATABASE ACCESSION NUMBER: ATCC 18831
tgtgttcattcaggagctgattgtgagtaccccggagattttcctgcgattgcgcatgaagcaagcgctgacgtccatctagaacaacatcgccaaggctcacggtggttactccgtgttctgcggtgtcggcgagcgtactcgtgagggtaacgatttgtaccacgaaatgcaggagaccggtgtcatcaacctcgagggcgagtccaaggtcgcccttgtcttcggtcagatgaacgagcccccgggagcccgtgcccgtgtcgcccttactggtcttaccgtcgctgagtaagttttgacaaccagaagcgagtattgccacaattactgactaaaaatcaagatatttccgtgacgaggagggccaggatgtgcttctcttcattgacaacattttccgtttcacccaggccggttctgaggtgtccgctcttctcggccgtattccctctgccgtcggttaccagcccactctcgccgtcgacatgggtatgatgcaggagcgtatcaccaccacccagaagggttccatcacttccgtc

SEQ ID NO: 1654 - DNA, 564 bp, Fusarium moniliforme
  strain WSA-213
tgtgtttattcaggagctcatcaacaacatcgccaaggcccacggtggttactctgtcttcactggtgtcggtgagcgaacccgtgagggtaacgatctgtaccacgaaatgcaggagacttccgttattcagcttgatggcgagtccaaggttgccctggttttcggtcagatgaacgagccccctggagctcgtgcccgtgtcgctcttaccgggtaagttgatagatagtgccttcccttcctgtttcaacacctcaacaccaccactccccaagacattgctactcatactgcaccatgatattatatttacgcctcttggacgctagctaatgttgtatcgacagtttgactgttgctgagtacttcagagacgaggagggtcaggacgtgctgcttttcattgacaacattttccgattcactcaggccggttccgaggtgtctgcccttctcggtcgtatcccctctgccgtcggttaccagcccactctggccgtcgacatgggtggtatgcaggagcgtattaccaccaccaccaagggttccattacctcagtc

SEQ ID NO: 1655 - DNA, 776 bp, Klebsiella oxytoca
  ref <308>: DATABASE ACCESSION NUMBER: ATCC 13182
cgtaccgcgcgtgtacgaggctcttgaggtacaaaatggtagtgagaatctggtgctggaagttcagcagcagctcggcggcggtattgttcgtaccatcgccatgggttcttccgacggtctgcgtcgcggtctggaagtcaaagacctcgagcatccgatcgaagtcccggtaggtaaagcaacgctgggtcgtatcatgaacgtactgggccaaccggtagacatgaaaggcgacatcggcgaagaagagcgttgggcgattcaccgcgcagcgccttcctacgaagagttgtcaaactctcaggaactgctggaaaccggcatcaaagttatcgacctgatgtgtccgtttgcgaagggcggtaaagttggtctgttcggtggtgcgggtgtaggtaaaaccgtaaacatgatggagctgatccgtaacatcgcgatcgagcactccggttactccgtgtttgcgggcgtaggtgaacgtactcgtgagggtaacgacttctaccacgaaatgaccgactccaacgttatcgataaagtatccctggtgtatggccagatgaacgagccgccgggaaaccgtctgcgcgttgcgctgaccggcctgaccatggctgagaagttccgtgacgaaggtcgtgacgttctgctgttcgtcgataacatctatcgttacaccctggccggtactgaagtatccgcactgctgggtcgtatgccttcagcggtaggttaccagccgactctggcggaagagatgggcgttctgcagg

SEQ ID NO: 1656 - DNA, 572 bp, Microsporum audouinii
  ref <308>: DATABASE ACCESSION NUMBER: ATCC 11347
gtgttcatccaggagttgattgtaagtgattatattcccctagaaagaaatgttttgaacaaaagtctcgaattagaaaattcttttcagatactaatttactatagaacaacattgccaaggctcacggtggttactccgtcttcaccggtgtcggagagcgaacccgtgaaggaaacgatctgtaccatgaaatgcaggaaactcgtgtcatccaacttgatggcgagtccaaggtcgccctggtcttcggtcagatgaacgagcccccaggtgcccgtgcccgtgttgctcttactggtttgaccattgctgagtacttccgtgatgaggaaggtcaagacggtatgttctttaaattagatatcttctggagaaacagcgtctaacaaattcttccagtgcttctcttcatcgacaacatcttccgtttcactcaggctggttccgaagtgtctgccctgcttggtcgtattccatctgccgtcggttaccaacccactcttgccgtcgacatgggtggtatgcaggaacgtattaccaccaccaagaagggatccattacctccgtc

SEQ ID NO: 1657 - DNA, 790 bp, Obesumbacterium proteus
  ref <308>: DATABASE ACCESSION NUMBER: ATCC 12841
gcctaaagtgtataacgcacttgaggtgaaaggcggtgccactaaactggtactggaagttcagcagcagctaggcggcggcgttgtacgctgtatcgctatgggtacttctgacggtctgcgtcgcggactggacgttgttgacctggagcacccgattgaagtcccagtaggtaaagcgaccttaggccgcattatgaacgtactgggtgagccaattgatatgaagggtgatatcggcgaagaagatcgctgggctattcaccgtgaagctccaagctacgaagaactgtctaactcgcaagaactgctggaaaccggtatcaaggtaatggacttgatttgtccgttcgctaagggcggtaaagtcggtctgttcggtggtgcgggtgttggtaaaacagtaaacatgatggagctgatccgtaacatcgcgatcgagcactcaggttactctgtatttgccggcgtgggtgaacgtactcgtgagggtaacgacttctaccacgaaatgaccgactccaacgtattggacaaagtatcactggtttatggccagatgaacgagccaccaggaaaccgtctgcgcgttgcgctgaccggtctgactatggctgagaagttccgtgacgaaggtcgtgacgtactgctgttcatcgataacatctaccgttataccttggccggtaccgaagtatctgcactgctgggtcgtatgccttctgcggtaggttatcagccaacgctggcggaagagatgggtgttctgcaagaacgtatcacctctacc

SEQ ID NO: 1658 - DNA, 622 bp, Paracoccidioides brasiliensis
  ref <308>: DATABASE ACCESSION NUMBER: ATCC 200443
tgtcttcattcaggagcttatcaacaacatcgccaaggcccacggtggttactccgtcttcactggtgtgggagagcgcactcgtgagggaaacgacttgtatcacgagatgcaagagacttccgttatccagctcgaaggcgaatccaaggttgccctcgtcttcggtcaaatgaacgagcctccgggtgctcgtgctcgtgttgctctcaccggtcgtaagtgctccttcccagatttctcttccccagtttctggacccactttttccttccaccaccattctactgggtaggaccaagatagcactgcctattctggtgccttcctaccgcctactctactgcctattccaccaccttttctaccgcctcttctacttgctattgtatactaacttactcaaacagttactattgctgagtacttccgtgacgctgagggccaggatgtgcttctcttcatcgacaacattttccgtttcacccaggccggttccgaggtgtccgctcttctcggtcgtatcccctccgccgtcggttaccagcccacccttgccgtcgacatgggtggtatgcaggagcgtatcaccaccaccaagaagggatccattacctccgtc

SEQ ID NO: 1659 - DNA, 794 bp, Plesiomonas shigelloides
  ref <308>: DATABASE ACCESSION NUMBER: ATCC 14029
gacgctgtacctcaggtgtacgatgcactgacagttgagggtgctgagctggtactggaagtgcagcagcagctgggtggtggtgttgttcgctgtatcgcgatgggtgcctctgatggcctcaagcgcggtctgaaagcgcacaatactggtgctcctatcactgtaccggtgggtgtggaaacactgggccggatcatggatgtgttgggtaacccgattgaccagaaaggtccaatcggtgaacaagatcgctgggtgatccaccgtgaagcaccaagctacgaagatcaggctaacagcactgaactgctggaaaccggtatcaaggttatcgacctggtatgcccgtttgcgaaaggcggtaaagtcggtctgttcggtggtgccggtgtaggtaaaaccgtaaacatgatggagctgatccgtaacatcgcgatcgagcactccggttattccgtgtttgcgggcgtgggtgagcgtacccgtgaaggtaacgacttctaccacgaaatgacagactccaacgtactggacaaagtatccctggtgtacggtcagatgaacgagccgccaggtaaccgtctgcgcgtagcactgaccggcctgaccattgcggagaaattccgtgatgaaggtcgtgacgtactgctgttcatcgataacatctaccgttataccctggcggggaccgaagtatcggcactgctgggccgtatgccttctgcggtaggttatcagccaacgctggcggaagagatgggtgtactgcaagagcgtattacctctacccg

SEQ ID NO: 1660 - DNA, 799 bp, Shewanella putrefaciens
  ref <308>: DATABASE ACCESSION NUMBER: ATCC 8071
aggtatatgacgctstgaagatcacaggtgaaggcgcctgtaatggtttggtgctggaagttcagcaacagctaggcggtggtgtagttcgtactatcgctatgggttcttctgatggtctgcgtcgtggtcttgaggttgttaactcaggttcacctatttctgttcctgttggtaccgccacgcttggccgtatcatgaacgtattaggtgagcctattgatgaagcgggtccaatcggtgaagaagagcgttatgttattcaccgtgcagcaccttcatatgaagatcaatcgaacactactgaactgttagagacaggtatcaaggttattgaccttgtttgtccattcgctaagggtggtaaagtaggtctgttcggtggtgcgggtgttggtaaaacagttaacatgatggaactgattaacaacatcgctaaagctcactcgggtctttcggtgttcgccggtgtgggtgaacgtactcgtgaaggtaacgacttctactacgagatgaaagattctggcgttctcgacaaagtggccatggtttatggtcagatgaacgagccaccaggaaaccgtttacgcgtagcactgtcaggtctgacaatggctgagaagttccgtgacgaaggtcgtgacgtattgttgttcgttgacaacatctaccgttataccttagccggtactgaagtatctgcactgttaggccgtatgccttctgcggtaggttatcaaccaacattggctgaagaaatgggcgttctgcaagagcgtattacttcaactaagacggg

SEQ ID NO: 1661 - DNA, 18 bp, Artificial Sequence
  Synthetic DNA Sequence
tgggaagcgaaaatcctg

SEQ ID NO: 1662 - DNA, 774 bp, Campylobacter curvus
  ref <308>: DATABASE ACCESSION NUMBER: ATCC 35224
ctatgcctcaaactagagagcatatcttgctatctcgccaagtaggcgttccatatatcgttgtatttatgaacaaagccgatatggtcgatgacgctgagcttcttgagctagtcgagatggaaattcgcgagcttcttaacgagtacaacttccctggcgatgatactcctatcatatcaggttctgctcttaaagccctcgaagaggctaaagcaggcgttgatggcgagtggtcagcaaaagttcttgagcttatggataaagtcgatgagtatatcccaactccagttcgtgctaccgataaagacttcctgatgcctatcgaagacgttttctctatctcaggtcgtggaacggtcgttactggtaggatcgaaaaaggtgtcgtaaaagttggcgatactatcgagatcgttggtatcaaacctactcaaactacgacagttactggcgttgagatgtttaggaaagagatggaacaaggcgaggccggtgataacgtaggtgttcttttaagaggtactaaaaaagaagacgtcgagcgcggcatggttctttgtaagccaaaatcaatcactcctcatacaaaatttgagggtgaggtttatatcctaacaaaagaggaaggcggacgccacactccattctttaacaactatagaccacaattttatgtaagaacaacagacgttacaggttctatcacacttccagaaggaactgagatggttatgcctggagataatgtcagaatttccgttgaactcatcg

SEQ ID NO: 1663 - DNA, 791 bp, Campylobacter rectus
  ref <308>: DATABASE ACCESSION NUMBER: ATCC 33238
ttctgcggctgacggcccaatgccacaaactagagagcacatcttgctatctcgccaagtaggcgttccgtatatcgttgtttttatgaacaaagccgatatggtcgatgatgccgagcttcttgagctggttgagatggagattcgcgagcttctaaacgagtatgatttccctggtgacgatactccaatcgtagcaggctctgctcttcaagctcttaatgaagccaaagccggaacagaaggcgagtggtctgcaaaaattcttgagcttatggctaaagttgacgagtatatcccgactccggttcgtgcaacggataaagacttcttgatgcctattgaggacgttttctctatctccggtcgcggcaccgtcgttaccggcagaatcgaaaaaggtatcgtaaaagtcggtgatactatcgagatcgtaggtatccgcgatactcaaacaactaccgttaccggcgttgagatgttcagaaaagagatggatcaaggcgaagcgggcgataacgtaggcgttcttctaagaggcactaaaaaagaagacgttgagcgcggtatggttctttgcaaacctaaatcaatcactcctcacactaaatttgagggagaggtttatatcttaactaaagaggaaggcggacgccatactccattctttaataactatagaccgcagttttatgtaagaactaccgacgttaccggttctatcactcttccggaaggaacagagatggttatgcctggcgataacttaaagataagcgttgagcttatcg

SEQ ID NO: 1664 - DNA, 810 bp, Fonsecaea pedrosoi
  ref <308>: DATABASE ACCESSION NUMBER: ATCC 18831
cgacggacagatgccccagaccagggagcacttgctcctcgcccgccaggtcggtgtcaagcgcattgtcgtcttcgtcaacaaggtcgatgccattgaggacaaggagatgttggagctcgtcgagatggagatgcgtgagcttctctccagctacggcttcgagggtgacgacactcccatcgtcatgggttccgccctttgcgccattgagggccgcgagcccgacattggtgtcgagaagattgacgagctcctcgagcacgtcgacacctggatccccacccccgagcgtgacatcgccaagcctttcctcatgtccgttgaggacgtcttctccattcccggccgtggtaccgtcgcttctggccgtgtcgagcgtggtgtcctgaagaaggattccgaagtcgagcttgtcggcaagaacaagaaccccatcaagaccaaggttaccgacatcgagaccttcaagaagtcttgcgacgagtcccgcgctggtgacaactccggtctccttctccgtggtgtcaagcgtgacgatgtcctccgtggcatggtcgttgtccagcccggcaccaccaaggcccacaagaagttccttgcctccatgtacgtcctcaccaaggaggagggtggccgccacactggtttcgccaacaactacaagccccagatgttcatccgtaccgccgatgaggccgccactcttacctggcccgagggtaccgaggaggacaagatggtcatgcccggtgacaatgtcgagatgatctgcgagatccacaagcccattgccgtcgagcaaggcca

SEQ ID NO: 1665 - DNA, 19 bp, Artificial Sequence
  Synthetic DNA Sequence
cagtacaggtagacttctg

SEQ ID NO: 1666 - DNA, 888 bp, Microsporum audouinii
  ref <308>: DATABASE ACCESSION NUMBER: ATCC 11347
atgattgcgaaacctacttgctgtggaagaatttggatattctaacatttctctaggcctcaaaccagagagcatctgctccttgcccgccaggtcggtgttcagaagctcgtcgttttcgttaacaaggtcgacgctgttgaggacccagagatgttggaacttgtcgagctagagatgcgtgagctgctcagccactatggtttcgagggtgaggagaccccaatcatttttggctctgctctctgcgcccttgaatctcgacgaccagaattgggtgttgagaagatcgatgagctattgaacgctgtggatacctggattcccaccccagagcgtgccactgataagcctttccttatgtccattgaggaagttttctccatctctggtcgtggtaccgtcgtttccggtcgtgtcgagcgtggtatcctcaagaaggactctgatgtcgaaattgtgggtggatctgatacacccatcaagacgaaggtcaccgacattgaaaccttcaagaagtcttgtgacgaatcccgagctggtgacaactccggtctacttctccgaggtgtcaagcgtgaggacttgagacgtggaatggttgttgctgctcccggatcgaccaaggctcataccgacttcatggtctccctttatgttctgaccgaggctgagggtggccgttccaatggattcacccacaagtaccgcccacagatgttcatccgtactgccggtatgtaaaccctttttctaccattcactttgtttcaccactgacttgtatactttaccgcagacgaagccgcatctttcagctggcctggagaggatcaagacaagaaggccatgcctggtgacaatgtcgagatgatttgcaagaccctc

SEQ ID NO: 1667 - DNA, 793 bp, Piedraia hortai
  ref <308>: DATABASE ACCESSION NUMBER: ATCC 24292
atgccgcagacccgcgagcacttgctgctcgcccgtcaggtcggtgtccagaagatcgttgttttcgtcaacaaggttgatgctatcgacgacccggagatgctggagcttgtcgagatggagatgcgtgaacttctcagcacatacggtttcgagggtgacgagacccctgttattatgggctccgcgctcatggctctcaacaaccagcgccccgagattggtcaacagaagattgatgaactcatggccgctgtcgacgagtggatccctactccccagcgtgacctcgacaagcctttcctgatgtctgttgaggatgtcttctccattgctggccgtggtaccgttgtgtccggccgtgtggagcgcggtaccctcaagcgtgatgaggaagtcgagcttgtcggcaagggtgtcgaccccatcaagaccaaggtcaccgatatcgagactttcaagaagtcctgcgaggaggctcaggctggtgacaactctggtcttctgatccgtggtgtccgccgcgaggatgttcgtcgcggtatggttgtctccaagcccggcaccgtcaagtctcacactcagttcctggcctcgctttacgttctcaccaaggaggagggtggtcgccacactggtttcggcgagcactaccgtccccagctctacctccgtacctcagacgagtctgtcgatctgaccttccccgagggaactgaggatcaccactccaagatcgtcatgcctggtgacaacatcgagatggtcgtcacgatgactcacgccaacgcta

SEQ ID NO: 1668 - DNA, 891 bp, Escherichia coli
  strain K-12 KL1699
aacatgatcaccggtgctgcgcagatggacggcgcgatcctggtagttgctgcgactgacggcccgatgccgcagactcgtgagcacatcctgctgggtcgtcaggtaggcgttccgtacatcatcgtgttcctgaacaaatgcgacatggttgatgacgaagagctgctggaactggttgaaatggaagttcgtgaacttctgtctcagtacgacttcccgggcgacgacactccgatcgttcgtggttctgctctgaaagcgctggaaggcgacgcagagtgggaagcgaaaatcctggaactggctggcttcctggattcttacattccggaaccagagcgtgcgattgacaagccgttcctgctgccgatcgaagacgtattctccatctccggtcgtggtaccgttgttaccggtcgtgtagaacgcggtatcatcaaagttggtgaagaagttgaaatcgttggtatcaaagagactcagaagtctacctgtactggcgttgaaatgttccgcaaactgctggacgaaggccgtgctggtgagaacgtaggtgttctgctgcgtggtatcaaacgtgaagaaatcgaacgtggtcaggtactggctaagccgggcaccatcaagccgcacaccaagttcgaatctgaagtgtacattctgtccaaagatgaaggcggccgtcatactccgttcttcaaaggctaccgtccgcagttctacttccgtactactgacgtgactggtaccatcgaactgccggaaggcgtagagatggtaatgccgggcgacaacatcaaaatggttgttaccctgatccacccgatcgcgatggacgacggtctgcgtttcgcaatccgtgaaggcggccgtaccgttggcgcgggc

SEQ ID NO: 1669 - DNA, 805 bp, Saksenaea vasiformis
  ref <308>: DATABASE ACCESSION NUMBER: ATCC 60625
tcctcgtggtcgccgccaccgacggcccgatgccgcagaccaaggagcacgtgctcctggcccgccaggtcggcgttccgtacatcgtcgtcgccctcaacaaggccgacatggtggacgacgaggagatcctggagctcgtcgagctcgaggtccgtgagctcctctccgagtacgagttcccgggcgacgacgttcccgtcgtcaaggtctccgctctgaaggccctcgagggcgacaaggagtggggcaactcggttctcgagctcatgaacgccgtcgacacggcgatccccgagcccgagcgtgacgtcgacaagccgttcctcatgccgatcgaggacgtcttcacgatcaccggtcgcggtacggtcgtcaccggccgtatcgagcgtggtgtcctgaaggtcaacgagaccgtcgacatcatcggcatcaagaccgagaagaccaccaccacggtcaccggcatcgagatgttccggaagctcctcgacgagggccaggccggtgagaacgtcggtctgctcctccgtggcatcaagcgcgaggacgtcgagcgcggccaggtcatcatcaagccgggctcggtcacgccgcacacggagttcgaggcgcaggcctacatcctgtccaaggacgagggtggccgccacacgccgttcttcaacaactaccgcccgcagttctacttccgtacgacggacgtgaccggcgtggtgaccctccccgagggcaccgagatggtcatgccgggtgacaacaccgagatgaaggtggagctcatccagcccgtcgccatgga

SEQ ID NO: 1670 - DNA, 935 bp, Trichophyton tonsurans
  ref <308>: DATABASE ACCESSION NUMBER: ATCC 56185
gcttctgacggtcaaatgtaattgaatgcccgcccagacagatgaaaggatttgacgtttctaacatcagtctaggcctcagaccagagaacatttgctccttgcccgccaggtcggtgtccagaagctggtcgttttcgttaacaaggtcgatgccgttgaggacccagagatgttggagcttgtcgaacttgaaatgcgtgaactcctcagccactacggtttcgagggtgaggagacccccatcatttttggctctgctctctgtgccctcgagtcccgtcgacctgagcttggtgtcgagaagattgacgagctattgaacgccgtcgacacctggatccccaccccagagcgcgccactgataagcctttcctcatgtccattgaggaagtgttctctatctctggtcgtggtaccgtcgtctccggtcgtgttgagcgtggtatcctcaagaaggattcggacgtcgaaattgttggtggctctaccacccctatcaagaccaaggtcaccgatatcgaaaccttcaagaagtcctgcgatgaatctcgagctggtgacaactctggtctccttctccgaggtatcaagcgtgaggacttgaagcgtggaatggttgttgctgcccccggatccaccaaggctcacaccgacttcatggtctccctctacgtcctgactgaggctgagggtggtcgttccaacggcttcacccacaagtaccgcccccaaatgttcatccgtactgctggtatgtaacccaagtttccgctatttactaagtagatcattgctaacttgtatttccttccgtagacgaagccgcatctttcagctggcctggagaagaccaagacaagaaggctatgcctggtgacaacgtcgagatgatttgcaagaccctccaccccattgctgccgaggctggcca

SEQ ID NO: 1671 - DNA, 772 bp, Enterobacter aerogenes
  ref <308>: DATABASE ACCESSION NUMBER: ATCC 13048
acgatgcccttgaggtacagaatggtaatgagagcctggtgctggaagttcagcagcagctcggcggtggcgtagtccgtgctatcgccatgggttcttccgacggtctgcgtcgtggtctggaagttaaagaccttgagcacccgatcgaagtcccggtaggtaaagcgactctgggccgtatcatgaacgtcctgggtcagccgatcgacatgaaaggcgacatcggcgaagaagaacgttgggctatccaccgcgcggcgccttcctatgaagagctgtccagctctcaggaactgctggaaaccggcatcaaagttatcgacttgatgtgtccgttcgctaagggcggtaaagttggtctgttcggtggtgcgggtgtaggtaaaaccgtaaacatgatggagctgatccgtaacatcgcgatcgagcactccggttactccgtgtttgcgggcgttggtgagcgtactcgtgagggtaacgacttctatcacgaaatgaccgactccaacgttctggataaagtatccctggtttacggccagatgaacgagccgccgggaaaccgtctgcgcgttgcgctgaccggcctgaccatggctgagaaattccgtgacgaaggtcgtgacgttctgctgttcgtcgataacatctatcgttacaccctggccggtactgaagtatctgcactgctgggccgtatgccttcagcggtaggttatcagccgactctggcggaagagatgggcgttctgcaggaacgtatcac

SEQ ID NO: 1672 - DNA, 1401 bp, Bordetella pertussis
  strain Tohama 1
atgagcaacggaaccatcgttcagtgcatcggcgccgtggtggatattcagttcccccgcgataacatgcccaagatctacgaagcgctcaccctggtcgacgagggttcctcgttcgccgagaagggcttgacgctggaagtgcaacaacagctgggcgacggcgtggtgcgtaccatcgcgctgggttccagcgacgggctgcgccgcggcatgcaagtggccggcaccggcgcaccgatctcggtgcccgtgggccacggcaccctgggccgcatcatggacgtgctgggccgtcccatcgacgaagccggtcccatcgcctccgacgagaagcgcgccatccaccagcccgcgccccgtttcgacgagctgtcgccgtcggtcgagctgctggaaaccggcatcaaggttatcgacctggtgtgcccgttcgccaagggcggcaaggtcggcctgttcggcggcgccggcgtgggcaagaccgtcaacatgatggaactgatcaacaacatcgccaagcagcacagcggcttgtcggtgttcgccggcgtgggcgagcgtacccgcgaaggcaacgacttctaccacgaaatggaagagtcgaacgttctggacaaggtggccatggtgttcggccagatgaacgagcccccgggcaaccgcctgcgcgtggcgctgaccggcctgaccatggccgagaagttccgcgacgaaggccgtgacatcctgttcttcgtcgacaacatctaccgctacaccctggccggtaccgaagtgtcggcgctgctgggccgtatgccgtcggcggtgggctaccagcctacgctggccgaggaaatgggcgtgctgcaagagcgcatcacctcgaccaagaccggttcgatcacctcgatccaggccgtgtacgtgcctgccgacgacttgaccgacccgtcgcccgccacgaccttccagcacttggactcgaccgtcgtgctgtcgcgtgacatcgctgcgctgggcatctatcccgccgtggacccgctggattcctccagccgccagctcgacccgcaagtcgtgggcgaagagcactaccaggtggcccgtggcgtgcagcagacgctgcagcgctacaaggaactgcgcgacatcatcgcgattctgggcatggacgaactgtcgccggaagacaagcaggccgtggcccgcgcgcgcaagatccagcgcttcctgtcgcagcccttctacgtggccgaagtgttcaccggctcgccgggcaagtacgtgtcgctggccgaaacgatccgtggcttcaagatgatcgtcgacggcgagtgcgacgcgctgcccgagcaggcgttctacatggtcggcacgatcgacgaggccttcgagaaggccaagaaactccaataa

SEQ ID NO: 1673 - DNA, 797 bp, Arcanobacterium haemolyticum
  ref <308>: DATABASE ACCESSION NUMBER: ATCC 9345
cagctaccgacggtccaatggctcagacccgcgagcacgttcttcttgctcgccaggttggcgttccacagatcatcgttgctctcaacaaggctgacatggttgacgacgaggaaatcctcgaactcgtcgaaatggaagttcgtgagcttctctcttcccaggagtacccaggtgacgacctcccagtcgtcaagatctcggcactcaaggctctcgaaggcgatgccgaatggagcaaggcaatcgaagatctcatggaagctgtcgatacctacttcgacgatccagtgcgtgacctcgataagccattcctcatgccaatcgaagacgtcttcaccatcaccggtcgtggcaccgttgttaccggccgtgcagagcgcggtatgctcaacttgaacgaagaagttgaaatcctcggtatccgtgcaccacagaagacaaccgttaccggtatcgaaatgttccacaagtcgatggatcacgcagatgcaggcgaaaactgtggtcttctcctccgtggcaccaagcgcgaagatgttgaacgtggtcaggttgttgccaagccaggcaccatcaccccacacaccaacttcgaagctcaggtctacgtgctcggtaaggaagaaggtggccgtcacaacccattcttctccaactaccgtccacagttctacttccgtaccacggatgttaccggcgtgatcacccttccagagggcaccgaaatggttatgccaggcgacaacaccgacatgacagttgagctcatccagccaatcgctatggaagagggc

SEQ ID NO: 1674 - DNA, 785 bp, Butyrivibrio fibrisolvens
  ref <308>: DATABASE ACCESSION NUMBER: ATCC 19171
ctgatggtcctatgccacagacccgtgagcacatcctattagcacgtcaggtaggcgtaccatacatcatcgtattcctaaacaagtgcgatatggttgacgacgaggaattattagagttagttgagatggacgtacgtgatctattaaatcagtaccagttcccaggcgacgacactccaatcatccgtggttcagcactaggtgcattaaacggcgaagagaagtggaaagaggcaatctatcagttagcagacactctagattcatacattccagagccaaagcgtgatatcgatgatccattcctattaccaatcgaagatatcttctcaatctcaggtcgtggtactgtagtaaccggccgtgtagagcgtggtattgtacacgtaggtgacgaagttgaaatcgttggtattcgtccaaccaccaagaccactgtaactggcgttgaaatgttccgtaagttactagacgaaggtcgtgcaggtgataacgttggtgttctactacgtggtaccaagcgtgatgaggttgagcgtggtcaggttctagctgctccaggcacaatcactccacacaccaagttcactggtcaggtttacgtactaagcaaggatgaaggtggtcgtcacactccattcttcaagggctaccgtccacagttcttcttccgtacaaccgatattaccggttctatcgatctgaaagagggcgtagagatggtaatgccaggtgataacaccgacatgaccgtaaccctaatccacccagtagctatggct

SEQ ID NO: 1675 - DNA, 835 bp, Campylobacter jejuni subsp. doylei
  ref <308>: DATABASE ACCESSION NUMBER: ATCC 49349
tggggcgatcttggttgtttctgctgcagatggtcctatgccacaaactagagagcacattcttctttctcgtcaagtaggcgttccatatattgttgtttttatgaataaagcagatatggttgatgatgctgagcttttagagttagttgaaatggaaattagagaattattaagctcttatgatttcccaggcgatgatacacctattatttctggttctgctttaaaagctcttgaagaagctaaagctggacaagatggtgaatggtcagcaaaaattatggatcttatggctgcagttgatagttatattccaactccaactcgtgatactgaaaaagacttcttgatgccaattgaagacgttttctcaatttcaggtcgtggtactgttgttacaggtagaattgaaaaaggtgttgtaaaagtaggtgatactatcgaaatcgttggtattaaagacactcaaacaacaactgtaacaggtgttgaaatgttcagaaaagaaatggatcaaggcgaggcaggagataacgtaggtgttcttcttcgtggtactaaaaaagaagaagttattcgcggtatggttcttgctaaaccaaaatcaattactccacacactgacttcgaagctgaagtttatatcttaaataaagatgaaggtggtagacatactccattctttaacaactatagaccacagttttatgtaagaacaactgatgttacaggttcgattaaattagctgatggtgttgaaatggttatgccaggtgaaaatgtgagaattactgtaagcttgatcgctccagtagcacttgaagaaggaact

SEQ ID NO: 1676 - DNA, 812 bp, Campylobacter lari
  ref <308>: DATABASE ACCESSION NUMBER: ATCC 43675
ttctgcagcagacggccctatgccacaaactagagagcatatcttactttctcgtcaagtaggtgtaccatatattgttgttttcatgaacaaagctgatatggttgatgatgcagaattattagaattagttgaaatggaaattagagaattactaagctcttatgatttcccaggagatgatactccaattatttcaggttcagcattacaagctcttgaagaagcaaaagctggtcaagatggtgaatggtctaaaaaaatcttagatcttatggctgcagttgatgattatattccaactccggctcgtgatacagataaagatttcttgatgccaatcgaagatgttttctcaatctcaggtcgtggaactgttgttaccggtagaattgaaaaaggtgttgtaaaagttggtgatactatagaaatcgttggtattagagacactcaaacaaccacagttactggtgttgaaatgtttagaaaagaaatggatcaaggtgaagctggtgataatgttggtgtattacttcgtggaactaaaaaagaagatgttgaacgtggtatggttcttgctaaaccaaaatcaatcactccacatactgattttgaagcagaagtttatatcttaaataaagatgaaggtggtcgtcatactccattctttaataattatagaccgcaattttatgtaagaacaactgatgttacaggtgctattaaacttgcagaaggcgttgagatggttatgccaggcgataatgatagaattactgtaagtcttattgctccagttgcacttgaggaag

SEQ ID NO: 1677 - DNA, 828 bp, Campylobacter sputorum subsp. sputorum
  ref <308>: DATABASE ACCESSION NUMBER: ATCC 35980
gctattcttgtatgttcagctgcagatggtccaatgccacagactagagagcatattctactatcaagacaagttggtgttccatacatagttgttttcttaaataaagaagatatggttgatgatgctgagcttatagagttggttgaagttgaggttagagatttattaaatgaatatgatttccctggagatgatactccaatcgtaataggttctgctcttaaagctttagaagaagcaaaagctggaacagagggtgaatggtctgctaaaattatgaaacttatggatgctgttgatagctatatcccaactccaacaagagatacagataaagatttccttatgccaatcgaagatatcttctcaatttctggtcgtggtacagttgtaacaggtagaattgaaaaaggtgtagtaaaagttggcgagactattgagatagttggtattagacctactcaaacaacaacagttactggtgttgaaatgtttagaaaagagctagatcaaggtgaagctggagataatgttggtatcttgttaagaggtacaaaaaaagaagatgttgaaagaggtatggttttatgtaaaccaaaatcaatcactcctcacaagaaatttgaaggcgaagtttatattcttacaaaagatgaaggtggtagacatactcctttctttagtaactatagaccacaattttatgttagaacaacagatgtaacaggttctatatctcttcctgagggaacagagatggatatgcctggtgataatgtaaaacttacagttgaacttataaacccaattgctcttgagcaagga

SEQ ID NO: 1678 - DNA, 820 bp, Campylobacter upsaliensis
  ref <308>: DATABASE ACCESSION NUMBER: ATCC 49815
cgattttggttgtttctgctgctgatggtcctatgccacaaactagagagcacattttgctttctcgtcaagtgggtgttccttatatcgtagtttttatgaataaggctgatatggttgatgatgcagagcttttagaattggttgaaatggaaattagagaacttttaagctcttatgatttcccgggcgatgacactcctatcatttcaggctctgctcttcaagccttagaagaggctaaggcgggacaagatggcgagtggtcagctaagattttagagcttatgaaggcagttgatgagtatatcccaactcctgttcgcgatactgaaaaagatttcttgatgcctattgaagatgttttttcaatttctggtcgtggaactgttgtaacaggtagaattgaaaaaggtgtggttaaagtcggcgatactattgagatagtaggtatcaaagatactcaaactacaacagttacaggcgttgagatgtttagaaaagaaatggatcaaggtgaggctggcgataatgtcggtgtgcttttaagaggaacaaaaaaagaagatgttcttcgtggtatggttcttgcaaagcctaaatctatcactcctcatactgattttgaagcagaagtttatattctaaataaagatgagggcggtcgccatactcctttctttaacaattatcgtccgcagttttatgtaagaacgactgatgtaactggttctattaaattagctgatggtgttgagatggttatgccgggtgaaaatgtaagaattacagttagccttatcgctccagttgcacttga

SEQ ID NO: 1679 - DNA, 783 bp, Globicatella sanguis
  ref <308>: DATABASE ACCESSION NUMBER: ATCC 51173
ctgcagctgatggtccaatgcctcaaacacgtgaacatatcttattatcacgtcaagtaggtgttccttacatggttgtcttcttaaacaaagttgacatggttgacgatgaagaattattagaattagttgaaatggaagttcgtgatttattatctgaatacgaattccctggagacgacgttccagtaatcgctggttcagctttaaaagctttagaaggcgaagaacaatatgaagcaaaagtattagaattaatggaagctgtagatacatacattccagaaccagttcgtgatactgaaaaaccattcatgatgccagttgaagatgtgttctcaatcacaggtcgtggtacagttgctactggacgtgttgaacgtggacaagttaaagttggtgacgaagttgaaatcgttggtattgctgaagaaattagcaaaacaactgtaactggtgttgaaatgttccgtaaattattagattacgctgaagctggagataacattggtgcgttattacgtggtgttacacgtgaacaaatccaacgtggtcaagtattagcaaaaccaggaacaattacacctcatactaaattcgaggcggaagtttacgtattatcaaaagaagaaggtggacgtcatactccattcttcgctaactaccgtcctcaattctacttccgtacaactgacgttacaggtgttgtagaattaccagaaggtacagaaatggtaatgcctggagataacgtatcaatgacagttgaattaattcacccaa

SEQ ID NO: 1680 - DNA, 823 bp, Lactobacillus acidophilus
  ref <308>: DATABASE ACCESSION NUMBER: ATCC 4356
gctatcttagttgttgctgcaactgatggtcctatgccacaaactcgtgaacacattttgcttgctcgtcaagttggtgttaactacatcgtagtattcttgaacaagtgcgatttagttgacgacccagaattgatcgacttggttgaaatggaagttcgtgacttgttgactgaatacgattaccctggtgatgatattccagttgttcgtggttcagcattaaaggctttacaaggtgacaaggaagctcaagaccaaatcatgaagttgatggacattgttgatgaatacatcccaactccagaacgtcaaactgacaagccattcttgatgccagttgaagacgtattcactatcactggtcgtggtactgttgcttcaggtcgtatcgaccgtggtactgttaaggtcggtgacgaagttgaaatcgttggtttggtagataaagttcttaagtcagttgttactggtttggaaatgttccacaagactttggacttaggtgaagccggcgataacgttggtgtattgcttcgtggtgttgaccgtgatcaagttgttcgtggtcaagtattggctgcacccggctcaatccaaactcataagaagtttaaggcacaagtttatgttttgaagaaggacgaaggtggtcgtcacactccattcttctcagactaccgtccacaattctacttccacaccactgatattactggtgaaattgaattgccagaaggtactgaaatggttatgcctggtgataacactgaattcactgttactttgatcaagccagctgccatcgaaaagggtactaagt

SEQ ID NO: 1681 - DNA, 793 bp, Leuconostoc mesenteroides subsp. dextranicum
  ref <308>: DATABASE ACCESSION NUMBER: ATCC 19255
gctgcaactgatggtcctatgccacaaacacgtgaacacatcttgttggcacgtcaagttggtgttgactacttggttgtcttcttgaacaagactgatttggttgatgatgaagaattagttgaattggttgaaatggaagttcgtgaattgttgtcagaatatgacttcccaggtgacgatattcctgtacttaagggttcagctttgaaggctttggaaggtgatcctgaacaagttaaggttatcgaagaattgatggatactgttgattcatacattccagaaccagcacgtgaaacagacaagccattcttgatgcctgtcgaagacgtcttcacaatcactggtcgtggtacagttgcttctggtcgtgttgaccgtggtgtattgactacaggaactgaaattgaaatcgttggtttgaaggacgaagttcaaaagactactgttacaggtatcgaaatgttccgtaagactttggaagaagctcaagcgggtgataacattggtgcattgttgcgtggtgttgatcgtagcaacattgaacgtggtcaagttttggcaaagccaggttcaattaagacacacaagaagttcaaggctgaagtttatgtcttgacaaaggaagaaggtggtcgtcatacaccattcttcactaactaccgtccacaattctacttccacacaactgatgttacaggtgttgttgaattgccagccggtgttgaaatggttatgcctggtgaccaagtgacattcgaaatcgaattgatctcaccagttgccatcg

SEQ ID NO: 1682 - DNA, 796 bp, Prevotella buccalis; identical to SEQ ID NO: 1573
  ref <308>: DATABASE ACCESSION NUMBER: ATCC 35310

SEQ ID NO: 1683 - DNA, 800 bp, Ruminococcus bromii
  ref <308>: DATABASE ACCESSION NUMBER: ATCC 27255
ggttgctgctactgacggcccgatgcctcagactcgtgagcacgttctgctcgctcgtcaggtgggtgtgcccgccatcgtcgtcgccctcaacaagtgcgacatggttgacgatgaggagctcattgagcttgtcgagatggaggtccgcgagctgctgacctcgcaggagttcgacggcgacaactgccctgtcgttcgcatctccgccttccaggccctccagggtgacgagaagtggacccagtcgatcctcgacctcatggacgccgtggacgagtacatcccgcagcctgagcgcgatctcgacaagcccttccttatgccgatcgaggacgtcttcaccatcaccggccgtggcaccgttgtcaccggtcgtgtcgagcgtggtgtcgtcaagactggcgaagaggtcgagatcgtcggtatccacgagaagacccagaagaccaccgttaccggtgtcgagatgttccgtaagatcctcgacgagggccgcgctggtgagaacgtcggcgttctgctccgtggcaccaagaaggaggacgtcgttcgcggcatggtcctctccaagcctggttccaccaccccccacaccgacttcgagggccaggtctacgtcctcaagaaggatgagggtggccgccacaagccgttcttctcccattacagcccccagttctacttccgtaccacggacgtgactggcactgttgagctccccgagggcaccgagatggtcatgcctggcgacaacaccgacatgactgtgcacctgattcacccggttgccatggagg

SEQ ID NO: 1684 - DNA, 545 bp, Paracoccidioides brasiliensis
  ref <308>: DATABASE ACCESSION NUMBER: ATCC 32075
tgtctttattcaggaactgattgtatgtttcttctcgtttatatataacataccttctatatttcatgtgtttctaacgaactcatagaacaacattgccaaggctcacggtggttactccgtgttcaccggtgtcggtgagcgtacccgtgaaggaaacgatctgtaccacgaaatgcaggaaacccgcgtcatccagctggacggcgagtccaaagtcgccctcgtcttcggccagatgaacgagccccccggagcccgtgcccgtgttgccctgaccggtctgaccatcgctgaatacttccgtgacgaagaaggccaagatggtacgttcccccattccatatatgtttcttgtgcgctttgccaactaaacaccacctagtgctcctcttcatcgacaatatcttccgcttcacccaagccggttccgaagtgtccgccctgctaggccgcatcccctccgccgtcggctatcaacccaccctcgccgtcgacatgggtggtatgcaggagcgcatcacaactacaacaaaaggctccat

SEQ ID NO: 1685 - DNA, 1020 bp, Candida norvegica
  ref <308>: DATABASE ACCESSION NUMBER: ATCC 36586
gatatcgctttatggaaattcgaaactccaaaattccacgttacygttatcgatgctccaggtcacagagatttcatcaagaatatgattacyggtacctcccaagctgattgtgctattttaatcattgctggtggtgttggtgaattcgaagctggtatctccaaagatggtcaaaccagagaacacgctttgttagctttcaccttaggtgtyaaacaattgattgttgccgttaacaaaatggactctgtcaaatgggatcaatcccgtttcgaagaaatcgtcaaggaagcttccggtttcatcaagaaagttggttacaacccaaagactgttccattcgttccaatctctggttggaatggtgacaacatgattgaagtytcwgctaacgcyccatggtacaaaggttgggaaaaggaaaccaaagcyggtgtcgttaaaggtaaaactttattagaagccattgatgctattgaaccaccttcaagaccaactgaaaaaccattgagattgccattgcaagatgtctacaagattggtggtatcggaaccgtaccagtcggtaragttgaaaccggtgtcattaaaccaggtatgattgttactttcgccccagccggtgttactactgaagtcaaatctgttgaaatgcatcacgaacaattagaagctggttacccaggtgacaatgttggtttcaacgtcaagaatgtttcagttaaagaaatcagaagaggtaahgttgctggtgactccaagaacgatccaccaaaaggtgctgaatctttcaacgctcaagttattgtcttgaaccatccaggtcaaatctytgctggttactytccagttttggattgtcacactgcccacattgcttgtaaattcgatgaaatcttggaaaagattgacagaagatccggtaagaaattggaagaaaatccaaaattcatcaaatctggtgacgctgctawtgtcaaatttgttccatwtaaaccattrtgtgttgaagctttc

SEQ ID NO: 1686 - DNA, 929 bp, Aspergillus nidulans
  strain WSA-176
tgctgcttccgatggtcaaatgtacgattgatattccttccagccagtcaggataacagctgataccagttgcaaataggccccagactcgtgagcacttgttgcttgcccgtcaggttggtgtccagaagatcgttgtcttcgtcaacaaggttgacgctgtcgatgaccctgagatgttggagcttgttgagctcgagatgcgtgagctcctcaacacttacggtttcgagggagaggagacccctatcatcttcggttccgccctgtgcgctctcgaaggccgccgcgaggacattggtactcagcgtattgactccctcctcgaggccgttgacacttggatccctaccccccagcgtgacttggacaagcccttcctgatgtccattgaggaagttttctccattggtggtcgtggtaccgtcgcctctggtcgtgtcgagcgtggtctcctcaagaaggataccgaagttgaaattcacggtgctgatggtattctgaagaccaaggtcaccgacattgagaccttcaagaagagctgcgatgagtctcgtgctggtgacaactccggtcttctcctccgtggtatccgtcgtgaggatgttcgtcgtggtatggtcatcgctgcccctggctccatcaaggcctccaagaagttcatggtctccatgtacgtcttgactgaggctgaaggtggccgcaagaacggcttcggtgccaactaccgcccccaggctttcatccgcactgctggtaagtttcgaactatttgattcattgatcacgtccctaactgttactttagacgaggcttgcgaccttcatttccctgatgaggccgacaaggaccgccacgtcatgcccggtgacaacgtcgaaatggtcctcaacctcaacaaccccgttgctgctgaggctggacagcg

SEQ ID NO: 1687 - DNA, 951 bp, Aspergillus terreus
  strain WSA-174
tgccgcttccgatggtcagatgtacgctcaagccccagtttccatataaacataaacgatctatcatcagcacaacgctgacttcttcgcttccaggccccagacccgtgagcacttgctgttggcccgtcaggtcggtgtccagaagatcgtggtcttcgtcaacaaggtcgatgccgttgatgacccggagatgttggagctcgttgagctggaaatgcgcgagctcctgaccagctacggattcgagggtgaagagacccccatcatcttcggttctgctctctgcgctcttgagggccgccgtcctgagattggtactgagaagattgacgagctgatgcacgccgtcgacacctggatccccaccccccagcgtgacctcgacaagcccttcctgatgtccgtcgaggaagtcttctccattgctggtcgtggtaccgtcgcttccggccgtgtcgagcgtggtattctgaagaaggatagcgaagtcgagatcatcggtggtgctttcgacgccacgaagaccaaggtcactgacatcgagaccttcaagaagtcttgcgacgagtctcgcgctggtgacaactctggtctcctcctccgtggtatccgtcgtgaggatgttcggcgtggtatggtcattgctgctcctggcagcaccaaggcccacgacaagttccttgtctctatgtacgtcctcactgaggctgagggtggccgtcgtaccggattcggtaccaactaccgcccccaggtcttcatccgtactgccggtaagtgttcctggaagaggctttgagcctatataggatctcggataatttactaatccaccatatagatgaggccgctgacctcagcttccccgacaacgatgactcccgccgtgtcatgcccggtgacaacgttgagatggtcctgaagacccaccgccccgtggctgctgag

SEQ ID NO: 1688 - DNA, 823 bp, Candida norvegica
  ref <308>: DATABASE ACCESSION NUMBER: ATCC 36586
cgttgccgctaccgatggtcaaatgcctcaaactagagaacatttgctattggctagacaggttggtgttcaacacattgtcgtgtttgttaacaaggttgacactattgatgatccagaaatgttggaattggttgaaatggaaatgagagagttgattgccacttatggtttcgatggtgataacaccccagttatcatgggttctgctctatgtgctttggaaggtcgtgaacctgaaatcggtgctcaatcaatcgacagattgttggaagccgttgatgaatacattccaactccaactagagatttggaaaaaccattcttgatgggtgttgaagatgtcttctccatttctggtagaggtaccgtctgtaccggtcgtgttgaaagaggtaacttgaagaaaggtgatgaaatcgaaattgtcggctacaacaagactccaatcaaaaccaccgtcaccggtattgagatgttcaaaaaggaattagaccaagctatggctggtgataactgtggtatcttattacgtggtgttaagagagatgatatcaagagaggtatggttatctctaaagtcaacaccgtttccgcacacaccaaattcttggcctctttatacgtcttgactaaagaagaaggtggtcgtcattcaggttttgctgaaaactacagacctcaattgttcatcagaaccggtgatgtcactgttactttaaccttcccagaagatgctgatcactctcagcaagtcttaccaggtgacaacgttgaaatggaatgtaccttggttcatccaactgctcttgaaaccggtcaa

SEQ ID NO: 1689 - DNA, 803 bp, Candida parapsilosis
  ref <308>: DATABASE ACCESSION NUMBER: ATCC 201076
gctgctactgacggtcaaatgcctcaaactagggaacatatgttgttggcgagacaagttggtatccaaaacttggttgtttttgttaacaaagttgataccattgatgacccagaaatgttggaattggttgaaatggaaatgagggaattattgagctcttatgggtttgatggtgaaaacactccagttatcatgggatcagccttgtgtgctttagaaggtaaacaaccagaaatcggtgttcaagccattcaaaaattattggatgctgttgatgaatatattccaactccagaaagagatgctgaccaaccatttttgatgccagtggaagatgtgttttctatttcaggtagaggaaccgttgtcaccggaagagttgaaagaggtatgttgaagaaaggtgaagaagtakaagtcattggtgaaaactcatttaaggctacttccacgggtattgagatgttcaaaaaggaattggatgccgctatggccggtgacaactgtggtattttgttgagaggtgtcaagagagacgaagtcaagaggggtatggttttggccaaaccaggtaccaccaccccacaccaaaagtttttggcttccatttatatcttgactgctgaagaaggtggacgtagtacccctttcagtgaaggatacaaaccacaatgtttctttagaactagtgatgttaccacgacatttactttcccagaaggtgaaggtgttgaccactcacaaatggttatgccaggagrcaatgttgaaatggtgggaactttaatcaagaaagctcc

SEQ ID NO: 1690 - DNA, 23 bp, Artificial Sequence
  Synthetic DNA Sequence
caggtcctgttgcgactgaagaa

SEQ ID NO: 1691 - DNA, 25 bp, Artificial Sequence
  Synthetic DNA Sequence
cacagataaacctgagtgtgctttc

SEQ ID NO: 1692 - DNA, 24 bp, Artificial Sequence
  Synthetic DNA Sequence
ggtgagaactgtggtatcttactt

SEQ ID NO: 1693 - DNA, 24 bp, Artificial Sequence
  Synthetic DNA Sequence
catttcaacgccttctttcaactg

SEQ ID NO: 1694 - DNA, 20 bp, Artificial Sequence
  Synthetic DNA Sequence
aaggcaaggatgacaacggc

SEQ ID NO: 1695 - DNA, 21 bp, Artificial Sequence
  Synthetic DNA Sequence
acgatttccacttcttcctgg

SEQ ID NO: 1696 - DNA, 20 bp, Artificial Sequence
  Synthetic DNA Sequence
atgttcctgtagttgctgga

SEQ ID NO: 1697 - DNA, 22 bp, Artificial Sequence
  Synthetic DNA Sequence
tttcttcagcaataccaacaac

SEQ ID NO: 1698 - DNA, 23 bp, Artificial Sequence
  Synthetic DNA Sequence
ggaatcaacagatggtttacaaa

SEQ ID NO: 1699 - DNA, 20 bp, Artificial Sequence
  Synthetic DNA Sequence
gcatcttctgggaaaggtgt

SEQ ID NO: 1700 - DNA, 20 bp, Artificial Sequence
  Synthetic DNA Sequence
aagatgcggaaagaagcgaa

SEQ ID NO: 1701 - DNA, 23 bp, Artificial Sequence
  Synthetic DNA Sequence
attatggatcagttcttggatca

SEQ ID NO: 1702 - DNA, 213 bp, Streptococcus gordonii
  strain Challis V288
ttcatagacgctgagcacgctttggatccatcttacgcggctgctctaggtgtaaatattgatgagctgttgctatctcaaccagattctggtgagcaaggtttagaaattgcaggaaaattgattgactctggggcagttgatttagttgtcatcgactctgttgcagctcttgtaccacgtgcggaaatcgatggagatatcggtgatagc

SEQ ID NO: 1703 - DNA, 692 bp, Streptococcus mutans
  strain GS-5
gggccggaatcttctggtaagacaactgtcgctcttcatgctgctgctcaggcgcaaaaagatggcggtattgccgctttcattgatgcagaacatgcccttgatccagcctatgctgctgctcttggcgttaatattgatgagcttttgctttcacaaccagattcaggagaacagggtcttgaaattgcagggaaattgattgattctggcgctgttgatttagttgttgttgactcagtggcagctttagtaccacgtgcggagattgacggagatattggtaatagtcatgttggcttacaagcacgcatgatgagtcaagcgatgcgtaaattatcagcttcaatcaataaaacaaaaaccattgctatttttattaatcaattgcgggaaaaagttggtattatgtttggtaatccagaaacaacccctggcgggcgtgccttgaagttttattcttctgtgcgtcttgatgtccgcggcaatactcaaattaaaggaaccggggaacaaaaagacagcaatattggtaaagagaccaaaattaaagttgttaaaaataaagttgctccaccatttaaggaagcttttgtagaaattatatatggtgaaggcatttctcgtacaggtgaattagttaagattgccagtgatttgggaattatccaaaaagctggagcttggtactc

SEQ ID NO: 1704 - DNA, 1204 bp, Streptococcus pneumoniae
atggcgaaaaaaccaaaaaaattagaagaaatttcaaaaaaatttggggcagaacgtgaaaaggccttgaatgacgctcttaaattgattgagaaagactttggtaaaggatcaatcatgcgtttgggtgaacgtgcggagcaaaaggtgcaagtgatgagctcaggttctttagctcttgacattgcccttggctcaggtggttatcctaagggacgtatcatcgaaatctatggcccagagtcatctggtaagacaacggttgcccttcatgcagttgcacaagcgcaaaaagaaggtgggattgctgcctttatcgatgcggaacatgcccttgatccagcttatgctgcggcccttggtgtcaatattgacgaattgctcttgtctcaaccagactcaggagagcaaggtcttgagattgcgggaaaattgattgactcaggtgcagttgatcttgtcgtagtcgactcagttgctgcccttgttcctcgtgcggaaattgatggagatatcggagatagccatgttggtttgcaggctcgtatgatgagccaggccatgcgtaaacttggcgcctctatcaataaaaccaaaacaattgccatttttatcaaccaattgcgtgaaaaagttggagtgatgtttggaaatccagaaacaacaccgggcggacgtgctttgaaattctatgcttcagtccgcttggatgttcgtggtaatacacaaattaagggaactggtgatcaaaaagaaaccaatgtcggtaaagaaactaagattaaggttgtaaaaaataaggtagctccaccgtttaaggaagccgtagttgaaattatgtacggagaaggaatttctaagactggtgagcttttgaagattgcaagcgatttggatattatcaaaaaagcaggggcttggtattcttacaaagatgaaaaaattgggcaaggttctgagaatgctaagaaatacttggcagagcacccagaaatctttgatgaaattgataagcaagtccgttctaaatttggcttgattgatggagaagaagtttcagaacaagatactgaaaacaaaaaagatgagccaaagaaagaagaagcagtgaatgaagaagttccgcttgacttaggcgatgaacttgaaatcgaaattgaagaataagctgttaaagcagtggagaaatccgctactttttcga

SEQ ID NO: 1705 - DNA, 981 bp, Streptococcus pyogenes
  strain NZ131
atgcgttcaggaagtctagctcttgatattgcttggatagctggtggttatcctaaaggacgtatcatcgaaatctatggtccagagtcttccggtaaaacgactgtggctttacatgctgtagcacaagctcaaaaagaaggtggaatcgcagcctttatcgatgccgagcatgcgcttgatccagcttatgctgctgcgcttggggttaatattgatgaacttctcttgtctcaaccagattctggagaacaaggacttgaaattgcaggtaaattgattgattctggtgcggttgacctggttgttgtcgattcagtagcagctttagtgccacgtgctgaaattgatggtgatattggcgatagccatgtcggattgcaagcacgtatgatgagtcaggccatgcgtaaattatcagcttctattaataaaacaaaaactatcgcaatctttatcaaccaattgcgtgaaaaagttggtgtgatgtttggaaatcctgaaacaacaccaggtggtcgagctttgaaattctatgcttctgttcggctggatgtgcgtggaaacaaccaaattaaaggaactggtgaccaaaagatagccagcattggtaaggagaccaaaatcaaggttgttaaaaacaaggtcgctccgccatttaaggtagcagaagttgaaatcatgtatggggaaggtatttctcgtacaggggagcttgtgaaaattgcttctgatttggacattatccaaaaagcaggtgcttggttctcttataatggtgagaagattggccaaggttctgaaaatgctaagcgttatttggccgatcatccacaattgtttgatgaaatcgaccgtaaagtacgtgttaaatttggtttgcttgaagaaagcgaagaagaatctgctatggcagtagcatcagaagaaaccgatgatcttgctttagatttagataatggtattgaaattgaagattaa

SEQ ID NO: 1706 - DNA, 312 bp, Streptococcus salivarus subsp. thermophilus
gcgtatgcacgagctctaggtgttaatatcgatgagcttcttttgtcgcagcctgattctggtgagcaaggtctcgaaattgcaggtaagctgattgactctggtgcagtggatttagttgttgttgactcagttgcggccttcgtaccacgtgcagaaattgatggagatagtggtgacagtcatgtaggacttcaagcgcgtatgatgagtcaagccatgcgtaaactttctgcatctattaataaaacaaaaacgattgctatctttattaaccagttgcgtgaaaaagttggtatcatgtttggtaac

SEQ ID NO: 1707 - DNA, 831 bp, Escherichia coli
atgaaaaacacaatacatatcaacttcgctatttttttaataattgcaaatattatctacagcagcgccagtgcatcaacagatatctctactgttgcatctccattatttgaaggaactgaaggttgttttttactttacgatgcatccacaaacgctgaaattgctcaattcaataaagcaaagtgtgcaacgcaaatggcaccagattcaactttcaagatcgcattatcacttatggcatttgatgcggaaataatagatcagaaaaccatattcaaatgggataaaacccccaaaggaatggagatctggaacagcaatcatacaccaaagacgtggatgcaattttctgttgtttgggtttcgcaagaaataacccaaaaaattagattaaataaaatcaagaattatctcaaagattttgattatggaaatcaagacttctctggagataaagaaagaaacaacggattaacagaagcatggctcgaaagtagcttaaaaatttcaccagaagaacaaattcaattcctgcgtaaaattattaatcacaatctcccagttaaaaactcagccatagaaaacaccatagagaacatgtatctacaagatctggataatagtacaaaactgtatgggaaaactggtgcaggattcacagcaaatagaaccttacaaaacggatggtttgaagggtttattataagcaaatcaggacataaatatgtttttgtgtccgcacttacaggaaacttggggtcgaatttaacatcaagcataaaagccaagaaaaatgcgatcaccattctaaacacactaaatttataa

SEQ ID NO: 1708 - DNA, 846 bp, Enterococcus faecalis
  strain HH22
ttgaaaaagttaatatttttaattgtaattgctttagttttaagtgcatgtaattcaaacagttcacatgccaaagagttaaatgatttagaaaaaaaatataatgctcatattggtgtttatgctttagatactaaaagtggtaaggaagtaaaatttaattcagataagagatttgcctatgcttcaacttcaaaagcgataaatagtgctattttgttagaacaagtaccttataataagttaaataaaaaagtacatattaacaaagatgatatagttgcttattctcctattttagaaaaatatgtaggaaaagatatcactttaaaagcacttattgaggcttcaatgacatatagtgataatacagcaaacaataaaattataaaagaaatcggtggaatcaaaaaagttaaacaacgtctaaaagaactaggagataaagtaacaaatccagttagatatgagatagaattaaattactattcaccaaagagcaaaaaagatacttcaacacctgctgctttcggtaagactttaaataaacttatcgcaaatggaaaattaagcaaagaaaacaaaaaattcttacttgatttaatgttaaataataaaagcggagatactttaattaaagacggtgttccaaaagactataaggttgctgataaaagtggtcaagcaataacatatgcttctagaaatgatgttgcttttgtttatcctaagggccaatctgaacctattgttttagtcatttttacgaataaagacaataaaagtgataagccaaatgataagttgataagtgaaaccgccaagagtgtaatgaaggaattttaa

SEQ ID NO: 1709 - DNA, 555 bp, Pseudomonas aeruginosa
atgtccgcgagcaccccccccataactcttcgcctcatgaccgagcgcgacctgccgatgctccatgactggctcaaccggccgcacatcgttgagtggtggggtggcgacgaagagcgaccgactcttgatgaagtgctggaacactacctgcccagagcgatggcggaagagtccgtaacaccgtacatcgcaatgctgggcgaggaaccgatcggctatgctcagtcgtacgtcgcgctcggaagcggtgatggctggtgggaagatgaaactgatccaggagtgcgaggaatagaccagtctctggctgacccgacacagttgaacaaaggcctaggaacaaggcttgtccgcgctctcgttgaactactgttctcggaccccaccgtgacgaagattcagaccgacccgactccgaacaaccatcgagccatacgctgctatgagaaggcaggattcgtgcgggagaagatcatcaccacgcctgacgggccggcggtttacatggttcaaacacgacaagccttcgagagaaagcgcggtgttgcctaa

SEQ ID NO: 1710 - DNA, 732 bp, Staphylococcus aureus
atgaaccagaaaaaccctaaagacacgcaaaattttattacttctaaaaagcatgtaaaagaaatattgaatcacacgaatatcagtaaacaagacaacgtaatagaaatcggatcaggaaaaggacattttaccaaagagctagtcaaaatgagtcgatcagttactgctatagaaattgatggaggcttatgtcaagtgactaaagaagcggtaaacccctctgagaatataaaagtgattcaaacggatattctaaaattttccttcccaaaacatataaactataagatatatggtaatattccttataacatcagtacggatattgtcaaaagaattacctttgaaagtcaggctaaatatagctatcttatcgttgagaagggatttgcgaaaagattgcaaaatctgcaacgagctttgggtttactattaatggtggagatggatataaaaatgctcaaaaaagtaccaccactatattttcatcctaagccaagtgtagactctgtattgattgttcttgaacgacatcaaccattgatttcaaagaaggactacaaaaagtatcgatcttttgtttataagtgggtaaaccgtgaatatcgtgttcttttcactaaaaaccaattccgacaggctttgaagcatgcaaatgtcactaatattaataaactatcgaaggaacaatttctttctattttcaatagttacaaattgtttcactaa

SEQ ID NO: 1711 - DNA, 738 bp, Escherichia coli
  strain BM2570
atgaacaaaaatataaaatattctcaaaactttttaacgagtgaaaaagtactcaaccaaataataaaacaattgaatttaaaagaaaccgataccgtttacgaaattggaacaggtaaagggcatttaacgacgaaactggctaaaataagtaaacaggtaacgtctattgaattagacagtcatctattcaacttatcgtcagaaaaattaaaatcgaatactcgtgtcactttaattcaccaagatattctacagtttcaattccctaacaaacagaggtataaaattgttgggaatattccttaccatttaagcacacaaattattaaaaaagtggtttttgaaagccatgcgtctgacatctatctgattgttgaagaaggattctacaagcgtaccttggatattcaccgaacactagggttgctcttgcacactcaagtctcgattcagcaattgcttaagctgccagcggaatgctttcatcctaaaccaagagtaaacagtgtcttaataaaacttacccgccataccacagatgttccagataaatattggaagctatatacgtactttgtttcaaaatgggtcaatcgagaatatcgtcaactgtttactaaaaatcagtttcatcaagcaatgaaacacgccaaagtaaacaatttaagtaccgttacttatgagcaagtattgtctatttttaatagttatctattatttaacgggaggaaataa

SEQ ID NO: 1712 - DNA, 735 bp, Staphylococcus aureus
  strain RN451
atgaacgagaaaaatataaaacacagtcaaaactttattacttcaaaacataatatagataaaataatgacaaatataagattaaatgaacatgataatatctttgaaatcggctcaggaaaagggcattttacccttgaattagtacagaggtgtaatttcgtaactgccattgaaatagaccataaattatgcaaaactacagaaaataaacttgttgatcacgataatttccaagttttaaacaaggatatattgcagtttaaatttcctaaaaaccaatcctataaaatatttggtaatataccttataacataagtacggatataatacgcaaaattgtttttgatagtatagctgatgagatttatttaatcgtggaatacgggtttgctaaaagattattaaatacaaaacgctcattggcattatttttaatggcagaagttgatatttctatattaagtatggttccaagagaatattttcatcctaaacctagagtgaatagctcacttatcagattaaatagaaaaaaatcaagaatatcacacaaagataaacagaagtataattatttcgttatgaaatgggttaacaaagaatacaagaaaatatttacaaaaaatcaatttaacaattccttaaaacatgcaggaattgacgatttaaacaatattagctttgaacaattcttatctcttttcaatagctataaattatttaataagtaa

SEQ ID NO: 1713 - DNA, 1029 bp, Enterococcus faecalis
  strain V583
atgaataaaataaaagtcgcaattatcttcggcggttgctcggaggaacatgatgtgtcggtaaaatccgcaatagaaattgctgcgaacattaatactgaaaaattcgatccgcactacatcggaattacaaaaaacggcgtatggaagctatgcaagaagccatgtacggaatgggaagccgatagtctccccgccatattctccccggataggaaaacgcatggtctgcttgtcatgaaagaaagagaatacgaaactcggcgtattgacgtggctttcccggttttgcatggcaaatgcggggaggatggtgcgatacagggtctgtttgaattgtctggtatcccctatgtaggctgcgatattcaaagctccgcagcttgcatggacaaatcactggcctacattcttacaaaaaatgcgggcatcgccgtccccgaatttcaaatgattgaaaaaggtgacaaaccggaggcgaggacgcttacctaccctgtctttgtgaagccggcacggtcaggttcgtcctttggcgtaaccaaagtaaacagtacggaagaactaaacgctgcgatagaagcagcaggacaatatgatggaaaaatcttaattgagcaagcgatttcgggctgtgaggtcggctgcgcggtcatgggaaacgaggatgatttgattgtcggcgaagtggatcaaatccggttgagccacggtatcttccgcatccatcaggaaaacgagccggaaaaaggctcagagaatgcgatgattatcgttccagcagacattccggtcgaggaacgaaatcgggtgcaagaaacggcaaagaaagtatatcgggtgcttggatgcagagggcttgctcgtgttgatctttttttgcaggaggatggcggcatcgttctaaacgaggtcaataccctgcccggttttacatcgtacagccgctatccacgcatggcggctgccgcaggaatcacgcttcccgcactaattgacagcctgattacattggcgatagagaggtga

SEQ ID NO: 1714 - DNA, 818 bp, Campylobacter jejuni subsp. jejuni
  ref <308>: DATABASE ACCESSION NUMBER: ATCC 33292
gcacaggttcagttgggcttgatcttgctttaggtataggcggtgttccaaaaggaagaattatagaaatttatggrcctgaaagttcaggtaaaaccactctaactctacacattatcgcagaatgccaaaaagcaggtggrgtttgtgcttttatcgatgcagaacatgcrcttgatgtraaatatgctaaaaatttgggtgtaaatacagatgatttgtatgtttctcagcctgattttggagarcaagccttagaaattgtagaaactatagcaagaagtggcgcagtagatcttatcgtagtagatagcgttgcagcgcttaccccaaaagcagaaattgaaggcgatatgggtgatcaacatgtaggacttcaagcaagacttatgtctcaagctctaagaaaacttacaggtatagttcataaaatgaataccacagtaattttyatcaaccaaattcgtatgaaaatcggtgctatgggttatggtactcctgaaaccacaacaggtggaaatgcattaaaattttatgcttctgtgcgtttagatgttagaaaagtagcaaccttaaaacaaaacgaagaacctataggaaaccgcgttaaagtaaaagtagttaaaaataaagttgctcctccattcagacaagctgaatttgatgtgatgtttggagagggtttaagccgtgaaggtgaattgatcgattatggtgtaaaacttgatatcgtagataaaagtggtgcgtggttttcttataaagataaaaaacttggacaaggtagagaaaattcaaaagctttcttaaaagaaaac

SEQ ID NO: 1715 - DNA, 809 bp, Abiotrophia adiacens
  ref <308>: DATABASE ACCESSION NUMBER: ATCC 49175
tggtgctatcttagtagtatctgcagctgatggtccaatgcctcaaacacgtgaacacatcttattatcacgtcaagtaggtgttccttacatcgttgtattcttaaacaaagttgacatggttgacgatgaagaattattagaattagtagaaatggaagttcgtgacttattatcagaatacgatttcccaggcgatgacactccagttgttgcaggttctgctttacgcgctttagaaggcgacgcttcatacraagaaaaaatcttagaattaatggctgctgttgacgaatacattccaactccagaacgygacgttgacaaaccattcatgatgccagttgaagacgtgttctcaatcacaggtcgtggtactgttgctacaggtcgtgttgaacgtggacaagttcgtgttggtgacgaagttgaaatcgttggtatttcagaagaaacttcaaaaacaactgtaactggtgttgaaatgttccgtaaattgttagactacgctgaagcaggggataacattggtacattattacgtggtgttacacgtgacaacatcgaacgtggacaagttcttgctaaaccaggaacaatcactccacatactaaattcaaagctgaagtttacgtattaactaaagaagaaggtggacgtcatactccattcttctctaactaccgtcctcaattctacttccgtacaacagacatcactggtgtttgtgtgttaccagaaggcgttgaaatggtaatgcctggtgataacgtaactatggaagttgaattaattcacccagtagcga

SEQ ID NO: 1716 - DNA, 817 bp, Abiotrophia defectiva
  ref <308>: DATABASE ACCESSION NUMBER: ATCC 49176
cggcgcgatcctcgttgtatctgctgctgacggcccaatgccacaaactcgtgaacacatcctcttgtctcgtcaagttggtgttccttacatcgtagtattcttgaacaaagttgacatggttgacgacgaagaattgctcgaattagttgaaatggaagttcgtgacctcttgtctgaatacgacttcccaggcgacgacactccagttatcgctggttcagctttgaaagctttagaaggcgacgctaactacgaagctaaagttttagaattgatggaacaagttgatgcttacattccagaaccagaacgtgacactgacaagccattcatgatgccagtcgaagacgtattctctatcactggtcgtggtactgttgcaactggtcgtgttgaacgtggtcaagttcgcgttggtgacgaagttgaaatcgttggtatcgaagaagaaacttctaagactaccgttaccggtgttgaaatgttccgtaagttattggattacgctgaagctggggacaacgttggtaccttgttacgtggtgtaactcgtgaccaaatccaacgtggtcaagtattatctaaaccaggttcaatcactccgyacactaagttcgaagctgaagtgtacgtattgtctaaagaagaaggtggtcgtcacactccattcttctctaactaccgtccacaattctacttccgtacaactgacgtaactggtgttgttactttaccagaaggtactgaaatggttatgccaggcgacaacgtacaaatggttgttgaattgatccacccaatcgcgatcgaagaa

SEQ ID NO: 1717 - DNA, 814 bp, Corynebacterium accolens
  ref <308>: DATABASE ACCESSION NUMBER: ATCC 49725
cggcgctatcctggttgttgctgcaaccgatggcccgatgccgcagacccgcgagcacgttctgcttgctcgccaggttggcgttccttacatcctcgttgcactgaacaagtgcgacatggttgatgatgaggaaatcatcgagctcgtggagatggagatctccgagctgctcgcagagcaggactacgatgaggaagctcctatcgttcacatctccgctctgaaggcactcgagggtgacgagaagtgggtacagtccatcgttgacctgatggatgcctgcgacaactccatccctgatccggagcgcgctaccgatcagccgttcttgatgcctatcgaggacatcttcaccattaccggccgcggtaccgttgttaccggccgtgttgagcgtggtcgtctgaacgtcaacgaggacgttgagatcatcggtatccaggagaagtcccagaacaccaccgttaccggtatcgagatgttccgcaagatgatggactacaccgaggctggcgacaactgtggtctgcttctgcgtggtaccaagcgtgaggacgttgagcgtggccaggttgttatcaagccgggcgcttacacccctcacaccaagttcgagggttccgtctacgtcctgaagaaggaagagggcggccgccacaccccgytcatgaacaactaccgtcctcagttctacttccgcaccaccgacgttaccggtgttgtgaacctgcctgagggcaccgagatggttatgcctggcgacaacgttgagatgtctgttgagctcatccagcctgttgctatggacgag

SEQ ID NO: 1718 - DNA, 814 bp, Corynebacterium genitalium
  ref <308>: DATABASE ACCESSION NUMBER: ATCC 33031
cggcgccatcctggttgttgctgcaaccgatggcccgatgccgcagacccgtgagcacgttctgctggctcgccaggttggcgttccgtacatcctagttgcactgaacaagtgcgacatggttgatgatgaggagctgctggagctcgtcgagatggaggtccgcgagctgctggctgagcaggacttcgacgaggaagcacctgttgttcacatctccgcactgaaggccctggagggcgacgagaagtgggctaagcagatcctggagctcatggaggcttgcgacaactccatcccggatccggagcgcgagaccgacaagccgttcctgatgccggttgrggacatcttcaccattaccggccgcggtaccgttgttaccggccgtgttgagcgtggcgtcctgaacctgaacgacgaggtcgagatcctgggcatccgcgagaagtccaccaagaccaccgttacctccatcgagatgttcaacaagctgctggacaccgcagaggctggcgacaacgccgcactgctgctgcgtggcctgaagcgcgaagatgttgagcgtggtcagatcgttgctaagccgggcgagtacaccccgcacaccgagttcgagggctccgtctacgttctgtccaaggacgagggtggccgccacaccccgttcttcgacaactaccgtccgcagttctatttccgcaccaccgacgttaccggtgttgtgaagctgccggagggcaccgagatggttatgccgggcgacaacgttgacatgtccgtcaccctgatccagccggttgctatggacgag

SEQ ID NO: 1719 - DNA, 814 bp, Corynebacterium jeikeium
  ref <308>: DATABASE ACCESSION NUMBER: ATCC 43216
cggcgccatcctggttgttgccgcaaccgatggcccgatgccgcagacccgcgagcacgttctgctggcycgccaggttggcgttccgtacatcctggttgcactgaacaagtgtgacatggttgacgatgaggagctgctggagctcgtcgagatggaggtccgcgagctgctggctgagcaggacttcgacgaggaagctccggttgttcacatctccgcactgaaggccctggagggcgacgagaagtgggctaaccagattctcgagctgatgcaggcttgcgacgagtctatcccggatccggagcgcgagaccgacaagccgttcctgatgccggttgwggacatcttcaccattaccggtcgcggtaccgttgttaccggccgtgttgagcgtggcatcctgaacctgaacgacgaggttgagatcctgggtatccgcgagaagtcccagaagaccaccgttacctccatcgagatgttcaacaagctgctggacaccgcagaggctggcracaacgctgcactgctgctgcgtggtctgaagcgcgaggacgttgagcgtggccagatcatcgctaagccgggcgagtacaccccgcacaccgagttcgagggctccgtctacgttctgtccaaggacgagggcggccgccacaccccgttcttcgacaactaccgtccgcagttctacttccgcaccaccgacgttaccggtgttgtgaagctgcctgagggcaccgagatggttatgccgggcgacaacgtygacatgtccgtcaccctgatccagccggttgctatggacgag

SEQ ID NO: 1720 - DNA, 748 bp, Corynebacterium pseudodiphtheriticum
  ref <308>: DATABASE ACCESSION NUMBER: ATCC 10700
cggcgctatcttggttgttgcagctaccgacggcccaatgccacagactcgcgagcacgttctgctggctcgccaggttggcgttccttacatcctggttgcactaaacaagtgcgacatggttgacgacgaggaaatcctcgagctcgtcgagatggagatccgcgaattgctggctgaccaggaattcgacgaagaagctccaatcgttcacatctccgcagtcggcgccttggaaggcgaagagaggtgggttaacgccatcgttgaactgatggatgcttgtgacgagtcgatccctgatccagaccgtgctaccgacaagccattcctgatgcctatcgaggacatcttcaccattaccggtcgtggcaccgttgttacgggtcgtgttgagcgtggttccctgaaggtcaacgaagaagtcgagatcatcggcatcaaggaaaagtcccagaagaccaccatcaccggtatcgaaatgttccgcaagatgctggactacaccgaggccggcgacaacgctggtctgctgcttcgcggtaccaagcgtgaagacgttgagcgtggacaggttatcgttgctccaggtgcttacagcacccacaagaagttcgaaggttccgtctacgttctttccaaggacgagggcggccgccacaccccgttcttcgacaactaccgtcctcagttctacttccgcaccaccgacgttaccggtgttgttaccctgcctgagggcaccgag

SEQ ID NO: 1721 - DNA, 813 bp, Corynebacterium striatum
  ref <308>: DATABASE ACCESSION NUMBER: ATCC 6940
ggcgctatcttggttgttgctgcaaccgatggcccgrtgccgcagacccgcgagcacgttcttctggctcgccaggttggcgttccttacatcctcgttgcactgaacaagtgcgacatggttgacgacgaggaaattatcgagctcgtcgagatggagatccgcgaactgctcgcagagcaggactacgatgaggaagctccgatcgttcacatctctgctctgaaggctcttgagggcgrcgagaagtgggtacaggctatcgttgacctgatgcaggcttgcgatgactccatcccggatccggagcgcgagctggacaagccgttcctgatgccaatcgaggacatcttcaccatcaccggccgcggtaccgttgttactggccgtgttgagcgtggctccctgaacgtcaacgaggacgttgagatcatcggtatccaggacargtccatctccaccaccgttaccggtatcgagatgytccgcaagatgatggactacaccgaggctggcgacaactgtggtctgcttctgcgtggtaccaagcgtgaagaggttgagcgcggccaggttgttattaagccgggcgcttacacccctcacacccagttcgagggttccgtctacgtcctgaagaaggaagagggcggccgccacaccccgttcatggacaactaccgtccgcagttctacttccgcaccaccgacgttaccggcgtcatcaagctgcctgagggcaccgagatggttatgcctggcgacaacgtcgagatgtcygtcgagctgatccagccggtcgctatggacgag

SEQ ID NO: 1722 - DNA, 817 bp, Enterococcus avium
  ref <308>: DATABASE ACCESSION NUMBER: ATCC 14025
cggagctatcttagtagtatctgctgctgatggccctatgcctcaaactcgtgaacacatcttgttatctcgtaacgttggtgttccttacatcgttgtattcttaaacaaaatggatatggttgacgatgaagaattacttgaattagttgaaatggaagttcgtgacttattaactgaatacgacttcccaggcgacgacactccagttatcgcaggttcagcgttgaaagctttagaaggcgacgcttcatacgaagaaaaaatcttagaattaatggctgctgttgacgaatatatcccaacaccagttcgtgatactgacaaaccattcatgatgccagtcgaagacgtattctcaatcactggtcgtggtactgttgcaactggtcgtgttgaacgtggacaagttcgcgttggtgacgaagttgaaatcgtaggtatcgctgacgaaactgctaaaacaactgttacaggtgttgaaatgttccgtaaattgttagactacgctgaagcaggtgacaacatcggtgctttgttacgtggtgttgcacgtgaagatatccaacgtggacaagtattggctaaaccagcttcaatcactccacatacaaaattctctgcagaagtttatgttctaactaaagaagaaggtggacgtcatactccattcttcactaactaccgtcctcagttctacttccgtacaactgacgtaactggtgtagttgatctaccagaaggtactgaaatggtwatgcctggggataacgtaactatggaagttgaattgatycacccaatygcggtagaagac

SEQ ID NO: 1723 - DNA, 823 bp, Gardnerella vaginalis
  ref <308>: DATABASE ACCESSION NUMBER: ATCC 14018
tggcgcaatcctcgtggttgctgctaccgacggtccaatggctcagacccgtgaacacgtcttgcttgctaagcaggtcggcgttccaaaaattcttgttgctttgaacaagtgcgatatggttgacgacgaagagcttatcgatctcgttgaagaagaggtccgtgacctcctcgaagaaaacggcttcgatcgcgattgcccagtcytccgtacttccgcttacggcgctttgcatgatgacgctccagaccacgacaagtgggtagagaccgtcaaggaactcatgaaggctgttgacgagtacatcccaaccccaactcacgatcttgacaagccattcttgatgccaatcgaagatgtgttcaccatctccggtcgtggtyccgttgtcaccggtcgtgttgagcgtggtaagctcccaatcaacaccccagttgagatcgttggtttgcgcgatacccagaccaccaccgtcacctctatcgagaccttccacaagcagatggatgaggcagaggctggcgataacactggtcttcttctccgcggtatcaaccgtaccgacgttgagcgtggtcaggttgtggctgctccaggttctgtgactccacacaccaagttcgaaggcgaagtttacgtcttgaccaaggacgaaggtggccgtcactcgccattcttctccaactaccgtccacagttctacttccgtaccaccgatgttactggcgttatcaccttgccagacggcatcgaaatggttcagccaggcgatcacgcaaccttcactgttgagttgatccaggctatcgcaatggaagag

SEQ ID NO: 1724 - DNA, 817 bp, Listeria innocua
  ref <308>: DATABASE ACCESSION NUMBER: ATCC 33090
cggagctatcttagtagtatctgctgctgatggcccaatgccacaaactcgtgaacatatcttactttcacgtcaagttggtgttccatacatcgttgtattcatgaacaaatgtgacatggttgacgatgaagaattactagaattagttgaaatggaaattcgtgatctattaactgaatatgaattccctggcgatgacattcctgtaatcaaaggttcagctcttaaagcacttcaaggtgaagctgactgggaagctaaaattgacgagttaatggaagctgtagattcttacattccaactccagaacgtgatactgacaaaccattcatgatgccagttgaggatgtattctcaatcactggtcgtggaacagttgcaactggacgtgttgaacgtggacaagttaaagttggtgacgaagtagaagttatcggtattgaagaagaaagcaaaaaagtagtagtaactggagtagaaatgttccgtaaattactagactacgctgaagctggcgacaacattggcgcacttctacgtggtgttgctcgtgaagatatccaacgtggtcaagtattagctaaaccaggttcgattactccacacactaacttcaaagctgaaacttatgttttaactaaagaagaaggtggacgtcacactccattcttcaacaactaccgcccacaattctatttccgtactactgacgtaactggtattgttacacttccagaaggtactgaaatggtaatgcctggtgataacattgagcttgcagttgaactaattgcaccaatcgctatcgaagac

SEQ ID NO: 1725 - DNA, 818 bp, Listeria ivanovii
  ref <308>: DATABASE ACCESSION NUMBER: ATCC 19119
cggagctatcttagtagtatctgctgctgatggtccaatgccacaaactcgtgaacatattcttactttcacgtcaagttggtgttccatacatcgttgtattcatgaacaaatgtgacatggttgacgatgaagaattacttgaattagttgaaatggaaattcgtgatctattaactgaatatgaattccctggcgacgacattcctgtaatcaaaggttcagctcttaaagcacttcaaggtgaagctgattgggaagctaaaattgacgagttaatggaagctgtagattcttacattccaactccagaacgtgatactgacaaaccattcatgatgccagttgaggatgtattctcaatcactggtcgtggaacagttgcaactggacgtgttgaacgtggacaagttaaagttggtgacgaagtagaagttatcggtattgaagaagaaagcaaaaaagtagtagtaactggagtagaaatgttccgtaaattactagactacgctgaagctggcgacaacattggcgcacttctacgtggtgttgctcgtgaagatatccaacgtggtcaagtattagctaaaccaggttcgattactccacatactaacttcaaagctgaaacttatgttttaactaaagaagaaggtggacgtcatactccattcttcaacaactaccgcccacaattctatttccgtactactgacgtaactggtattgttacacttccagaaggtactgaaatggtaatgcctggtgataacattgagcttgcagttgaactaattgcaccaatcgctatcgaagac

SEQ ID NO: 1726 - DNA, 817 bp, Listeria monocytogenes
  strain LSPQ 5093202
cggagctatcttagtagtatctgctgctgatggcccaatgccacaaactcgtgaacatatcttactttcacgtcaagttggtgttccatacatcgttgtattcatgaacaaatgtgacatggttgacgatgaagaattactagaattagttgaaatggaaattcgtgatctattaactgaatatgaattccctggcgatgacattcctgtaatcaaaggttcagctcttaaagcacttcaaggtgaagctgactgggaagctaaaattgacgagttaatggaagctgtagattcttacattccaactccwgaacgtgatactgacaaaccattcatgatgccagttgaggatgtattctcaatcactggtcgtggaacagttgcaactggacgtgttgaacgtggacaagttaaagttggtgacgaagtagaagttatcggtatcgaagaagaaagcaaaaaagtagtagtaactggagtagaaatgttccgtaaattactagactacgctgaagctggcgacaacattggcgcacttctacgtggtgttgctcgtgaagatatccaacrtggtcaagtattagctaaaccaggttcgattactccacacactaacttcaaagctgaaacttatgttttaactaaagaagaaggtggacgtcacactccattcttcaacaactaccgcccacaattctatttccgtactactgacgtaactggtattgttacacttccagaaggtactgaaatggtaaygcctggtgataacattgagcttgcagttgaactaattgcaccaatcgctatcgaagac

SEQ ID NO: 1727 - DNA, 817 bp, Listeria seeligeri
  ref <308>: DATABASE ACCESSION NUMBER: ATCC 35967
cggagctatcttagtagtatctgctgctgatggcccaatgccacaaactcgtgaacatatcttactttcacgtcaagttggtgttccatacatcgttgtattcatgaacaaatgtgacatggttgacgatgaagaattacttgaattagttgaaatggaaattcgtgatctattaactgaatatgaattccctggtgatgacattcctgtaatcaaaggttcagctcttaaagcacttcaaggtgaagctgactgggaagctaaaattgacgagttaatggaagctgtagattcttacattccaactccagaacgtgatactgacaaaccattcatgatgccagttgaggatgtattctcaatcactggtcgtggaactgttgcaactggacgtgttgaacgtggacaagttaaagttggtgacgaagtagaagttatcggtattgaagaagaaagcaaaaaagtaatagtaactggagtagaaatgttccgtaaattactagactacgctgaagctggcgacaacattggcgcacttctacgtggtgttgctcgtgaagatatccaacgtggtcaagtattagctaaaccaggttcgattactccacatactaacttcaaagctgaaacttatgttttaactaaagaagaaggtggacgtcacactccattcttcaacaactaccgcccacaattctatttccgtactactgacgtaactggtattgttacacttccagaaggtactgaaatggtaatgcctggtgataacattgagcttgcagttgaactaattgcaccaatcgctatcgaagac

SEQ ID NO: 1728 - DNA, 814 bp, Staphylococcus aureus
  ref <308>: DATABASE ACCESSION NUMBER: ATCC 25923
cggtggtatcttagtagtatctgctgctgacggtccaatgccacaaactcgtgaacacattcttttatcacgtaacgttggtgtaccagcattagtagtattcttaaacaaagttgacatggttgacgatgaagaattattagaattagtagaaatggaagttcgtgacttattaagcgaatatgacttcccaggtgacgatgtacctgtaatcgctggttcagcattaraagctttagaaggcgatgctcaatacgaagaaaaaatcttagaattartggaagctgtagatacttacattccaactccagaacgtgattctgacaaaccattcatgatgccagttgaggacgtattctcaatcactggtcgtggtactgttgctacaggccgtgttgaacgtggtcaaatcaaagttggtgaagaagttgaaatcatcggtttacatgacacatctaaaacaactgttacaggtgttgaaatgttccgtaaattattagactacgctgaagctggtgacaacattggtgcattattacgtggtgttgctcgtgaagacgtacaacgtggtcaagtattagctgctcctggttcaattacaccacatactgaattcaaagcagaagtatacgtattatcaaaagacgaaggtggacgtcacactccattcttctcaaactatcgtccacaattctatttccgtactactgacgtaactggtgttgttcacttaccagaaggtactgaaatggtaatgcctggtgataacgttgaaatgacagtagaattaatcgctccaatcgcgattgaagac

SEQ ID NO: 1729 - DNA, 817 bp, Staphylococcus saprophyticus
  ref <308>: DATABASE ACCESSION NUMBER: ATCC 15305
cggagctatcttagtagtatctgctgctgatggcccaatgccacaaactcgtgaacacattcttttatcacgtracgttggtgytccagcattagttgtattcttaaacaaagttgacatggttgacgaygaagaattattagaattrgtagaaatggaagttcgtgrcttattaagcgaatatgacttcccaggtgacgatgtacctgtaatctctggttctgcattaaaagctttagaaggcgacgctgactatgagcaaaaaatcttagacttaatgcaagctgttgatgactycattccaacaccagaacgtgattctgacaaaccattcatgatgccagttgaggacgtattctcaatcactggtcgtggtactgttgctacaggccgtgttgaacgtggtcaaatcaaagtcggtgaagaaatcgaratcatcggtatgcaagaagaatcaagcaaaacaactgttactggtgtagaaatgttccgtaaattattagactacgctgaagctggtgacaacattggtgcattattacgtggtgtttcacgtgatgatgtacaacgtggtcaagttttagctgctcctggtactatcacaccacatacaaaattcaaagcggatgtttacgttttatctaaagatgaaggtggtcgtcatacgccattcttcactaactaccgcccacaattctatttccgtactactgacgtaactggtgttgttaacttaccagaaggtactgaaatggttatgcctggcgataacgttgaaatggatgttgaattaatttctccaatcgctattgaagac

SEQ ID NO: 1730 - DNA, 817 bp, Staphylococcus simulans
  ref <308>: DATABASE ACCESSION NUMBER: ATCC 27848
cggcggtatcttagtagtatctgctgcagatggtccaatgccacaaactcgtgaacacatcttattatcacgtaacgttggtgtaccagctttagttgtattcttaaacaaagctgacatggttgacgacgaagaattattagaattagttgaaatggaagttcgtgacttattatctgaatacgacttccctggtgacgatgtaccagttatcgttggttctgcattaaaagctttagaaggcgacccagaatacgaacaaaaaatcttagacttaatgcaagctgtagatgactacatcccaactccagaacgtgactctgataaaccattcatgatgccagttgaggacgtattctcaatcactggtcgtggtactgtagcaacaggccgtgttgaacgtggtcaaatcaaagtcggtgaagaagttgaaatcatcggtatcactgaagaaagcaagaaaacaacagttacaggtgtagaaatgttccgtaaattattagactacgctgaagctggtgacaacatcggtgctttattacgtggtgttgcacgtgaagacgtacaacgtggacaagtattagcagctcctggctctattactccacacacaaaattcaaagctgatgtttacgttttatctaaagaagaaggtggacgtcatactccattcttcactaactaccgcccacaattctacttccgtactactgacgtaactggcgttgttcacttaccagaaggtactgaaatggttatgcctggcgataacgtagaaatgactgttgaattgatcgctccaatcgcgattgaagac

SEQ ID NO: 1731 - DNA, 817 bp, Streptococcus agalactiae
  ref <308>: DATABASE ACCESSION NUMBER: ATCC 27591
cggagctatccttgtagttgcttcaactgatggaccaatgccacaaactcgtgagcacatccttctttcacgtcaagttggtgttaaacaccttatcgtattcatgaacaaagttgaccttgttgatgatgaagaattgcttgaattggttgaaatggaaattcgtgaccttctttcagaatacgacttcccaggtgatgaccttccagttatccaaggttcagctcttaaagcacttgaaggcgacgaaaaatacgaagacatcatcatggaattgatgagcactgttgatgagtacattccagaaccagaacgtgatactgacaaacctttacttcttccagttgaagatgtattctcaatcactggacgtggtacagttgcttcaggacgtatcgaccgtggtactgttcgtgtcaacgacgaagttgaaatcgttggtattaaagaagatatccaaaaagcagttgttactggtgttgaaatgttccgtaaacaacttgacgaaggtcttgcaggggacaacgttggtgttcttcttcgtggtgttcaacgtgatgaaatcgaacgtggtcaagttcttgctaaaccaggttcaatcaacccacacactaaatttaaaggtgaagtttacatcctttctaaagaagaaggtggacgtcatactccattcttcaacaactaccgtccacaattctacttccgtacaactgacgtaacaggttcaatcgaacttccagcaggaacagaaatggttatgcctggtgataacgttactatcgaagttgaattgattcacccaatcgccgtagaacaa

SEQ ID NO: 1732 - DNA, 817 bp, Streptococcus pneumoniae
  ref <308>: DATABASE ACCESSION NUMBER: ATCC 27336
cggagctatccttgtagtagcttcaactgacggaccaatgccacaaactcgtgagcacatccttctttcacgtcaggttggtgttaaacaccttatcgtcttcatgaacaaagttgacttggttgacgacgaagaattgcttgaattggttgaaatggaaatccgtgacctattgtcagaatacgacttcccaggtgacgatcttccagttatccaaggttcagcacttaaagctcttgaaggtgactctaaatacgaagacatcgttatggaattgatgaacacagttgatgagtatatcccagaaccagaacgtgacactgacaaaccattgcttcttccagtcgaggacgtattctcaatcactggacgtggtacagttgcttcaggacgtatcgaccgtggtatcgttaaagtcaacgacgaaatcgaaatcgttggtatcaaagaagaaactcraaaagcagttgttactggtgttgaaatgttccgtaaacaacttgacgaaggtcttgctggagataacgtaggtgtccttcttcgtggtgttcaacgtgatgaaatcgaacgtggacaagttatcgctaaaccaggttcaatcaacccacacactaaattcaaaggtgaagtctacatccttactaaagaagaaggtggacgtcacactccattcttcaacaactaccgtccacaattctacttccgtactactgacgttacaggttcaatcgaacttccagcaggtactgaaatggtaatgcctggtgataacgtgacaatcgacgttgagttgattcacccaatcgccgtagaacaa

SEQ ID NO: 1733 - DNA, 817 bp, Streptococcus salivarius
  ref <308>: DATABASE ACCESSION NUMBER: ATCC 7073
cggtgcgatccttgtagtagcatctactgacggaccaatgccacaaactcgtgagcacatccttctttcacgtcaggttggtgttaaacaccttatcgtcttcatgaacaaagttgacttggttgacgatgaagaattgcttgaattggttgaaatggaaatccgtgaccttctttcagaatacgatttcccaggtgatgacattccagttatccaaggttcagctcttaaagctcttgaaggtgattctaaatacgaagacatcatcatggacttgatgaacactgttgacgaatacatcccagaaccagaacgtgacactgacaaaccattgttgcttccagtcgaagacgtattctcaatcactggtcgtggtactgttgcttcaggacgtatcgaccgtggtgttgttcgtgtcaatgacgaagttgaaatcgttggtcttaaagaagacatccaaaaagcagttgttactggtgttgaaatgttccgtaaacaacttgacgraggtattgccggagataacgtcggtgttcttcttcgtggtatccaacgtgatgaaatcgaacgtggtcaagtattggctgcacctggttcaatcaacccacacactaaattcaaaggtgaagtttacatcctttctaaagaagaaggtggacgtcacactccattcttcaacaactaccgtccacagttctacttccgtacaactgacgtaacaggttcaatcgaacttcctgcaggtactgaaatggttatgcctggtgataacgtgactatcgacgttgagttgatccacccaatcgccgttgaacaa

SEQ ID NO: 1734 - DNA, 897 bp, Agrobacterium tumefaciens
aacatgatcaccggtgctgccgagatggacggcgcgatcctggtttgctcggctgccgacggcccgatgccacagacccgcgagcacatcctgcttgcccgtcaggtgggcgttccggccatcgtcgtgttcctcaacaaggtcgaccaggttgacgacgccgagcttctcgagctcgtcgagcttgaagttcgcgaacttctgtcgtcctacgacttcccgggcgacgatatcccgatcatcaagggttcggcacttgctgctcttgaagattctgacaagaagatcggtgaagacgcgatccgcgagctgatggctgctgtcgacgcctacatcccgacgcctgagcgtccgatcgaccagccgttcctgatgccgatcgaagacgtgttctcgatctcgggtcgtggtacggttgtgacgggtcgcgttgagcgcggtatcgtcaaggttggtgaagaagtcgaaatcgtcggcatccgtccgacctcgaagacgactgttaccggcgttgaaatgttccgcaagctgctcgaccagggccaggccggcgacaacatcggtgcactcgttcgcggcgttacccgtgacggcgtcgagcgtggtcagatcctgtgcaagccgggttcggtcaagccgcacaagaagttcatggcagaagcctacatcctgacgaaggaagaaggcggccgtcatacgccgttcttcacgaactaccgtccgcagttctacttccgtacgactgacgttaccggtatcgtttcgcttcctgaaggcacggaaatggttatgcctggcgacaacgtcactgttgaagtcgagctgatcgttccgatcgcgatggaagaaaagctgcgcttcgctatccgcgaaggcggccgtaccgtcggcgccggc

SEQ ID NO: 1735 - DNA, 885 bp, Bacillus subtilis
  strain 168
atgatcactggtgctgcgcaaatggacggagctatccttgtagtatctgctgctgatggcccaatgccacaaactcgtgagcacatccttctttctaaaaacgttggtgtaccatacatcgttgtattcttaaacaaatgcgacatggtagacgacgaagagcttcttgaactagttgaaatggaagttcgcgatcttcttagcgaatacgacttccctggtgatgatgtaccagttgttaaaggttctgctcttaaagctcttgaaggagacgctgagtgggaagctaaaatcttcgaacttatggatgcggttgatgagtacatcccaactccagaacgcgacactgaaaaaccattcatgatgccagttgaggacgtattctcaatcactggtcgtggtacagttgctactggccgtgtagaacgcggacaagttaaagtcggtgacgaagttgaaatcatcggtcttcaagaagagaacaagaaaacaactgttacaggtgttgaaatgttccgtaagcttcttgattacgctgaagctggtgacaacattggtgcccttcttcgcggtgtatctcgtgaagaaatccaacgtggtcaagtacttgctaaaccaggtacaatcactccacacagcaaattcaaagctgaagtttacgttctttctaaagaagagggtggacgtcatactccattcttctctaactaccgtcctcagttctacttccgtacaactgacgtaactggtatcatccatcttccagaaggcgtagaaatggttatgcctggagataacactgaaatgaacgttgaacttatttctacaatcgctatcgaagaaggaactcgtttctctattcgtgaaggcggacgtactgttggt

SEQ ID NO: 1736 - DNA, 882 bp, Bacteroides fragilis
  DSM 2151
atggttactggtgctgctcagatggacggtgctatcattgtagttgctgctactgatggtccgatgcctcagactcgtgagcacatccttttggctcgtcaggtaaacgttccgaagctggttgtattcatgaacaagtgcgatatggttgaagatgctgagatgttggaacttgttgaaatggaaatgagagaattgctttcattctatgatttcgacggtgacaatactccgatcattcagggttctgctcttggtgcattgaacggcgtagaaaaatgggaagacaaagtaatggaactgatggaagctgttgatacttggattccactgcctccgcgcgatgttgataaacctttcttgatgccggtagaagacgtgttctctatcacaggtcgtggtactgtagctacaggtcgtatcgaaactggtgttatccatgtaggtgatgaaatcgaaatcctcggtttgggtgaagataagaaatcagttgtaacaggtgttgaaatgttccgcaaacttctggatcagggtgaagctggtgacaacgtaggtctgttgcttcgtggtgttgacaagaacgaaatcaaacgtggtatggttctttgtaaaccgggtcagattaaacctcactctaaattcaaagcagaggtttatatcctgaagaaagaagaaggtggtcgtcacactccattccataacaaatatcgtcctcagttctacctgcgtactatggactgtacaggtgaaatcactcttccggaaggaactgaaatggtaatgccgggtgataacgtaactatcactgtagagttgatctatccggttgcactgaacatcggtcttcgtttcgctatccgcgaaggtggacgtacagtaggt

SEQ ID NO: 1737 - DNA, 888 bp, Borrelia burgdorferi
  strain U78183
aatatgattacaggagcagctcaaatggatgcagcgatacttttagttgctgctgatagtggtgctgagcctcaaacaaaagagcatttgcttcttgctcaaagaatgggaataaagaaaataatagtttttttaaataaattggacttagcagatcctgaacttgttgagcttgttgaagttgaagttttagaacttgttgaaaaatatggcttttcagctgatactccaataatcaaaggttcagcttttggggctatgtcaaatccagaagatcctgaatctacaaaatgcgttaaagaacttcttgaatctatggataattattttgatcttccagaaagagatattgacaagccatttttgcttgctgttgaagatgtattttctatttcaggaagaggcactgttgctactgggcgtattgaaagaggtattattaaagttggtcaagaagttgaaatagttggaattaaagaaaccagaaaaactactgttactggtgttgaaatgttccagaaaattcttgagcaaggtcaagcaggggataatgttggtcttcttttgagaggcgttgataaaaaagacattgagagggggcaagttttgtcagctccaggtacaattactccacacaagaaatttaaagcttcaatttattgtttgactaaagaagaaggcggtaggcacaagccatttttcccagggtatagaccacagttcttttttagaacaaccgatgttactggagttgttgctttagagggcaaagaaatggttatgcctggtgataatgttgatattattgttgagctgatctcttcaatagctatggataagaatgtagaatttgctgttcgagaaggtggaagaaccgttgcttcagga

SEQ ID NO: 1738 - DNA, 894 bp, Brevibacterium linens
  DSM 20425
aacatgatcaccggtgccgctcagatggacggtgcgatcctcgtcgtcgccgctaccgacggaccgatgccccagacccgtgagcacgtgctgctcgcgcgtcaggtcggcgttccctacatcgtcgtggctctgaacaagtccgacatggtcgatgacgaggagctcctcgagctcgtcgaattcgaggtccgcgacctgctctcgagccaggacttcgacggagacaacgctccggtcattccggtgtccgctctcaaggcgctggaaggcgacgagaagtgggtcaagagcgttcaggatctcatggctgccgtcgatgacaacgttccggagccggagcgcgatgtcgacaagccgttcctcatgcccgtcgaggacgtcttcacgatcaccggtcgtggaaccgtcgtcaccggtcgtgtcgagcgcggcgtgctcctgcctaacgacgaaatcgaaatcgtcggcatcaaggagaagtcgtccaagacgactgtcaccgctatcgagatgttccgcaagaccctgccggatgcccgtgcaggtgagaacgtcggtctgctcctccgcggcaccaagcgcgaggatgttgagcgcggtcaggtcatcgtgaagccgggttcgatcaccccgcacaccaagttcgaggctcaggtctacatcctgagcaaggacgagggcggacgtcacaacccgttctactcgaactaccgtccgcagttctacttccggaccacggacgtcaccggtgtcatcacgctgcccgagggcaccgagatggtcatgcccggcgacaacaccgatatgtcggtcgagctcatccagccgatcgctatggaggaccgcctccgcttcgcaatccgcgaaggtggccgcaccgtcggcgccggt

SEQ ID NO: 1739 - DNA, 888 bp, Chlamydia trachomatis
  strain F/IC-Cal-13
atgatcacgggcgcagcgcagatggacggcgcgatcctggtttgctcggcagcagacggcccgatgccgcaaacgcgtgagcacatcctgctggcgcgtcaggttggtgttccgtacatcatcgtgttcctgaacaagtgcgacagtgtggacgacgctgaactgctcgagctggtcgagatggaagttcgcgaactcctgtcgaagtacgacttcccgggcgacgacacgccgatcgtgaagggttcggccaagctggcgctggaaggcgacacgggcgagctgggcgaagtggcgatcatgagcctggcagacgcgctggacacgtacatcccgacgccggagcgtgcagttgacggcgcgttcctgatgccggtggaagacgtgttctcgatctcgggccgtggtacggtggtgacgggtcgtgtcgagcgcggcatcgtgaaggtcggcgaagaaatcgaaatcgtcggtatcaagccgacggtgaagacgacctgcacgggcgttgaaatgttccgcaagctgctggaccaaggtcaggcaggcgacaacgtcggtatcctgctgcgcggcacgaagcgtgaagacgtggagcgtggccaggttctggcgaagccgggttcgatcacgccgcacacgcacttcacggctgaagtgtacgtgctgagcaaggacgaaggcggccgtcacacgccgttcttcaacaactaccgtccgcagttctacttccgtacgacggacgtgacgggctcgatcgagctgccgaaggacaaggaaatggtgatgccgggcgacaacgtgtcgatcacggtgaagctgattgctccgatcgcgatggaagaaggtctgcgcttcgcaatccgtgaaggcggccgtacggtcggc

SEQ ID NO: 1740 - DNA, 891 bp, Fibrobacter succinogenes
  strain S85
aacatggtgactggtgctgctcagatggacggcgctatcctcgttgttgccgctactgacggtccgatgccgcagactcgcgaacacatccttctcgctcaccaggttggcgtgccgaagatcgtcgtgttcatgaacaagtgcgacatggttgacgatgctgaaattctcgacctcgtcgaaatggaagttcgcgaactcctctccaagtatgacttcgacggtgacaacaccccgatcatccgtggttccgctctcaaggccctcgaaggcgatccggaataccaggacaaggtcatggaactcatgaacgcttgcgacgaatacatcccgctcccgcagcgcgataccgacaagccgttcctcatgccgatcgaagacgtgttcacgattactggccgcggcactgtcgctactggccgtatcgaacgcggtgtcgttcgcttgaacgacaaggttgaacgtatcggtctcggtgaaaccaccgaatacgtcatcaccggtgttgaaatgttccgtaagctcctcgacgacgctcaggcaggtgacaacgttggtctcctcctccgtggtgctgaaaagaaggacatcgtccgtggcatggttctcgcagctccgaagtctgtcactccgcacaccgaatttaaggctgaaatctacgttctcacgaaggacgaaggtggccgtcacacgccgttcatgaatggctaccgtccgcagttctacttccgcaccaccgacgttactggtacgatccagctcccggaaggtgtcgaaatggttactccgggtgacacggtcacgatccacgtgaacctcatcgctccgatcgctatggaaaagcagctccgcttcgctatccgtgaaggtggacgtactgttggtgctggc

SEQ ID NO: 1741 - DNA, 894 bp, Flavobacterium ferrugineum
  DSM 13524
aacatgatcaccggtgctgcccagatggacggtgctatcttagttgtggctgcatcagacggtcctatgcctcaaacaaaagaacacatcctgcttgctgcccaggtaggtgtacctaaaatggttgtgtttctgaataaagttgacctcgttgacgacgaagagctcctggagctggttgagatcgaggttcgcgaagaactgactaaacgcggtttcgacggcgacaacactccaatcatcaaaggttccgctacaggcgccctcgctggtgaagaaaagtgggttaaagaaattgaaaacctgatggacgctgttgacagctacatcccactgcctcctcgtccggttgatctgccgttcctgatgagcgtagaggacgtattctctatcactggtcgtggtactgttgctaccggtcgtatcgagcgtggccgtatcaaagttggtgagcctgttgagatcgtaggtctgcaggagtctcccctgaactctaccgttacaggtgttgagatgttccgcaaactcctcgacgaaggtgaagctggtgataacgccggtctcctcctccgtggtgttgaaaaaacacagatccgtcgcggtatggtaatcgttaaacccggttccatcactccgcacacggacttcaaaggcgaagtttacgtactgagcaaagacgaaggtggccgtcacactccattcttcaacaaataccgtcctcaattctacttccgtacaactgacgttacaggtgaagtagaactgaacgcaggaacagaaatggttatgcctggtgataacaccaacctgaccgttaaactgatccaaccgatcgctatggaaaaaggtctgaaattcgcgatccgcgaaggtggccgtaccgtaggtgcagga

SEQ ID NO: 1742 - DNA, 906 bp, Helicobacter pylori
  strain 26695
aacatgatcaccggtgcggcgcaaatggacggagcgattttggttgtttctgcagctgatggccctatgcctcaaactagggagcatatcttattgtctcgtcaagtaggcgtgcctcacatcgttgttttcttaaacaaacaagacatggtagatgaccaagaattgttagaacttgtagaaatggaagtgcgcgaattgttgagcgcgtatgaatttcctggcgatgacactcctatcgtagcgggttcagctttaagagctttagaagaagcaaaggctggtaatgtgggtgaatggggtgaaaaagtgcttaaacttatggctgaagtggatgcctatatccctactccagaaagagacactgaaaaaactttcttgatgccggttgaagatgtgttctctattgcgggtagagggactgtggttacaggtaggattgaaagaggcgtggtgaaagtaggcgatgaagtggaaatcgttggtatcagacctacacaaaaaacgactgtaaccggtgtagaaatgtttaggaaagagttggaaaaaggtgaagccggcgataatgtgggcgtgcttttgagaggaactaaaaaagaagaagtggaacgcggtatggttctatgcaaaccaggttctatcactccgcacaagaaatttgagggagaaatttatgtcctttctaaagaagaaggcgggagacacactccattcttcaccaattaccgcccgcaattctatgtgcgcacaactgatgtgactggctctatcacccttcctgaaggcgtagaaatggttatgcctggcgataatgtgaaaatcactgtagagttgattagccctgttgcgttagagttgggaactaaatttgcgattcgtgaaggcggtaggaccgttggtgctggt

SEQ ID NO: 1743 - DNA, 891 bp, Micrococcus luteus
  strain IFO 3333
aacatgatcaccggcgccgctcagatggacggcgcgatcctcgtggtcgccgctaccgacggcccgatggcccagacccgtgagcacgtgctcctggcccgccaggtcggcgtgccggccctgctcgtggccctgaacaagtcggacatggtggaggacgaggagctcctcgagcgtgtcgagatggaggtccggcagctgctgtcctccaggagcttcgacgtcgacgaggccccggtcatccgcacctccgctctgaaggccctcgagggcgacccccagtgggtcaagtccgtcgaggacctcatggatgccgtggacgagtacatcccggacccggtgcgcgacaaggacaagccgttcctgatgccgatcgaggacgtcttcacgatcaccggccgtggcaccgtggtgaccggtcgcgccgagcgcggcaccctgaagatcaactccgaggtcgagatcgtcggcatccgcgacgtgcagaagaccactgtcaccggcatcgagatgttccacaagcagctcgacgaggcctgggccggcgagaactgcggtctgctcgtgcgcggtctgaagcgcgacgacgtcgagcgcggccaggtgctggtggagccgggctccatcaccccgcacaccaacttcgaggcgaacgtctacatcctgtccaaggacgagggtgggcgtcacaccccgttctactcgaactaccgcgcgcagttctacttccgcaccaccgacgtcaccggcgtcatcacgctgcccgagggcaccgagatggtcatgcccggcgacaccaccgagatgtcggtcgagctcatccagccgatcgccatggaggagggcctcggcttcgccatccgcgagggtggccgcaccgtgggctccggc

SEQ ID NO: 1744 - DNA, 891 bp, Mycobacterium tuberculosis
  strain Erdmann
aacatgatcaccggcgccgcgcagatggacggtgcgatcctggtggtcgccgccaccgacggcccgatgccccagacccgcgagcacgttctgctggcgcgtcaagtgggtgtgccctacatcctggtagcgctgaacaaggccgacgcagtggacgacgaggagctgctcgaactcgtcgagatggaggtccgcgagctgctggctgcccaggaattcgacgaggacgccccggttgtgcgggtctcggcgctcaaggcgctcgagggtgacgcgaagtgggttgcctctgtcgaggaactgatgaacgcggtcgacgagtcgattccggacccggtccgcgagaccgacaagccgttcctgatgccggtcgaggacgtcttcaccattaccggccgcggaaccgtggtcaccggacgtgtggagcgcggcgtgatcaacgtgaacgaggaagttgagatcgtcggcattcgcccatcgaccaccaagaccaccgtcaccggtgtggagatgttccgcaagctgctcgaccagggccaggcgggcgacaacgttggtttgctgctgcggggcgtcaagcgcgaggacgtcgagcgtggccaggttgtcaccaagcccggcaccaccacgccgcacaccgagttcgaaggccaggtctacatcctgtccaaggacgagggcggccggcacacgccgttcttcaacaactaccgtccgcagttctacttccgcaccaccgacgtgaccggtgtggtgacactgccggagggcaccgagatggtgatgcccggtgacaacaccaacatctcggtgaagttgatccagcccgtcgccatggacgaaggtctgcgtttcgcgatccgcgagggtggccgcaccgtgggcgccggc

SEQ ID NO: 1745 - DNA, 891 bp, Mycoplasma genitalium
  strain G37
aatatgatcacaggtgctgcacaaatggatggagctattctagttgtttcagcaactgatagtgtgatgccccaaacccgcgagcacatcttacttgcccgccaagtaggggttcctaaaatggtagtttttctaaacaagtgtgatattgctagtgatgaagaggtacaagaacttgttgctgaagaagtacgtgatctgttaacttcctatggttttgatggtaagaacactcctattatttatggctcagctttaaaagcattggaaggtgatccaaagtgggaggctaagatccatgatttgattaaagcagttgatgaatggattccaactcctacacgtgaagtagataaacctttcttattagcaattgaagatacgatgaccattactggtagaggtacagttgttacaggaagagttgaaagaggtgaactcaaagtaggtcaagaagttgaaattgttggtttaaaaccaattagaaaagcagttgttactggaattgaaatgttcaaaaaggaacttgattcagcaatggctggtgacaatgctggggtattattacgtggtgttgaacgtaaagaagttgaaagaggtcaagttttagcaaaaccaggctctattaaaccgcacaagaaatttaaagctgagatctatgctttaaagaaagaagaaggtggtagacacactggttttttaaacggttaccgtcctcaattctatttccgtaccactgatgtaactggttctattgctttagctgaaaatactgaaatggttctacctggtgataatgcttctattactgttgagttaattgctcctatcgcttgtgaaaaaggtagtaagttctcaattcgtgaaggtggtagaactgtaggggcaggc

SEQ ID NO: 1746 - DNA, 891 bp, Neisseria gonorrhoeae
  strain MS11
aacatgattaccggcgccgcacaaatggacggtgcaatcctggtatgttctgctgccgacggccctatgccgcaaacccgcgaacacatcctgctggcccgtcaagtaggcgtaccttacatcatcgtgttcatgaacaaatgcgacatggtcgacgatgccgagctgttccaactggttgaaatggaaatccgcgacctgctgtccagctacgacttccccggcgacgactgcccgatcgtacaaggttccgcactgaaagccttggaaggcgatgccgcttacgaagaaaaaatcttcgaactggctaccgcattggacagatacatcccgactcccgagcgtgccgtggacaaaccattcctgctgcctatcgaagacgtgttctccatttccggccgcggtaccgtagtcaccggccgtgtagagcgaggtatcatccacgttggtgacgagattgaaatcgtcggtctgaaagaaacccaaaaaaccacctgtaccggcgttgaaatgttccgcaaactgctggacgaaggtcaggcgggcgacaacgtaggcgtattgctgcgcggtaccaaacgtgaagacgtagaacgcggtcaggtattggccaaacggggtactatcactcctcacaccaagttcaaagcagaagtgtacgtattgagcaaagaagagggcggcccccataccccgtttttcgccaactaccgtccccaattctacttccgtaccactgacgtaaccggcacgattactttggaaaaaggtgtggaaatggtaatgccgggtgagaacgtaaccattactgtagaactgattgcgcctatcgctatggaagaaggtctgcgctttgcgattcgcgaaggcggccgtaccgtgggtgccggc

SEQ ID NO: 1747 - DNA, 891 bp, Rickettsia prowazekii
  strain Madrid E
aatatgataactggtgccgctcagatggatggtgctatattagtagtttctgctgctgatggtcctatgcctcaaactagagaacatatattactggcaaaacaggtaggtgtacctgctatggtagtatttttgaataaagtagatatggtagatgatcctgacctattagaattagttgagatggaagtaagagaattattatcaaaatatggtttccctggtaatgaaatacctattattaaaggttctgcacttcaagctttagaaggaaaacctgaaggtgaaaaagctattaatgagttaatgaatgcagtagatacgtatatacctcagcctatagagctacaagataaaccttttttaatgccaatagaggatgtattttctatttcaggcagaggtaccgttgtaactggtagagtggagtcaggcataattaaggtgggtgaagaaattgaaatagtaggtctaaaaaatacgcaaaaaacgacttgtacaggtgtagaaatgttcagaaaattacttgatgaaggacaatctggagataatgtcggtatattactacgtggtacaaaaagagaagaagtagaaagaggacaagtacttgcaaaacctgggagcataaaaccgcatgataaatttgaagctgaagtgtatgtgcttagtaaagaggaaggtggacgtcataccccatttactaatgattatcgcccacagttctattttagaacaacagatgttaccggcacaataaaattgccttctgataagcagatggttatgcctggagataatgctactttttcagtagaattaattaagccgattgctatgcaagaagggttaaaattctctatacgtgaaggtggtagaacagtaggagccggt

SEQ ID NO: 1748 - DNA, 891 bp, Salmonella choleraesuis subsp. choleraesuis
  strain LT2 trpE9
aacatgatcaccggtgctgctcagatggacggcgcgatcctggttgttgctgcgactgacggcccgatgccgcagacccgtgagcacatcctgctgggtcgtcaggtaggcgttccgtacatcatcgtgttcctgaacaaatgcgacatggttgatgacgaagagctgctggaactggttgagatggaagttcgcgaactgctgtctcagtacgacttcccgggcgacgacactccgatcgttcgtggttctgctctgaaagcgctggaaggcgacgcagagtgggaagcgaaaatcatcgaactggctggcttcctggattcttatattccggaaccagagcgtgcgattgacaagccgttcctgctgccgatcgaagacgtattctccatctccggtcgtggtaccgttgttaccggtcgtgtagagcgcggtatcatcaaagtgggcgaagaagttgaaatcgttggtatcaaagagactcagaagtctacctgtactggcgttgaaatgttccgcaaactgctggacgaaggccgtgccggtgagaacgtaggtgttctgctgcgtggtatcaaacgtgaagaaatcgaacgtggtcaggtactggctaagccgggcaccatcaagccgcacaccaagttcgaatctgaagtgtacattctgtccaaagatgaaggcggccgtcatactccgttcttcaaaggctaccgtccgcagttctacttccgtactactgacgtgactggtaccatcgaactgccggaaggcgtagagatggtaatgccgggcgacaacatcaaaatggttgttaccctgatccacccgatcgcgatggacgacggtctgcgtttcgcaatccgtgaaggcggccgtaccgttggcgcgggc

SEQ ID NO: 1749 - DNA, 881 bp, Shewanella putrefaciens
  DSM 50426
atgatcactggtgctgcacagatggacggcgcgattctggtagtcgcttcaacagacggtccaatgccacagactcgtgagcacatcctgctttctcgtcaggttggcgtaccattcatcatcgtattcatgaacaaatgtgacatggtagatgacgaagagctgttagagctagttgagatggaagtgcgtgaactgttatcagaatacgatttcccaggtgatgacttaccggtaatccaaggttcagctctgaaagcgctagaaggcgagccagagtgggaagcaaaaatccttgaattagcagcggcgctggattcttacattccagaaccacaacgtgacatcgataagccgttcctactgccaatcgaagacgtattctcaatttcaggccgtggtacagtagtaacaggtcgtgttgagcgtggtattgtacgcgtaggcgacgaagttgaaatcgttggtgtacgtgcgacaactaagacaacgtgtactggtgtagaaatgttccgtaaactgcttgacgaaggtcgtgcaggtgagaactgtggtattttgttacgtggtactaagcgtgatgacgtagaacgtggtcaagtattagcgaagccaggttcaatcaacccacacactacttttgaatcagaagtttacgtactgtcaaaagaagaaggtggtcgtcacacgccattcttcaaaggctaccgtccacagttctacttccgtacaactgacgtaaccggtactatcgaactgccagaaggcgtagagatggtaatgccaggcgataacatcaagatggtagtgacactgatttgcccaatcgcgatggacgaaggtttacgcttcgcaatccgtgaaggcggtcgtacagtggt

SEQ ID NO: 1750 - DNA, 897 bp, Stigmatella aurantiaca
  strain DW4
aacatgatcacgggcgcggcgcagatggacggagcgattctggtggtgtccgcggccgacggcccgatgccccagacgcgtgagcacatcctgctggccaggcaggtgggcgtgccctacatcgtcgtcttcctgaacaaggtggacatgctggacgatccggagctgcgcgagctggtggagatggaggtgcgcgacctgctcaagaagtacgagttcccgggcgacagcatccccatcatccctggcagcgcgctcaaggcgctggagggagacaccagcgacatcggcgagggagcgatcctgaagctgatggcggcggtggacgagtacatcccgacgccgcagcgtgcgacggacaagccgttcctgatgccggtggaagacgtgttctccatcgcaggccgaggaacggtggcgacgggccgagtggagcgcggcaagatcaaggtgggcgaggaagtggagatcgtggggatccgtccgacgcagaagacggtcatcacgggggtggagatgttccgcaagctgctggacgagggcatggcgggagacaacatcggagcgctgctgcgaggcctgaagcgcgaggacctggagcgtgggcaggtgctggcgaactgggggagcatcaacccgcacacgaagttcaaggcgcaggtgtacgtgctgtcgaaggaagagggagggcggcacacgccgttcttcaagggataccggccgcagttctacttccggacgacggacgtgaccggaacggtgaagctgccggacaacgtggagatggtgatgccgggagacaacatcgccatcgaggtggagctcattactccggtcgccatggagaaggagctgccgttcgccatccgtgagggtggccgcacggtgggcgccggc

SEQ ID NO: 1751 - DNA, 897 bp, Thiomonas cuprina
  strain Hoe5
aacatgatcaccggtgcggcccagatggacggcgccatcctggtcgtgtccgccgccgacggccccatgccccaaacccgcgagcacatcctgctggcgcgtcaggtgggcgtgccctacatcatcgtgttcctcaacaagtgcgacatggtcgacgacgccgagctgctcgaactcgtcgagatggaagtgcgcgagctgctgtccaagtacgacttccccggtgacgacacccccatcatcaagggctcggccaagctggccctcgaaggcgacaagggcgaactgggcgaaggcgccattctcaagctggccgaggccctggacacctacatccccacgcccgagcgggccgtcgacggcgcgttcctcatgcccgtggaagacgtgttctccatctccgggcgcggcacggtggtcaccgggcgtgtggagcgcggcatcatcaaggtcggcgaggaaatcgagattgtcggcctcaagcccaccctcaagaccacctgcaccggcgtggaaatgttcaggaagctgctcgaccagggccaggccggcgacaacgtcggcatcttgctgcgcggcaccaagcgcgaggaagtcgagcgcggccaggtgctgtgcaaacccggctcgatcaagccccacacccacttcaccgccgaggtgtacgtgctgagcaaggacgagggcggccgccacacccccttcttcaacaactaccgcccgcagttctacttccgcaccaccgacgtcaccggcgccatcgaactgcccaaggacaaggaaatggtcatgcccggcgataatgtgagcatcaccgtcaagctcatcgcccccatcgccatggaagaaggcctgcgcttcgccatccgcgaaggcggccgcaccgtcggcgccggc

SEQ ID NO: 1752 - DNA, 894 bp, Treponema pallidum
  strain Nichols
aatatgatcacgggtgctgcgcagatggacggtggtattctcgtcgtgtctgcgcctgacggcgttatgccacagacgaaggagcatcttctgctcgcccgtcaggttggtgttccctccatcattgtttttttgaacaaggttgatttggttgatgatcctgagttgctagagctggtggaagaagaggtgcgtgatgcgcttgctggatatgggttttcgcgtgagacgcctatcgtcaaggggtctgcgtttaaagctctgcaggatggcgcttccccggaggatgcagcttgtattgaggaactgcttgcggccatggattcctactttgaagacccagtgcgtgacgacgcaagacctttcttgctctctatcgaggatgtgtacactatttctgggcgtggtaccgttgtcacggggcgcatcgaatgtggggtaattagtctgaatgaagaggtcgagatcgtcgggattaagcccactaagaaaacagtggttactggcattgagatgtttaataagttgcttgatcagggaattgcaggtgataacgtggggctgcttttgcgcggggtggataaaaaagaggttgagcgcggtcaggtgctttctaagcccggttctattaagccacacaccaagtttgaggcgcagatctacgtgctctctaaggaagagggtggccgtcacagtcctttttttcaaggttatcgtccgcagttttattttagaactactgacattaccggtacgatttctcttcctgaaggggtagacatggtgaagccgggggataacaccaagattataggtgagctcatccacccgatagctatggacaagggtctgaagcttgcgattcgtgaaggggggcgcactattgcttctggt

SEQ ID NO: 1753 - DNA, 891 bp, Ureaplasma urealyticum
  ref <308>: DATABASE ACCESSION NUMBER: ATCC 33697
aatatgattacaggggcagcacaaatggatggagcaattttagttattgctgcatctgatggggttatggctcaaactaaagaacatattttattagcacgtcaagttggtgttccaaaaatcgttgttttcttaaacaaatgtgatttcatgacagatccagatatgcaagatcttgttgaaatggaagttcgtgaattattatctaaatatggatttgatggcgataacacaccagttattcgtggttcaggtcttaaggctttagaaggagatccagtttgagaagcaaaaattgatgaattaatggacgcagttgattcatgaattccattaccagaacgtagtactgacaaaccattcttattagcaattgaagatgtattcacaatttcaggacgtggtacagtagtaactggacgtgttgaacgtggtgtattaaaagttaatgatgaggttgaaattgttggtctaaaagacactcaaaaaactgttgttacaggaattgaaatgtttagaaaatcattagatcaagctgaagctggtgataatgctggtattttattacgtggtattaaaaaagaagatgttgaacgtggtcaagtacttgtaaaaccaggatcaattaaacctcaccgtacttttactgctaaagtttatattcttaaaaaagaagaaggtggacgtcatacacctattgtttcaggataccgtccacaattctattttagaacaacagatgtaacaggtgctatttcattacctgctggtgttgatttggttatgccaggtgatgacgttgaaatgactgtagaattaattgctccagttgcgattgaagatggatctaaattctcaatccgtgaaggtggtaaaactgtaggtcatggt

SEQ ID NO: 1754 - DNA, 909 bp, Wolinella succinogenes
  DSM 1740
aacatgattacaggtgctgctcaaatggatggcgcgattcttgttgtttctgcggcggatggccccatgccccaaactagggagcacattcttctttctcgacaagtaggcgttccttacatcgtggttttcttgaacaaagaagatatggttgatgacgctgagcttcttgagcttgttgaaatggaagttagagaacttcttagcaactacgacttccctggagatgacactcctatcgttgcaggttccgctcttaaagctcttgaagaggctaacgaccaggaaaatgttggcgagtggggcgagaaagtattgaagcttatggctgaggttgaccgatatattcctacgcctgagcgagatgtggataagcctttccttatgcctgttgaagacgtattctccatcgcgggtcgtggaaccgttgtgacaggaagaattgaaagaggcgtggttaaagtcggtgacgaagtagaaatcgttggtatccgaaacacacaaaaaacaaccgtaactggcgttgagatgttccgaaaagagctcgacaagggtgaggcgggtgacaacgttggtgttcttttgagaggcaccaagaaagaagatgttgagagaggtatggttctttgtaaaataggttctatcactcctcacactaactttgaaggtgaagtttacgttctttccaaagaggaaggcggacgacacactccattcttcaatggataccgacctcagttctatgttagaactacagacgttaccggttctatctctcttcctgagggcgtagagatggttatgcctggtgacaacgttaagatcaatgttgagcttatcgctcctgtagccctcgaagagggaacacgattcgcgatccgtgaaggtggtcgaaccgttggtgcgggt

SEQ ID NO: 1755 - DNA, 888 bp, Burkholderia cepacia; identical to SEQ ID NO: 1739

SEQ ID NO: 1756 - DNA, 388 bp, Bacillus anthracis
  strain CIP 9444
tgaaagttcaggtaaaacaacagtttcattacacgcaattgcagaagtacagcgtcaaggtggacaagcagcgttcattgatgctgagcatgcaatggatcctgtatatgcacaaaaactaggtgttaacatcgatgaattactattatcacaacctgatacaggggagcaaggtttagaaatcgcagaagcacttgtacgaagtggtgcggttgatattatcgtaattgactctgtagcagctcttgtaccgaaagctgaaattgaaggagacatgggtgactcacacgtaggtttacaagctcgtctaatgtctcaagcacttcgtaaactttcaggtgcaatcaataaatcaaaaacaatcgcaatctttattaaccaaattcgt

SEQ ID NO: 1757 - DNA, 388 bp, Bacillus anthracis; identical to SEQ ID NO: 1756
  ref <308>: DATABASE ACCESSION NUMBER: ATCC 4229

SEQ ID NO: 1758 - DNA, 388 bp, Bacillus cereus; identical to SEQ ID NO: 1756
  ref <308>: DATABASE ACCESSION NUMBER: ATCC 7064

SEQ ID NO: 1759 - DNA, 388 bp, Bacillus cereus
  ref <308>: DATABASE ACCESSION NUMBER: ATCC 13472
tgaaagttcaggtaaaacgacagtttcattacatgcaattgcagaagtacaacgtcaaggtggacaagcagcattcatcgatgcggagcacgcaatggatcctgtatatgcacaaaaattaggcgttaacatagatgaattactattatcacagcctgatacaggggagcaaggattagaaatcgcggaagcacttgtacgaagtggtgcggttgacattatcgtaattgactctgtagcagctcttgtaccgaaagcagagattgaaggtgacatgggtgactcacacgtaggtttacaagcacgtttaatgtcacaagcacttcgtaagctttcaggagcaatcaacaaatcaaaaacaattgcaatctttattaaccaaattcgt

SEQ ID NO: 1760 - DNA, 374 bp, Bacillus mycoides
  ref <308>: DATABASE ACCESSION NUMBER: ATCC 6462
aaacgacagtttcattacatgcaattgcagaagtacaacgtcaaggtggacaagcagcattcatcgatgcggagcacgcaatggatcctgtatatgcacaaaaattaggcgttaacatagatgaattactattatcacagcctgatacaggggagcaaggattagaaatcgcagaagcacttgtacgaagtggtgcggttgacattatcgtaattgactctgtagcagctcttgtaccgaaagcagagattgaaggagacatgggtgactcacacgtaggtttacaagcacgtttaatgtcacaagcacttcgtaagctttcaggagcaatcaacaaatcaaaaacaattgcaatctttattaaccaaattcgt

SEQ ID NO: 1761 - DNA, 381 bp, Bacillus pseudomycoides
  NRRL BD-10
ggaaagttcaggtaaaacaacggtttccttacatgcgattgcagaagtgcaacgtcaaggtggacaagcggcatttattgatgcggagcatgcgatggatcctgtatatgcacaaaagttaggtgttaatattgatgagttactattatcgcagcctgatacaggagaacaaggtttagaaatcgcagaagcattagtacgaagcggtgcgattgatatcattgtaattgactctgtagcagctcttgtaccaaaagcagaaatcgaaggggaaatgggtgactcccacgttggtttacaagcgcgtttaatgtcacaagcacttcgtaagctttctggtgcgattaacaaatcaaaaacaattgcaatcttcattaacca

SEQ ID NO: 1762 - DNA, 388 bp, Bacillus thuringiensis
  strain HER 1410
tgaaagttcaggtaaaacgacagtttcattacatgcaattgcagaagtacaacgtcaaggtggacaagcagcattcatcgatgcggagcacgcaatggatcctgtatatgcacaaaaattaggcgttaacatagatgaattactattatcacagcctgatacaggggagcaaggattagaaatcgcggaagcacttgtacgaagtggtgcggttgacattatcgtaattgactctgtagcagctcttgtaccgaaagcagagattgaaggcgacatgggtgactcacacgtaggtttacaagcacgtttaatgtcacaagcacttcgtaagctttcaggagcaatcaacaaatcaaaaacaattgcaatctttattaaccaaattcgt

SEQ ID NO: 1763 - DNA, 388 bp, Bacillus thuringiensis
  strain HER 1418
tgaaagttcaggtaaaacgacagtttcattacatgcaattgcagaagtacaacgtcaaggtggacaagcagcattcattgatgcggagcacgcaatggatcctgtatatgcacaaaaattaggcgttaacatagatgaattactattatcacagcctgatacaggggagcaaggattggaaatcgcggaagcacttgtacgaagtggtgcggttgacattatcgtaattgactctgtagcagctcttgtaccgaaagcagagattgaaggcgatatgggtgactcacacgtaggtttacaagcacgtttaatgtcacaagcacttcgtaagctttcaggagcaatcaacaaatcaaaaacaattgcaatctttattaaccaaattcgt

SEQ ID NO: 1764 - DNA, 358 bp, Klebsiella oxytoca
  ref <308>: DATABASE ACCESSION NUMBER: ATCC 33496
ctcctatctggattatgcgatgtcggtcattgttggccgtgcgctgccggatgtccgagatggcctgaagccggtacaccgtcgcgtactatacgccatgaacgtattgggcaatgactggaacaaagcctataaaaaatctgcccgtgtcgtgggtgacgtcatcggtaaataccaccctcatggtgatactgccgtatacgacaccattgtacgtatggcgcagcccttctccctgcgttacatgctggtagatggccagggtaactttggttcggtcgacggcgactccgccgcagcgatgcgttatacggaaatccgtatgtcgaagatcgcccatgaactgatggccgacctc

SEQ ID NO: 1765 - DNA, 365 bp, Klebsiella pneumoniae subsp. ozaenae
  ref <308>: DATABASE ACCESSION NUMBER: ATCC 11296
ttaagaactcttatctggattatgcgatgtcggtcattgttggccgtgcgctgccggatgtccgagatggcctgaagccggtacaccgtcgcgtactttacgccatgaacgtattgggcaatgactggaacaaagcctataaaaaatcagcccgtgtcgttggtgacgtaatcggtaaataccacccgcacggcgactccgcggtatacgacaccatcgtgcgtatggcgcagccgttctcgctgcgttacatgctggtggacggccagggtaactttggttccatcgacggcgactccgccgcggcgatgcgttataccgaaattcgtctggcgaaaatcgctcatgagctgatggccgatctt

SEQ ID NO: 1766 - DNA, 344 bp, Klebsiella planticola
  ref <308>: DATABASE ACCESSION NUMBER: ATCC 33531
aagagctcgtatctggattatgcgatgtcggtcattgttggccgtgcgctgccggatgtccgagatggcctgaaaccggtacaccgtcgcgtactttacgccatgaacgtattgggcaatgactggaacaaagcctataaaaaatccgcccgtgtcgttggtgacgtaatcggtaaataccaccctcatggtgataccgccgtttatgacaccattgtacgtatggcacagccattctccttgcgttatatgctggtcgatggccagggtaacttcggttctgtcgatggcgactccgccgcagcgatgcgttatacggaaatccgtatgtcgaaaatcgccca

SEQ ID NO: 1767 - DNA, 345 bp, Klebsiella pneumoniae
  ref <308>: DATABASE ACCESSION NUMBER: ATCC 27336
aactcttatctggattatgcgatgtcggtcattgttggccgtgcgctgccggatgtccgagatggcctgaagccggtacaccgtcgcgtactttacgccatgaacgtattgggcaatgactggaacaaagcctataaaaaatcagcccgtgtcgttggtgacgtaatcggtaaataccacccgcacggcgactccgcggtatacgacaccatcgtgcgtatggcgcagccgttctcgctgcgttacatgctggtggacggccagggtaactttggttccatcgacggcgactccgccgcggcgatgcgttataccgaaattcgtctggcgaaaatcgctcatgag

SEQ ID NO: 1768 - DNA, 356 bp, Klebsiella pneumoniae subsp. pneumoniae
  ref <308>: DATABASE ACCESSION NUMBER: ATCC 13883
cttatctggattatgcgatgtcggtcattgttggccgtgcgctgccggatgtccgagatggcctgaagccggtacaccgtcgcgtactttacgccatgaacgtattgggcaatgactggaacaaagcctataaaaaatcagcccgtgtcgttggtgacgtaatcggtaaataccacccgcacggcgactccgcggtatacgacaccatcgtgcgtatggcgcagccgttctcgctgcgttacatgctggtggacggccagggtaactttggttccatcgacggcgactccgccgcggcgatgcgttataccgaaattcgtctggcgaaaatcgctcatgagctgatggccgatctt

SEQ ID NO: 1769 - DNA, 361 bp, Klebsiella pneumoniae subsp. pneumoniae
  ref <308>: DATABASE ACCESSION NUMBER: ATCC 29011
taagaactcttatctggattatgcgatgtcggtcattgttggccgtgcgctgccggatgtccgagatggcctgaagccggtacaccgtcgcgtactttacgccatgaacgtattgggcaatgactggaacaaagcctataaaaaatcagcccgtgtcgttggtgacgtaatcggtaaataccacccgcacggcgactccgcggtatacgacaccatcgtgcgtatggcgcagccgttctcgctgcgttacatgctggtggacggccagggtaactttggttccatcgacggcgactccgccgcggcgatgcgttataccgaaattcgtctggcgaaaatcgctcatgagctgatggccgat

SEQ ID NO: 1770 - DNA, 365 bp, Klebsiella pneumoniae subsp. rhinoscleromatis
  ref <308>: DATABASE ACCESSION NUMBER: ATCC 13824
taagaactcttatctggattatgcgatgtcggtcattgttggccgtgcgctgccggatgtccgagatggcctgaagccggtacaccgtcgcgtactttacgccatgaacgtattgggcaatgactggaacaaagcctataaaaaatcagcccgtgtcgttggtgacgtaatcggtaaataccacccgcacggcgactccgcggtatacgacaccatcgtgcgtatggcgcagccgttctcgctgcgttacatgctggtggacggccagggtaactttggttccatcgacggcgattccgccgcggcgatgcgttataccgaaattcgtctggcgaaaatcgctcatgagctgatggccgatcttg

SEQ ID NO: 1771 - DNA, 357 bp, Klebsiella terrigena
  ref <308>: DATABASE ACCESSION NUMBER: ATCC 33257
tcgtatctggattatgcgatgtcggtcattgttggccgtgcgctgccggatgtccgagatgggttgaaaccggtacaccgtcgcgtactttacgccatgaacgtattgggcaatgactggaacaaagcctataaaaaatccgcccgtgtcgttggtgacgtaatcggtaaatatcaccctcacggtgataccgccgtttatgacaccattgtacgtatggcgcagccattctccttgcgttatatgctggtcgatggccagggtaacttcggttctgtcgatggcgactccgccgcagcgatgcgttatacggaaatccgtatgtcgaaaatcgcccacgagctgatggccgacctc

SEQ ID NO: 1772 - DNA, 968 bp, Legionella pneumophila strain pneumophila
  ref <308>: DATABASE ACCESSION NUMBER: ATCC 33152
cagtacacaggcgagttctttttgcgatgagtgagttaagtaatgattggaataagccgtataaaaaatctgctcgtgtagtaggggatgtcattggtaaatatcatcctcatggggatacagctgtttatgacactattgttcgtatggctcagcccttttccatgcgttatatgctgattgatgggcagggtaattttggctctgtagatggagatgctccagctgccatgcgttacactgaagtaagaatgtccaaagtggcgcatgctttactggctgatttggataaggaaaccgttgattttagtcctaactatgatgaaacagaatttgctccagtggtattgccatcgagaattcccaatttactagttaatggctcttccggtattgcggtagggatggctactaatattccaccacataatcttaccgaagtaatcaatgcatgtattgctttagtggatgaacctgacacgagtcttgaagatttaatggaaattattcctggccctgattttcctacagccgcaattattaatggtcgtgctggaattattgaaggttatcgtactggaaaagggcgggttgttatcagggcacgcacagaaattgaaacggatgaaagttcaggccgtcagtcaattattattcaggaattaccctatcaggtgaataaagcgcgtttgatcgagcgtattgctgaattggtaagggacaagaaaatcgaaggaatttccggcttgagagatgagtcagacaagcaaggaatgagagtagtcattgaattaaaacgcaatgaagtagcagatgtggtattgaataacctgttcgctcatactcaaatgcaaaatgtattcggaattaatatggttgctctggtggatggccaaccgcgtactttgaatttgaagcaaatactggaatattttataaaacatcgaagagaggttgttaccagacgc

SEQ ID NO: 1773 - DNA, 967 bp, Proteus mirabilis
  ref <308>: DATABASE ACCESSION NUMBER: ATCC 25933
caccgccgagtgctatttgcgatgaatgtactgggaaacgattggaataaaccttataaaaaatcagcccgtgttgttggggatgtaatcggtaaatatcacccgcacggtgacagtgctgtctatgaaacgattgttcgtttagcacagcctttttctatgcgctacatgttggttgacggtcagggtaacttcgggtcagttgatggtgactccgcggcggctatgcgttataccgaagttcgtatggcgaagatcgcccatgaactgctggcggatttggaaaaagagacggtcgactttgttcctaactatgatggaacagaaaatataccggctgttatgccaacccgtattccaaacttgttagttaatggctcttcaggtattgccgttgggatggcaacgaatatccctccgcataacctcggtgaagttatcgacggttgtcttgcctatgttgataatgaagacatcaccatagaagaattaatggaatatattaccgggcctgattttccgactgctgcgattattaatggtcgcagaggaatattagatgcttatcgtacagggcgtggaaagatttatatccgtgctcaggctgatattgaaactgatgagaaaacaggtcgcgaaaccattatcgtgacagaaattccttatcaggtgaataaagcccgtttaattgaaaaaattgcggagcttgtaaaagataaacgtattgaaggtatcagcggattacgtgacgagtctgataaagacggtatgcgtattgttgttgagatcaaacgtgatgcagtcggtgaagtagtattaaatcacctcttttcacaaactcaaatgcaagtctcttttggtattaatatggttgcgcttcatcaaggccaaccaaaattattgaacctaaaagaaattatcgcagcctttattcgccatcgtcgtgaagtggtgactcgccgtacca

SEQ ID NO: 1774 - DNA, 978 bp, Providencia rettgeri
  ref <308>: DATABASE ACCESSION NUMBER: ATCC 9250
ccagtacaccgcagagtattgtatgcgatgaatgtattgggaaatgattggaataaaccctataaaaaatctgcccgtattgttggggacgtcatcggtaaataccatccacatggtgatagcgctgtttacgagacaatcgttcgtcttgctcagcctttctcaatgcgttacatgctggttgatggtcagggaaacttcggttctgttgacggagactccgcagcggcaatgcgttatacggaaatccgtatggcgaaaattgcccatgaactacttgctgaccttgaaaaagaaaccgttgatttcgttcctaactatgacggaacagagcacattcctgaagttatgccaacgaaaatcccaaaccttttggttaatgggtcgtcaggtattgctgttgggatggcaaccaatatcccacctcacaatttaggggaggtgattaatggttgtcttgcctatatagaagacgaagacatcagcattgatggtttaatggaacacattccagggcctgatttcccaaccgcagctattattaatggccgtcgtgggattattgatgcgtatcgcacagggcgtggcaaggtctatatccgtgcaagcgctgaagtggaagtcgatgagaaaaatggtcgcgaaaccattattgtcagcgaaattccttatcaagtgaataaagctcgcttgattgaaaaaattgctgagttagttaaagacaagcgtgttgaaggtatcagtgcactgcgtgacgagtctgataaagacggtatgcgtattgttattgaaatcaaacgcgatgcggtgggtgaagttgtactgaacaacttatattccctgacccaattgcaagtttcttttggtatcaatatggtagctctacaccaagggcagccgaaaatactgaatttaaaagatatcattgctgcttttgtgcgtcaccgccgtgaagtcgtcactcgtcgtacgattttc

SEQ ID NO: 1775 - DNA, 978 bp, Proteus vulgaris
  ref <308>: DATABASE ACCESSION NUMBER: ATCC 13315
ccagtacaccgtcgcgttcttttcgcgatgaatgtattaggaaacgattggaataaaccttataaaaaatcagcccgtgttgttggggatgttatcggtaaatatcacccgcacggtgacagtgctgtttatgaaacgatagttcgtttagcacagcctttttctatgcgttacatgttggttgacgggcagggtaacttcgggtcagttgatggtgactcggcggctgcaatgcgttataccgaagttcgtatggcgaaaatcgcccatgaactgctggcggatttggaaaaagaaacggttgattttgttcctaactatgatggaacagagcatatcccggcagtcatgccaacccgtattccaaacttattagtcaatggttcttcaggtatcgcagtcgggatggcaacaaacattcctccgcataacctaggtgaagttatcgacggctgtcttgcttatgttgataacgaagacatcactattgaagagttgatggagcatatcacggggcctgatttcccaactgccgctattattaatggccgcagaggaattttagatgcttaccgtactgggcgcggaaaaatttatattcgtgcacaagctgatgtagaaaccgatgagaaaactggtcgcgaaacaattatcgtgacggaaattccttatcaggtgaacaaagctcgcttaattgaaaaaattgcagagcttgttaaagataaacgtattgaaggcattagcggattacgtgatgagtcagataaagatggtatgcgcattgttgttgaaattaagcgtgatgctgttggtgaagttgtactaaatcacttattttctcagactcagatgcaggtttcttttggtattaacatggttgcactgcatcaaggtcaaccgaaagtgttaaacctgaaagaaattatttcagcctttattcgtcaccgtcgtgaagtggtgactcgtcgtactattttt

SEQ ID NO: 1776 - DNA, 940 bp, Yersinia enterocolitica
  ref <308>: DATABASE ACCESSION NUMBER: ATCC 9610
tgggtaatgactggaataagccatacaaaaaatcggcccgtgtagtcggggacgttatcggtaaatatcacccgcatggtgacagcgcggtctacgacacaattgtgcgtatggcccagccgttctcactgcgctatatgctggtggatgggcagggcaacttcggttccgttgatggcgactccgccgcagcgatgcgttataccgaaatccgtatgtctaaaattgctcacgaattgttggcggacttagaaaaagataccgtcgacttcgtgccgaactatgacggtacggagcaaattcctgccgtaatgccaacccgaatccctaacttgctggttaacggctcgtcaggtattgctgtcggtatggcaaccaatattccgccgcataacctttctgaggttattgatggctgtctggcctatatcgaagatgaaaacatcaccattgaagggttgatggagtacatcccggggccagatttcccaactgctgcgattatcaatggtcgccgtggtattgaagaagcttatcgtactggccgtggcaaggtgtatatccgtgcccgtgctgaagttgaggctgacgcttaaaccggtcgcgaaaccattattgttcacgagatcccgtatcaggtgaacaaggcgcggttgattgaaaaaatcgccgagctggttaaagaaaaacgcgtagaaggcatcagtgcgttgcgtgatgagtctgataaagacggcatgcgtatcgtgattgaaatcaaacgtgatgctgtcggggaagtggttctgaacaacctctattctctgacgcaattgcaggtgactttcggtatcaatatggtggctctgtctcaagggcagcctaagttgcttaacctgaaagacattttggttgctttcgtgcgccaccgccgtgaagtggtgactcgccgtaccatttt

SEQ ID NO: 1777 - DNA, 668 bp, Klebsiella oxytoca
  ref <308>: DATABASE ACCESSION NUMBER: ATCC 13182
ccgtttattggcgatggcctgaagccggtccagcgtcgcatcgtctatgcgatgtctgaactgggtctgaacgccagcgcgaagttcaaaaagtccgcccgcaccgtcggtgacgtgctgggtaaataccatccccacggcgacagcgcgtgctatgaagccatggtgctgatggctcagcccttctcctaccgctatccgctggttgacggtcagggaaactggggggcgccggacgatcctaaatccttcgccgcaatgcgttataccgaatcccgtttgtcgaagtatgctgaactgctgctgagcgaactggggcaaggcaccgttgactgggtaccaaacttcgacggcactttgcaggagccgaagatgctgcctgcgcgcctgcccaatattctgctaaacggtactaccggcattgccgttgggatggcgacggacattccgccgcacaacctgcgtgaagtggcccgggcggccattaccctgattgaaaagccgcaaacttcgctggatgacctgctggatatcgtgcaggggccggattatcctaccgaagcggaaatcattaccccccgtgccgaaatccgcaaaatctaccagaatggccgcggttcggtgcggatgcgcgcggtatgggccaaagaagacggcgcggtggtgat

SEQ ID NO: 1778 - DNA, 714 bp, Klebsiella oxytoca
  ref <308>: DATABASE ACCESSION NUMBER: ATCC 33496
gtttattggcgatggcctgaagccggtccagcgtcgcatcgtctatgcgatgtctgaactgggtctgaacgccagcgcgaagttcaaaaagtccgcccgcaccgtcggtgacgtgctgggtaaataccatccccacggcgacagcgcgtgctatgaagccatggtgctgatggctcagcccttctcctaccgctatccgctggttgacggtcagggaaactggggggcgccggacgatcctaaatccttcgccgcaatgcgttataccgaatcccgtttgtcgaagtatgctgaactgctgctgagcgaactggggcaaggcaccgttgactgggtaccaaacttcgacggcactttgcaggagccgaagatgctgcctgcgcgcctgcccaatattctgctaaacggtactaccggcattgccgttgggatggcgacggacattccgccgcacaacctgcgtgaagtggcccgggcggccattaccctgattgaaaagccgcaaacttcgctggatgacctgctggatatcgtgcaggggccggattatcctaccgaagcggaaatcattaccccccgtgccgaaatccgcaaaatctaccagaatggccgcggttcggtgcggatgcgcgcggtatgggccaaagaagacggcgcggtggtgattagcgcgctgccgcatcaggtttccggcgcccgcgtgcttgagcagat

SEQ ID NO: 1779 - DNA, 722 bp, Klebsiella pneumoniae subsp. ozaenae
  ref <308>: DATABASE ACCESSION NUMBER: ATCC 11296
ttggcgatggcttaaaaccggtccagcgtcgcatcgtctatgcgatgtccgagctggggctgaacgccagcgcgaaattcaaaaagtccgcccgcaccgtcggcgacgtgttgggtaaatatcacccgcacggcgacagcgcctgctatgaagcgatggtgctgatggcgcagccgttctcttaccgctatccgctggtggatggtcagggaaactggggggcgccggacgatcccaaatctttcgccgccatgcgttacaccgaatcccgcctgtcgaagtatgccgagctgctgctcagcgagctggggcaggggacggtcgactgggtgccaaactttgacggtacgctgcaggagccgaaaatgctgccagcgcgtttgccgaacatcctgctgaacggcaccaccggcatcgcggtaggtatggcgaccgatattcctccgcacaacctgcgggaagtggccaaagcggcgattacgctgattgagcagccgaaaaccaccctcgacgaactgctggatatcgtacaggggccggatttcccgaccgaggcggagatcatcacctcgcgggcggaaattcgaaaaatctaccagaacgggcgcggctcagtgcgcatgcgcgcggtgtggagtaaagaggacggcgcggtggtgatcagcgcgctgccgcatcaggtctccggcgccaaagtgctggagcagattgcggcgcagatg

SEQ ID NO: 1780 - DNA, 692 bp, Klebsiella planticola
  ref <308>: DATABASE ACCESSION NUMBER: ATCC 33531
gtccagcgtcgcatcgtttatgcgatgtctgagctggggctgaacgccagcgcgaagttcaaaaagtccgcccgcaccgtgggtgatgtgctgggtaaatatcacccgcacggcgatagcgcatgctatgaagctatggtgctgatggcgcagccattctcctaccgctacccgctggtggatgggcaggggaactggggggcaccggacgatcctaaatccttcgccgcgatgcgttataccgaatcccgtttgtcgaagtatgcggaactgctgctgggcgaactggggcagggaaccgtcgactgggtgccgaacttcgacgggacgatgcaggagccgaaaatgctgcctgcgcgtctgccgaatattctgctgaacggcactaccggcatcgccgtcggtatggcaaccgatattcctccgcacaacctgcgtgaagtggcgcaggcggcgattaccctgatcgaaaaaccgcagacctcgctcgacgaactgctggatatcgttcacggacccgactacccgaccgaagccgaaatcattactccacgcgcggagatccgcaaaatctaccagaacggccgcggttcggtgcggatgcgcgcggtatggaaaaaagaggacggcgcggtcgtgattacggcgttgccgcatcaggtttccggcgcccgcgtgctggagcaaattgc

SEQ ID NO: 1781 - DNA, 700 bp, Klebsiella pneumoniae
  ref <308>: DATABASE ACCESSION NUMBER: ATCC 27336
gtttattggcgatggcttaaaaccggtccagcgtcgcatcgtctatgcgatgtccgagctggggctgaacgccagcgcgaaattcaaaaagtccgcccgcaccgtcggcgacgtgttgggtaaatatcacccgcacggcgacagcgcctgctatgaagcgatggtgctgatggcgcagccgttctcttaccgctatccgctggtggatggtcagggaaactggggggcgccggacgatcccaaatctttcgccgccatgcgttacaccgaatcccgcctgtcgaagtatgccgagctgctgctcagcgagctggggcaggggacggtcgactgggtgccaaactttgacggcacgctgcaggagccgaaaatgctgccagcgcgtttgccgaacatcctgctgaacggcaccaccggcatcgcggtaggcatggcgaccgatattcctccgcacaacctgcgggaagtggccaaagcggcgattacgctgattgagcagccgaaaaccaccctcgacgaactgctggatatcgtacaggggccggatttcccgaccgaggcggagatcatcacctcgcgggcggaaattcgcaaaatctaccaaaacgggcgcggctcagtgcgcatgcgcgcggtgtggagtaaagaggacggcgcggtggtgatcagcgcgctgccgcatcaggtctccggcgccaaa

SEQ ID NO: 1782 - DNA, 726 bp, Klebsiella pneumoniae subsp. pneumoniae
  ref <308>: DATABASE ACCESSION NUMBER: ATCC 13883
attggcgatggcttaaaaccggtccagcgtcgcatcgtctatgcgatgtccgagctggggctgaacgccagcgcgaaattcaaaaagtccgcccgcaccgtcggcgacgtgttgggtaaatatcacccgcacggcgacagcgcctgctatgaagcgatggtgctgatggcgcagccgttctcttaccgctatccgctggtggatggtcagggaaactggggggcgccggacgatcccaaatctttcgccgccatgcgttacaccgaatcccgcctgtcgaagtatgccgagctgctgctcagcgagctggggcaggggacggtcgactgggtgccaaactttgacggcacgctgcaggagccgaaaatgctgccagcgcgtctgccgaacatcctgctgaacggcaccaccggcatcgcggtaggcatggcgaccgatattcctccgcacaacctgcgggaagtggccaaagcggcgattacgctgattgagcagccgaaaaccaccctcgacgaactgctggatatcgtacaggggccggatttcccgaccgaggcggagatcatcacctcgcgggcggaaattcgcaaaatctaccagaacgggcgcggctcagtgcgcatgcgcgcggtgtggagtaaagaggacggcgcggtggtgatcagtgcgctgccgcatcaggtctctggcgccaaagtgctggagcagattgcggcgcagatgcgc

SEQ ID NO: 1783 - DNA, 706 bp, Klebsiella pneumoniae subsp. pneumoniae
  ref <308>: DATABASE ACCESSION NUMBER: ATCC 29011
ggcttaaaaccggtccagcgtcgcatcgtctatgcgatgtccgagctggggctgaacgccagcgcgaaattcaaaaagtccgcccgcaccgtcggcgacgtgttgggtaaatatcacccgcacggcgacagcgcctgctatgaagcgatggtgctgatggcgcagccgttctcttaccgctatccgctggtggatggtcagggaaactggggggcgccggacgatcccaaatcttttgccgccatgcgttacaccgaatcccgcctgtcgaagtatgccgagctgctgctcagcgagctggggcaggggacggtcgactgggtgccaaactttgacggcacgctgcaggagccgaaaatgctgccagcgcgtctgccgaacatcctgctgaacggcaccaccggcatcgcggtaggcatggcgaccgatattcctccgcacaacctgcgggaagtggccaaagcggcgattacgctgattgagcagccgaaaaccaccctcgacgaactgctggatatcgtacaggggccggatttcccgaccgaggcggagatcatcacctcgcgggcggaaattcgcaaaatctaccagaacgggcgcggctcagtgcgcatgcgcgcggtgtggagtaaagaggacggcgcggtggtgatcagtgcgctgccgcatcaggtctccggcgccaaagtgctggagcagattgcgg

SEQ ID NO: 1784 - DNA, 614 bp, Klebsiella pneumoniae subsp. rhinoscleromatis
  ref <308>: DATABASE ACCESSION NUMBER: ATCC 13884
ttggcgatggcttaaaaccggtccagcgtcgcatcgtctatgcgatgtccgagctggggctgaacgccagcgcgaaattcaaaaagtccgcccgcaccgtcggcgacgtgttgggtaaatatcacccgcacggcgacagcgcctgctatgaagcgatggtgctgatggcgcagccgttctcttaccgctatccgctggtggatggtcagggaaactggggggcgccggacgatcccaaatctttcgccgccatgcgttacaccgaatcccgcctgtcgaagtatgccgagctgctgctcagcgagctggggcaggggacggtcgactgggtgccaaactttgacggcacgctgcaggagccgaaaatgctgccagcgcgtctgccgaacatcctgctgaacggcaccaccggcatcgcggtaggcatggcgaccgatattcctccgcacaacctgcgggaagtggccaaagcggcgattacgctgattgagcagccgaaaaccaccctcgacgaactgctggatatcgtacaggggccggatttcccgaccgaggcggagatcatcacctcgcgggcggaaattcgcaaaatctaccagaacgggcgcggctca

SEQ ID NO: 1785 - DNA, 668 bp, Klebsiella terrigena
  ref <308>: DATABASE ACCESSION NUMBER: ATCC 33257
gcctgaaaccggtccagcggcgcatcgtttatgcgatgtccgaactgggtctgaacgccaccgctaaattcaaaaaatccgcgcgcaccgtcggcgacgtgctgggtaaatatcacccgcacggcgatagcgcctgctatgaggcgatggtgctgatggcgcagccgttctcttaccgctacccgctggtggacggtcagggcaactggggcgccccggacgatcccaaatccttcgccgcgatgcgttataccgaatcccgcctgtcaaagtatgcggagctgctgctgggcgagctgggtcagggaaccgttgactgggtacctaactttgacggtacgatgcaggagccgaaaatgctgcctgcgcgtttgccgaatattctgctcaacggcaccaccggtatcgccgtggggatggccaccgatattccgccgcacaacctgcgcgaagtggccaaagcggccatcaccctgattgaaaagccgcagacctcgctcgacgaactgctggatatcgttcacgggccggactaccccaccgaagctgaaatcatcaccccgcgcgccgagatccgcaaaatctatcagaacggtcgcggctcggttcgcatgcgtgcggtgtggaaaaaagaggacggcgcggtggtgattagcgccctgccgcat

SEQ ID NO: 1786 - DNA, 113 bp, Bacillus cereus
  ref <308>: DATABASE ACCESSION NUMBER: ATCC 7064
cattacgttctaacactcaaggacgcggaacattctctatggtgtttgaccactatgaagaagtaccaaagtctgtttctgaagaaattatcaaaaaaaataaaggtgaataa

SEQ ID NO: 1787 - DNA, 118 bp, Bacillus cereus
  ref <308>: DATABASE ACCESSION NUMBER: ATCC 14579
aacgtcattacgttctaacactcaaggacgcggaacattctctatggtgtttgaccactatgaagaagtaccaaagtctgtttctgaagaaattatcaaaaaaaataaaggtgaataa

SEQ ID NO: 1788 - DNA, 120 bp, Bacillus anthracis
  strain CIP 9444
gcaacgtcattacgttctaacactcaaggacgcggaacattctctatggtgtttgaccactatgaagaagtaccaaagtctgtttctgaagaaattatcaaaaaaaataaaggtgaataa

SEQ ID NO: 1789 - DNA, 118 bp, Bacillus cereus; identical to SEQ ID NO: 1787
  ref <308>: DATABASE ACCESSION NUMBER: ATCC 13472

SEQ ID NO: 1790 - DNA, 120 bp, Bacillus anthracis; identical to SEQ ID NO: 1788
  ref <308>: DATABASE ACCESSION NUMBER: ATCC 4229

SEQ ID NO: 1791 - DNA, 120 bp, Bacillus pseudomycoides
  NRRL B-617
gcaacgtcattacgttctaacacgcaaggacgcggaacattctcaatgacatttgatcattatgaagaagtaccgaagtctgtttcagaagaaattatcaaaaaaaataaaggtgaataa

SEQ ID NO: 1792 - DNA, 116 bp, Bacillus cereus
  ref <308>: DATABASE ACCESSION NUMBER: ATCC 49064
cgtcattacgttctaacactcaaggacgcggaacattctctatggtgtttgaccactatgaagaagtaccaaagtctgtttctgaagaaattatcaaaaaaaataaaggtgaataa

SEQ ID NO: 1793 - DNA, 120 bp, Bacillus anthracis; identical to SEQ ID NO: 1788
  strain CIP 9440

SEQ ID NO: 1794 - DNA, 100 bp, Bacillus cereus
  ref <308>: DATABASE ACCESSION NUMBER: ATCC 15816
cactcaaggacgcggaacattctctatggtgtttgatcactatgaagaagtaccaaagtctgtttctgaagaaattatcaaaaaaaataaaggtgaataa

SEQ ID NO: 1795 - DNA, 120 bp, Bacillus weihenstephanensis
  strain WSBC 10204
gcaacggcattacgttctaacactcaaggacgcggaacattctcaatgacatttgatcattatgaagaagtaccgaagtctgtttctgaagaaattattaaaaaaaataaaggtgaataa

SEQ ID NO: 1796 - DNA, 120 bp, Bacillus mycoides
  ref <308>: DATABASE ACCESSION NUMBER: ATCC 6462
gcgacagcattacgttctaacactcaaggacgcggaacattctcaatgacatttgatcattatgaagaagtaccgaagtctgtttcagaagaaattattaaaaaaaataaaggcgaataa

SEQ ID NO: 1797 - DNA, 120 bp, Bacillus thuringiensis; identical to SEQ ID NO: 1788
  ref <308>: DATABASE ACCESSION NUMBER: ATCC 10792

SEQ ID NO: 1798 - DNA, 117 bp, Bacillus weihenstephanensis
  strain WSBC 10204
ttgatttttatcgattgttcaagtataactacttatgtaagcttagaaagtgagacgcaagtttcactttctagtctaaatataaaataacccatataaactaaggaggaatttaga

SEQ ID NO: 1799 - DNA, 117 bp, Bacillus thuringiensis
  ref <308>: DATABASE ACCESSION NUMBER: ATCC 10792
ttgatttttatcgattgttcaagtataactacttatgtaagcttagaaagtgggacgtaagtttcactttctagtctaaatataaaataacctatataaactaaggaggaatttaga

SEQ ID NO: 1800 - DNA, 117 bp, Bacillus anthracis
  ref <308>: DATABASE ACCESSION NUMBER: ATCC 4229
ttgatttttatcgattcttcacgtataactacttatgtaagcttagaaagtgggacgcaagtttcgctttctagcctaaatataaaataacctatataaactaaggaggaatttaga

SEQ ID NO: 1801 - DNA, 117 bp, Bacillus pseudomycoides
  NRRL B-617
ttgatttttatcgattgttcaagtataactacttatgtaagcttagaaagtgggacttaagtttcactttctagtctaaatataaaataacctatataaactaaggaggaatttaga

SEQ ID NO: 1802 - DNA, 117 bp, Bacillus anthracis; identical to SEQ ID NO: 1800
  strain CIP 9444

SEQ ID NO: 1803 - DNA, 117 bp, Bacillus cereus
  ref <308>: DATABASE ACCESSION NUMBER: ATCC 7064
ttgatttttatcgattcttcacgtataactacttatgtaagcttagaaagtgagacgcaagtttcgctttctagcctaaatataaaataacctatataaactaaggaggaatttaga

SEQ ID NO: 1804 - DNA, 117 bp, Bacillus cereus
  ref <308>: DATABASE ACCESSION NUMBER: ATCC 49064
ttgatttttatcgattcttcacgtataactacttatgtaagcttagaaagtgggacgcaagtttcactttctagcctaaatataaaataacctatataaactaaggaggaatttaga

SEQ ID NO: 1805 - DNA, 117 bp, Bacillus mycoides
  ref <308>: DATABASE ACCESSION NUMBER: ATCC 6462
ttgatttttatcaattgttcgagtataactacttatgtaagcttagaaagtgggacgtaagtttcgctttctagtctaaatataaaataacctatataaactaaggaggaatttaga

SEQ ID NO: 1806 - DNA, 117 bp, Bacillus cereus; identical to SEQ ID NO: 1799
  ref <308>: DATABASE ACCESSION NUMBER: ATCC 14579

SEQ ID NO: 1807 - DNA, 117 bp, Bacillus cereus; identical to SEQ ID NO: 1800
  ref <308>: DATABASE ACCESSION NUMBER: ATCC 15816

SEQ ID NO: 1808 - DNA, 117 bp, Bacillus cereus; identical to SEQ ID NO: 1799
  ref <308>: DATABASE ACCESSION NUMBER: ATCC 13472

SEQ ID NO: 1809 - DNA, 116 bp, Bacillus anthracis
  strain CIP 9440
ttgatttttatcgattcttcacgtataactacttatgtaagcttagaaagtgggacgcaagtttcgctttctagcctaaatataaaataacctatataaactaaggaggaatttag

SEQ ID NO: 1810 - DNA, 278 bp, Bacillus mycoides
  ref <308>: DATABASE ACCESSION NUMBER: ATCC 6462
atggctaaagctaaattcgaacgttctaaaccccatgttaacatcggtacaatcggccacgttgaccatggtaaaactacattaactgctgcgatcactacagttcttgcaaaagctggtggtgctgaagcacgcggatacgatcaaatcgacgctgctccagaagaaagagagcgcggaatcacaatctcaactgcacacgttgagtacgaaactgaaactcgtcactatgcacacgttgactgcccaggtcacgctgactatgttaaaaacatgat

SEQ ID NO: 1811 - DNA, 278 bp, Bacillus thuringiensis
  ref <308>: DATABASE ACCESSION NUMBER: ATCC 10792
atggctaaagctaaattcgaacgttctaaaccccatgttaacatcggtacaatcggccacgttgaccatggtaaaactacattaactgctgcgatcactacagttcttgcaaaagctggtggtgctgaagcacgcggatacgatcaaatcgatgctgctccagaagaaagagagcgcggtatcacaatctcaactgcacacgttgagtacgaaactgaaactcgtcactatgcacacgttgactgcccaggtcacgctgactatgttaaaaacatgat

SEQ ID NO: 1812 - DNA, 270 bp, Bacillus cereus
  ref <308>: DATABASE ACCESSION NUMBER: ATCC 15816
atggctaaagctaaattcgaacgttctaaaccccatgttaacatcggtacaatcggccacgttgaccatggtaaaactacattaactgctgcgatcactacagtacttgcaaaagctggtggtgctgaagcacgcggatacgatcaaatcgatgctgctccagaagaaagagagcgcggtatcacaatctcaactgcacacgttgagtacgaaactgaaactcgtcactatgcacacgttgactgcccaggtcacgctgactatgttaaa

SEQ ID NO: 1813 - DNA, 278 bp, Bacillus weihenstephanensis
  strain WSBC 10204
atggctaaagctaaattcgaacgttctaaaccccatgttaacatcggtacaatcggccacgttgaccatggtaaaactacattaactgctgcgatcactacagttcttgcaaaagctggtggtgctgaagcacgcggatacgatcaaatcgacgctgctccagaagaaagagagcgcggaatcacaatctcaactgcacacgttgagtacgaaactgaaactcgtcactatgcacacgttgactgcccaggtcatgctgactatgttaaaaacatgat

SEQ ID NO: 1814 - DNA, 266 bp, Bacillus anthracis
  strain CIP 9440
atggctaaagctaaattcgaacgttctaaaccccatgttaacatcggtacaatcggccacgttgaccatggtaaaactacattaactgctgcgatcactacagtacttgcaaaagctggtggtgctgaagcacgcggatacgatcaaatcgatgctgctccagaagaaagagagcgcggtatcacaatctcaactgcacacgttgagtacgaaactgaaactcgtcactatgcacacgttgactgcccaggtcacgctgactatgt

SEQ ID NO: 1815 - DNA, 269 bp, Bacillus cereus
  ref <308>: DATABASE ACCESSION NUMBER: ATCC 7064
atggctaaagctaaattcgaacgttctaaaccccatgttaacatcggtacaatcggccacgttgaccatggtaaaactacattaactgctgcgatcactacagtacttgcaaaagctggtggtgctgaagcacgcggatacgatcaaatcgatgctgctccagaagaaagagagcgcggtatcacaatctcaactgcacacgttgagtacgaaactgaaactcgtcactatgcacacgttgactgcccaggtcacgctgactatgttaa

SEQ ID NO: 1816 - DNA, 268 bp, Bacillus cereus
  ref <308>: DATABASE ACCESSION NUMBER: ATCC 13472
atggctaaagctaaattcgaacgttctaaaccccatgttaacatcggtacaatcggccacgttgaccatggtaaaactacattaactgctgcgatcactacagttcttgcaaaagctggtggtgctgaagcacgcggatacgatcaaatcgatgctgctccagaagaaagagagcgcggtatcacaatctcaactgcacacgttgagtacgaaactgaaactcgtcactatgcacacgttgactgcccaggtcacgctgactatgtta

SEQ ID NO: 1817 - DNA, 278 bp, Bacillus anthracis
  ref <308>: DATABASE ACCESSION NUMBER: ATCC 4229
atggctaaagctaaattcgaacgttctaaaccccatgttaacatcggtacaatcggccacgttgaccatggtaaaactacattaactgctgcgatcactacagtacttgcaaaagctggtggtgctgaagcacgcggatacgatcaaatcgatgctgctccagaagaaagagagcgcggtatcacaatctcaactgcacacgttgagtacgaaactgaaactcgtcactatgcacacgttgactgcccaggtcacgctgactatgttaaaaacatgat

SEQ ID NO: 1818 - DNA, 268 bp, Bacillus cereus; identical to SEQ ID NO: 1816
  ref <308>: DATABASE ACCESSION NUMBER: ATCC 14579

SEQ ID NO: 1819 - DNA, 278 bp, Bacillus anthracis; identical to SEQ ID NO: 1817
  strain CIP 9444

SEQ ID NO: 1820 - DNA, 278 bp, Bacillus pseudomycoides
  NRRL B-617
atggctaaagctaaattcgaacgttctaaaccccatgttaacatcggtacaatcggccacgttgaccatggtaaaactacattaactgctgcgatcactacagttcttgcaaaagctggtggtgctgaagcacgcggatacgaccaaatcgatgctgctccagaagaaagagagcgcggtatcacaatctcaactgcacacgttgagtacgaaactgaaactcgtcactatgcacacgttgactgcccaggtcacgctgactatgttaaaaacatgat

SEQ ID NO: 1821 - DNA, 263 bp, Bacillus cereus
  ref <308>: DATABASE ACCESSION NUMBER: ATCC 49064
atggctaaagctaaattcgaacgttctaaaccccatgttaacatcggtacaatcggccacgttgaccatggtaaaactacattaactgctgcgatcactacagtacttgcaaaagctggtggtgctgaagcacgcggatacgatcaaatcgatgctgctccagaagaaagagagcgcggtatcacaatctcaactgcacacgttgagtacgaaactgaaactcgtcactatgcacacgttgactgcccaggtcacgctgacta

SEQ ID NO: 1822 - DNA, 1668 bp, Streptococcus oralis
  ref <308>: DATABASE ACCESSION NUMBER: ATCC 35037
caatcgaagtacaacgttctcttcgwgtattggacggtgcggttactgttcttgactcacaatcaggtgttgagcctcaaactgaaacagtttggcgtcaagcaactgagtacggagttccacgtatcgtatttgctaacaaaatggacaaaatcggtgctgacttcctttactcagtaagcacacttcacgaccgtcttcaagcaaacgcacacccaatccaattgccaatcggtgctgaagatgacttccgtggtatcatcgacttgatcaagatgaaagctgaaatctatactaacgaccttggtacagatatccttgaagaagatattccagctgaataccttgaccaagctcaagaataccgtgaaaaattggttgaagcagtcgctgaaactgatgaagacttgatgatgaaataccttgaaggtgaagaaatcactaacgaagaattgaaagctgctatccgtaaagcaactatcaacgttgaattcttcccagtattgtgtggttctgccttcaagaacaagggtgttcaattgatgcttgatgcggttatcgactaccttccaagcccacttgatatcccagcgatcaaaggtatcaacccagatwcagatgaagaagaaactcgtccagcatctgacgaagagccattcgcagctcttgccttcaagatcatgacggacccatttgtaggtcgtttgacattcttccgtgtatactcargtgttctccaatcargktcttacgtattgaacacatctaaaggtaaacgtgaacgtatcggacgtatccttcaaatgcacgctaacagccgtcaagaaattgacactgtttactcaggtgatatcgctgctgccgttggtttgaaagatactycaactggtgactcattgmcagatgaaaaagctaaaatcatccttgagtcaatcaacgttccagamccagttatccaattgatggttgagccaaaatctaaagctgaccaagataagatgggtatcgcccttcaaaaattggctgaagaagatccaacattccgcgttgaamcaaacgttgaaactggtgaamcagttatctcaggtatgggtgagcttcacttggacgtccttgttgaccgtatgcgtcgtgagttcaaagtggaagcgaacgtaggtgctcctcaagtatcttaccgtgaaacattccgcgcttctactcaagcacgtggattcttcaaacgtcagtctggtggtaaaggtcaattcggtgatgtatggattgaatttactccaaacgaagaaggtaaaggattcgaattcgaaaacgcaatcgtcggtggtgtggttcctcgtgaatttatcccagcggttgaaaaaggtttggtagaatctatggctaacggtgttcttgcaggttacccaatggttgacgttaaagctaagctttacgatggttcataccacgatgtcgactcatctgaaactgccttcaagatcgcggcttcacttgcccttaaagaagctgctaagtcagcacaaccagctatccttgagccaatgatgcttgtaaccatcactgttccagaagaaaaccttggtgatgttatgggtcacgtaactgctcgtcgtggacgtgtagatggtatggaagcacwcggtaacagccaaatcgttcgtgcttacg

SEQ ID NO: 1823 - DNA, 115 bp, Budvicia aquatica
  ref <308>: DATABASE ACCESSION NUMBER: ATCC 35567
agacctgcgttcacaaacacagggtcgtgcttcttactctatggagttcttgaagtacaacgaagcgccaaacaacgttgctacagcaatcattgaagctcgtaaggctagataa

SEQ ID NO: 1824 - DNA, 107 bp, Buttiauxella agrestis
  ref <308>: DATABASE ACCESSION NUMBER: ATCC 33320
ctgcgttcactgaccaaggtcgtgcatcttactccatggaattcctgaagtatgatgacgcgccaaacaacgtagctcaggccgtaatcgaagctcgcggtaaataa

SEQ ID NO: 1825 - DNA, 79 bp, Klebsiella oxytoca
  ref <308>: DATABASE ACCESSION NUMBER: ATCC 13182
ttactccatggagttcctgaagtatgatgatgcgccgaacaacgttgctcaggccgtaatcgaagcccgtggtaaataa

SEQ ID NO: 1826 - DNA, 111 bp, Plesiomonas shigelloides
  ref <308>: DATABASE ACCESSION NUMBER: ATCC 14029
cagctgcgttctctgaccaaaggtcgtgcatcatacactatggaattcctgaagtatgatgatgcgccaaacaacgttgctcaggccgttattgaagcccgtggtaagtaa

SEQ ID NO: 1827 - DNA, 108 bp, Shewanella putrefaciens
  ref <308>: DATABASE ACCESSION NUMBER: ATCC 8071
gatttgcgctctgcaactcatgggcgtgcttcgtactccatggagttcttgaagtactctgatgcaccgcaaaacattgcgaaagcgattattgaatctcgtagctaa

SEQ ID NO: 1828 - DNA, 113 bp, Obesumbacterium proteus
  ref <308>: DATABASE ACCESSION NUMBER: ATCC 12841
ctcagctgcgttctctgaccaaaggtcgtgcatcttactccatggaattcctgaagtatgatgatgcgcctaacaacgttgctcaggccgttattgaagctcgtggcaaataa

SEQ ID NO: 1829 - DNA, 70 bp, Klebsiella oxytoca
  ref <308>: DATABASE ACCESSION NUMBER: ATCC 13182
gccgcagggttaaaaccaaagtcccgtgctctctcctgaaggggagagcactatagtaaggaatatagcc

SEQ ID NO: 1830 - DNA, 66 bp, Budvicia aquatica
  ref <308>: DATABASE ACCESSION NUMBER: ATCC 35567
gcctcgggtaaaacttatatcccagtccccctcgtatagagggggatagagtaaaggaagataatc

SEQ ID NO: 1831 - DNA, 81 bp, Plesiomonas shigelloides
  ref <308>: DATABASE ACCESSION NUMBER: ATCC 14029
tccacaggattaaaacccaggtttaaacctaagtcccgtgctctctcctcaggggagagcacaatagtaaggaatatagcc

SEQ ID NO: 1832 - DNA, 70 bp, Obesumbacterium proteus
  ref <308>: DATABASE ACCESSION NUMBER: ATCC 12841
gctactagtttaaaacattgatcccgtgctctctctatgaagggagagcacaagagtaaggaataaagcc

SEQ ID NO: 1833 - DNA, 72 bp, Shewanella putrefaciens
  ref <308>: DATABASE ACCESSION NUMBER: ATCC 8071
tttccagttacgacataaatgttattatggtccagctttgactggactattctgaaaagaaaggaatatatc

SEQ ID NO: 1834 - DNA, 73 bp, Buttiauxella agrestis
  ref <308>: DATABASE ACCESSION NUMBER: ATCC 33320
gccccgggttttaaaaaacattgatcccgtgctctctccagaaggggagagcgcaacagtaaggaatatagcc

SEQ ID NO: 1835 - DNA, 795 bp, Campylobacter coli
  ref <308>: DATABASE ACCESSION NUMBER: ATCC 43479
ctgcagctgatggtcctatgccacaaactagagagcacatccttctatcacgccaagtaggtgttccatatatcgttgtatttatgaataaagcagatatggttgatgatgctgaacttttagaattggttgaaatggaaattagagaattattaagctcttatgatttcccaggtgatgacacacctattatttcaggttctgctttaaaagctcttgaagaagcaaaagctggacaagatggcgaatggtcagcgaaaattatggatcttatggctgctgttgatagctatattccaactccaactcgtgacactgaaaaagatttcttaatgccaattgaagatgttttctcaatttcaggtcgtggtactgttgttacaggtagaattgaaaaaggtattgtaaaagttggtgatactatagaaatcgttggtattaaagatactcaaacaacaactgtaactggcgttgaaatgtttagaaaagaaatggaccaaggtgaagcaggggataatgttggtgttcttcttcgtggtacaaaaaaagaagaagttatccgcggtatggttcttgctaaaccaaaatcaattactccacatactgatttcgaagctgaagtttatatcctaaataaagatgagggtggtagacatactccattctttaataactatagaccgcaattctatgtaagaacaacagatgtaacaggttctattaaattagctgatggcgttgaaatggttatgcctggtgaaaatgtaagaattactgtaagcttgattgcaccag

SEQ ID NO: 1836 - DNA, 817 bp, Campylobacter fetus subsp. fetus
  ref <308>: DATABASE ACCESSION NUMBER: ATCC 25936
gccatactagttgtttctgcagctgatggcccaatgccacaaactagagagcacattttgctatctcgtcaagttggtgttccatatatagttgtttttatgaacaaagctgatatggtagatgacgcagagttgctagaattagttgaaatggagatcagagagttattaagcgaatatgacttccctggtgatgatactcctattataagcggatcagcacttcaagctcttgaagaagctaaagctggtaatgatggcgaatggtcagctaagattatggatcttatggctgctgttgatagctacataccaactccagttcgtgctactgataaagatttcttaatgccgattgaagacgtattctcaatttctggccgtggtactgttgttactggtagaattgaaaaaggtatagttaaagttggtgatactatcgaaatcgtaggtattagagatacacaaactacaacagttaccggcgttgaaatgtttagaaaagaaatggatcaaggcgaggctggtgataacgttggtgttcttttacgcggtacaaagaaagaagacgttgaaagaggtatggttctttgtaagccaaaatcaattactcctcatactaaatttgagggagaagtttatatcttgactaaggaagagggcggtagacatactccattcttcaacaactatagaccacaattttatgtaagaacaacagatgttactggatcaatcactcttccagagggtactgagatggttatgcctggtgataacttaaaaatcactgttgagttaatcaacccagttgctc

SEQ ID NO: 1837 - DNA, 798 bp, Campylobacter fetus subsp. venerealis
  ref <308>: DATABASE ACCESSION NUMBER: ATCC 33561
ccatactagttgtttctgcagctgatggcccaatgccacaaactagagagcacattttgctatctcgtcaagttggtgttccatatatagttgtttttatgaacaaagctgatatggtagatgacgcagagttgctagaattagttgaaatggagatcagagagttattaagcgaatatgacttccctggtgatgatactcctattataagcggatcagcacttcaagctcttgaagaagctaaagctggtaatgatggcgaatggtcagctaagattatggatcttatggctgctgttgatagctacataccaactccagttcgtgctactgataaagatttcttaatgccgattgaagacgtattctcgatttctggccgtggtactgttgttactggtagaattgaaaaaggtatagttaaagttggtgatactatcgaaatcgtaggtattagagatacacaaactacaacagttaccggcgttgaaatgtttagaaaagaaatggatcaaggcgaggctggtgataacgttggtgttcttttacgcggtacaaagaaagaagacgttgaaagaggtatggttctttgtaagccaaaatcaattactcctcatactaaatttgagggagaagtttatatcttgactaaggaagagggcggtagacatactccattcttcaacaactatagaccacaattttatgtaagaacaacagatgttactggatcaatcactcttccagagggtactgagatggttatgcctggtgataacttaaaaatcactgttagtt

SEQ ID NO: 1838 - DNA, 1116 bp, Buttiauxella agrestis
  ref <308>: DATABASE ACCESSION NUMBER: ATCC 33320
gtgtctaaagaaaaatttgaacgtacaaaaccgcacgtcaacgtcggtactatcggccacgttgaccatggtaaaactactctgactgcagcaatcactaccgttctggctaaaacctacggcggttctgcacgcgcattcgaccagatcgataacgcaccagaagaaaaagctcgtggtatcaccatcaacacttcccacgttgaatatgacaccccgactcgtcactacgcgcacgttgactgcccagggcacgccgactacgttaaaaacatgatcaccggtgctgctcagatggacggcgctatcctggttgttgctgcgactgatggcccgatgccacagactcgtgagcacatcctgctgggtcgccaggttggcgttccattcatgatcgtgttcatgaacaaatgtgacatggttgatgacgaagagctgctggaactggtagaaatggaagttcgtgaacttctgtctgcttatgatttcccgggcgacgacatcccagtggttcgtggttcagctctgaaagcgctggaaggcgaagcagagtgggaagctaaaatcatcgagctggctggtcacctggataactacatcccagaaccagagcgtgctatcgacaagccattcctgctgccaatcgaagacgtattctccatctccggccgtggtactgttgttactggtcgtgtagagcgtggtatcattaaagttggtgaagaagtagaaatcgttggtatcaaagataccgtgaaatctacctgtactggcgttgaaatgttccgcaaactgctggacgaaggccgtgctggtgagaacgttggtgttctgctgcgtggtattaaacgtgaagatatcgaacgtggtcaggttctggctaagccaggctctatcaagccgcacactcagttcgaatcagaagtttatatcctgtccaaagatgaaggcggccgtcatactccgttcttcaaaggctaccgtccacagttctacttccgtacaactgacgtgactggcaccatcgaactgccagaaggcgttgagatggtaatgccgggcgacaacattcaaatggttgttaccctgatccacccaatcgcaatggacgacggt

SEQ ID NO: 1839 - DNA, 1109 bp, Klebsiella oxytoca
  ref <308>: DATABASE ACCESSION NUMBER: ATCC 13182
gtgtctaaagaaaaatttgaacgtacaaaaccgcacgtcaacgtcggtactatcggccacgttgaccatggtaaaactactctgaccgctgcaatcactaccgttctggctaaaacctacggtggtgctgctcgcgcattcgaccagatcgataacgcgccggaagaaaaagctcgtggtatcaccatcaacacttcccacgttgaatatgacaccccgactcgccactacgcgcacgtagactgcccgggccacgccgactatgttaaaaacatgatcaccggtgctgcgcagatggacggcgcgatcctggttgttgctgcgactgacggcccgatgccgcagactcgtgagcacatcctgctgggtcgtcaggtaggcgttccgtacatcatcgtgttcctgaacaagtgcgacatggttgatgacgaagagctgctggaactggttgaaatggaagttcgtgaacttctgtctcagtacgatttcccgggcgacgacactccgatcgttcgtggttctgctctgaaagctctggaaggcgacgctgagtgggaatctaaaatcatcgaactggctggcttcctggattcttatattccggaaccagagcgtgcgattgacaagccgttcctgctgccgatcgaagacgtattctccatctccggtcgtggtaccgttgttaccggtcgtgtagagcgcggtatcatcaaagttggcgaagaagttgaaatcgttggtatcaaagacactgctaagtctacctgtactggcgttgaaatgttccgcaaactgctggacgaaggccgtgctggtgagaacgttggtgttctgctgcgtggtatcaaacgtgaagaaatcgaacgtggtcaggtactggctaagccgggctctatcaagccgcacaccaagttcgaatctgaagtttatatcctgtccaaagacgaaggcggccgtcacactccgttcttcaaaggctaccgtccgcagttctacttccgtacaactgacgtgactggcaccatcgaactgccggaaggcgtagagatggttatgccgggcgacaacatcaaaatggttgttaccctgatccacccgatcgcgatgga

SEQ ID NO: 1840 - DNA, 1108 bp, Plesiomonas shigelloides
  ref <308>: DATABASE ACCESSION NUMBER: ATCC 14029
gtgtctaaagaaaaatttgaacgtactaaaccgcacgttaacgttggtactatcggccacgttgaccacggtaaaactaccctgactgcagctatcactaccgtactgtctaaagtatacggtggtcaggctcgtgcattcgatcagatcgataacgcgccagaagaaaaagctcgtggtatcaccatcaacacttctcacgtagagtacgacaccccaactcgtcactacgcgcacgttgactgcccaggtcacgccgactacgtgaagaacatgatcactggtgctgctcagatggacggcgctatcctggtagtagctgcgactgacggcccaatgcctcagactcgtgagcacatcctgctgggtcgtcaggtaggcgttccttacatcatcgtgttcctgaacaagtgtgacatggttgatgacgaagagctgctggaactggtagaaatggaagtacgtgagctgctgtctcagtacgacttcccaggcgacgatactccagttgttcgcggttctgcactgaaagcgctggaaggcgatgctcagtgggaagagaagattgttgaactggcaggctacctggacagctacatccctgagccagagcgtgctatcgacaagccattcctgctgccaatcgaagacgtattctctatctccggccgtggtactgtagtaactggtcgtgtagagcgcggtatcatcaaagttggtgaagaagtagaaatcgttggtatcaaagagactaccaagactacttgtactggcgttgaaatgttccgtaagctgctggacgaaggtcgtgcgggcgagaacgtaggtgttctgctgcgtggtaccaagcgtgatgacgtagagcgtggtcaggttctggctaagccaggctcaatcaacccacacaccaactttgtagcagaagtttatattctgtccaaagatgaaggtggtcgtcacactccattcttcaaaggctaccgtccacagttctacttccgtacaactgacgtgaccggtaccatcgaactgccagaaggcgtagagatggtaatgccaggtgacaacattcaaatggttgttaccctgattgcaccaatcgcgatgg

SEQ ID NO: 1841 - DNA, 1107 bp, Shewanella putrefaciens
  ref <308>: DATABASE ACCESSION NUMBER: ATCC 8071
tggcaaaagctaaatttgaacgtattaagcctcacgtaaacgtgggcaccattggtcacgttgaccatggtaaaaccactctgactgcagctatctctcacgtactggctaagacctacggtggcgaagctaaagacttctctcaaatcgataacgctccagaagagcgtgagcgcggtattaccatcaatacctctcacatcgaatatgacacgccatcacgccactacgcccacgtagactgcccaggccacgctgactatgttaaaaacatgatcactggtgctgcacagatggacggcgcgattctggtagtcgcttcaacagacggtccaatgccacagactcgtgagcacatcctgctttctcgtcaggttggcgtaccattcatcatcgtattcatgaacaaatgtgacatggtagatgacgaagagctgttagagctagttgagatggaagtgcgtgaactgttatcagaatacgatttcccaggtgatgacttaccggtaatccaaggttcagctctgaaagcgctagaaggcgagccagagtgggaagcaaaaatccttgaattagcagcggcgctggattcttacattccagaaccacaacgtgacatcgataagccgttcctactgccaatcgaagacgtattctcaatttcaggccgtggtacagtagtaacaggtcgtgttgagcgtggtattgtacgcgtaggcgacgaagttgaaatcgttggtgtacgtgcgacaactaagacaacgtgtactggtgtagaaatgttccgtaaactgcttgacgaaggtcgtgcaggtgagaactgtggtattttgttacgtggtactaagcgtgatgacgtagaacgtggtcaagtattagcgaagccaggttcaatcaacccacacactacttttgaatcagaagtttacgtactgtcaaaagaagaaggtggtcgtcacacgccattcttcaaaggctaccgtccacagttctacttccgtacaactgacgtaaccggtactatcgaactgccagaaggcgtagagatggtaatgccaggcgataacatcaagatggtagtgacactgatttgcccaatcgcgatgg

SEQ ID NO: 1842 - DNA, 1116 bp, Obesumbacterium proteus
  ref <308>: DATABASE ACCESSION NUMBER: ATCC 12841
gtgtctaaagaaaaatttgaacgtacaaaaccgcacgttaacgttggtacaatcggccacgttgaccacggtaaaactaccctgactgctgcaatcactaccgttctggctaaaacctacggtggttctgcacgtgcattcgaccagatcgataacgcgccagaagaaaaagctcgtggtatcaccatcaacacttctcacgttgaatatgacaccccgactcgccactacgcacacgtagactgcccaggccacgccgactatgttaaaaacatgatcaccggtgctgcgcagatggacggcgcgatcctggttgttgctgcgactgacggccctatgcctcagactcgtgagcacatcctgctgggtcgtcaggttggcgttccttacatcatcgtattcctgaacaaatgcgacatggttgatgatgaagagctgctggagctggtagaaatggaagttcgtgaacttctgtctcagtacgacttcccaggcaatgatactccaatcatccgtggttctgctctgaaagcgctggaaggcgaagctgagtgggaagctaagatcgtagaactggctgaaactctggattcttacatcccagaaccagaacgtgctatcgacaagccattcctgctgccaatcgaagacgtattctcaatctctggccgtggtactgttgttaccggtcgtgtagagcgcggtatcgttaaagttggtgaagaagttgagattgttggtatcaaagataccgttaaatcaacttgtaccggcgttgaaatgttccgtaaactgctggacgaaggtcgtgcaggcgagaacgttggtgttctgctgcgtggtatcaagcgtgaagacatcgaacgtggtcaggttctggctaaaccaggttctatcaaaccacacaccaagttcgaatcagaagtttatattctgagcaaagatgaaggcggccgtcatactccgttcttcaaaggctaccgtccacagttctacttccgtacaactgacgtgaccggtaccatcgaactgccagaaggcgtggaaatggtaatgccaggcgataacatcaaaatgatcgttaccctgatccacccaatcgcaatggacgatggt

SEQ ID NO: 1843 - DNA, 1129 bp, Budvicia aquatica
  ref <308>: DATABASE ACCESSION NUMBER: ATCC 35567
gtgtctaaagaaaaatttgaacgtacaaaaccgcacgttaacgttggtactatcggccacgttgaccacggtaaaacaactctgactgctgctatcaccagcgttttagctaaaacttatggcggtaacgctcgtgcattcgatcaaatcgataatgcaccagaagaaaaagcacgtggtatcaccatcaacacttctcacgttgagtatgatactcctgctcgccactacgcacacgtagactgcccaggacacgccgactatgtgaaaaacatgatcaccggtgctgctcaaatggacggcgcgatcttagttgttgcggcaactgatggtcctatgccacagactcgtgagcacatcctgttaggtcgtcaggttggcgttccttacatcatcgtgttcctgaacaagtgtgacatggttgatgacgaagaactgttagaattagttgaaatggaagttcgtgagcttctttctgcttatgatttccctggtgacgatactccagttgttcgtggttctgcgctgaaagcgttagaaggcgaagctgagtgggaagctaagatcattgaattagccggatatctggatagctacatcccagagccagagcgtgcgattgaccgtccgttcctgctgccaatcgaagacgtattctctatttcaggccgtggtacagttgttaccggtcgtgtagagcgcggaatcgttaaagtcggtgaagccgttgagattgttggtatcaaagataccgtacaaactacctgtactggcgttgaaatgttccgtaagttacttgacgaaggccgtgctggtgagaacgttggtgttctgctgcgtggtactaagcgtgaagaaatcgaacgcggtcaagtactggctaagccaggttcaatcaacccgcacaccaactttgtatcagaagtttatattctgagcaaagatgaaggtggtcgtcatactccattcttcaaaggctaccgtccacagttctacttccgtacaactgacgtgaccggtactatcgaactgccagaaggcgtagagatggtgatgcctggtgacaacattcagatgactgtaactctgattgcaccaatcgcgatggacgaaggtttacgcttcgcta

SEQ ID NO: 1844 - DNA, 810 bp, Abiotrophia adiacens
  ref <308>: DATABASE ACCESSION NUMBER: ATCC 49175
atattcataatgcattacaagttgtgaaaacaacaagtgacggaagtgaaaagactgttacattggaaactgctgtagaattaggggatggtgcagttcgtacgattgccatggaatctacagatggtttgcaacgtggcatgaaagtagtggacttaggacgcacaattagcgttcctgtgggacctgaaacattaggtcgtgtattcaacgttttaggagatacaatcgacttgaaagaaccattcccagaagactttacaagacatgaaatccataaaccagcaccaaaatttgaagaattaaacagtcaatatgaaattctacaaacagggattaaagttattgaccttttagcaccttatcttaaaggtggtaaaatcggtttattcggtggtgccggtgtagggaaaaccgtattaattcaagaattaattcataatatcgctgaagaacttggtggtatttcagtatttacaggggtaggggaacgtactcgtgaagggaatgacctttaccatgaaatgcaagaatcaggcgtatctgctaaaacagcgatggtgtttgggcaaatgaacgaaccaccaggagctcgtatgcgtgtagcactaacagggttaactattgcggaatacttccgtgatatggaaaaacaagacgtgcttttattcatcgataacatttatcgtttcacgcaagcaggttcagaagtgtcagcgttacttggtcgtatgccttctgccgtagggtatcaaccaacattagcgacagaaatgggtcaattacaagaacgtatcagttcaactaaag

SEQ ID NO: 1845 - DNA, 815 bp, Arcanobacterium haemolyticum
  ref <308>: DATABASE ACCESSION NUMBER: ATCC 9345
tgctctgccagaaattaacaacgccctcctcaccgaagtagacctctccggccaaggcgaaggcgaaagcgttctcaagatgactcttgaggttgctcagcacctcggcgataacatcgtccgtaccatcgccatgaagccaaccgacggtctggttcgcggcgccaccgttatcgataccggcgccccaatcaccgtgccagttggcgacgcaactaaaggtcatgttttcaacgtgaccggtgatgtcctaaacttgggcgaaggcgaaacccttgacgtcaaggaacggtggccaatccaccgcaaggctccacagttcgacgaactcgaaccggaaaccaagatgttcgaaacaggcatcaaggtgatcgatctcctcaccccatacgtacagggcggcaagatcggtctgtttggcggtgctggtgttggtaagaccgttcttatccaggaaatgatccagcgtgttgcacaggatcatggcggtgtgtccgtgttcgcgggtgtgggtgaacgtacccgtgaaggtaacgatcttatccacgaaatggaagatgcgggcgttcttgataagaccgcgcttgtgttcggccagatggatgaaccgccaggggttcgtttgcgtattgcactttccggcctgaccatggcggaatacttccgtgacgtgcaaaaccaggacgtgcttttgttcatcgataacatcttccgcttcacccaggcaggttcggaagtgtccacgttgcttggccgtatgccatcagcagtgggctaccagccgaccttggcagatkaaatgggcgcattgcagg

SEQ ID NO: 1846 - DNA, 1073 bp, Basidiobolus ranarum
  ref <308>: DATABASE ACCESSION NUMBER: ATCC 24670
accttcctcctatcttgaahgccctggaggtccaaaaccacagctctcgyttagttttagaggtgtcccagcatttgggtgaaaacaccgttcgtactattgctatggacggtactgaaggattggttcgtggtcaaaatgtcgtagataccggatatcctattagagttcctgtcggtcctgaatgtttgggtcgtatcatgaacgttattggcgagcctgttgatgagcgcggycctatcaagaccaagaagcttgcacccatccacgcttctccccccgagttcgtygaccaatccaccacccccgaaatcttggagactggtattaaggttgtcgatttgttggccccttacgctcgtggtggtaagatcggtcttttcggtggtgccggtgtcggtaagactgtgtttatccaggagttgatyaacaacgttgccaaggcccacggtggttactccgtgttcgctggtgttggtgagcgtactcgtgagggtaacgatttgtaccacgagatgattcaaactggtgtcatcaagcttgatggccaatccaaggctgcccttgtctacggmcaaatgaacgagcccccaggtgctcgtgcccgmgtcgctttgaccggtcttaccgttgctgaatacttccgtgatgaggaagghcaagatgtgttgctcttcattgacaacattttccgtttcacccaagctggttctgaagtgtcygccttgttgggtcgtatcccctccgctgtcggttaccaacccaccttggccaccgatatgggtgtcatgcaagagcgtattaccaccaccaagaagggttccattacctctgtccaggccatttacgtccctgctgatgatttgaccgatcccgctcctgccactacttttgcccatcttgacgccaccaccgtgttgtctcgttccatctctgagttgggtatttaccccgctgtcgatcccctcgactccaagtctcgtatgttggatccycgtattgtcggtgaagagcactacgacatcgccactggtgttcagaagattctccartcttacaagtctctccaggat

SEQ ID NO: 1847 - DNA, 480 bp, Blastomyces dermatitidis
  ref <308>: DATABASE ACCESSION NUMBER: ATCC 56220
tgtctttatccaggagttgattgtacgtcttgcctcaccctttgggtattttgcgaatactaattatagtagaacaacattgccaaggctcacggtggttactctgtcttcactggtgtcggtgaacgtactcgtgagggtaacgatttgtaccacgaaatgcaggaaactggtgtcattcagctcgagggtgaatccaaggtcgccctcgtgttcggtcagatgaacgagccccctggtgcccgtgcccgtgtcgctcttactggtttgaccattgccgagtacttccgtgacgaggagggtcaagatgtgcttctcttcattgacaacattttccgtttcactcaggccggttctgaggtgtctgcccttttgggtcgtatcccctctgccgtcggttaccagcccactctcgccgtcgacatgggtgtcatgcaggagcgtattaccaccaccaccaagggttccatcacctccgtc

SEQ ID NO: 1848 - DNA, 566 bp, Blastomyces dermatitidis
  ref <308>: DATABASE ACCESSION NUMBER: ATCC 14112
tgtcttcattcaggagttgattgtacgtcccttcctctctacaaatgacgggcgaggaaaatttttggctttttctaatagctcgttatagaacaacattgccaaagcccacggtggttactccgttttcactggtgtcggcgagcggacccgtgaaggaaacgatttgtaccacgagatgcaggaaacccgtgttatccagctcgatggcgagtctaaggtcgcactcgtcttcggtcagatgaacgagccccccggagcccgtgcccgtgttgccctcactggcctgaccattgctgaatatttccgtgacgaggaaggtcaagacggtatgtattcatataaattactccgggcaaattgactcagaaccgcactcactcacacatatattagtgcttctctttatcgacaacattttccgcttcacccaggccggttccgaagtgtccgccctgcttggtcgtattccctccgccgtcggttaccaacccactctcgccgtcgacatgggtggtatgcaggaacgtatcacaaccaccaccaagggctccattacctycgtg

SEQ ID NO: 1849 - DNA, 817 bp, Campylobacter coli
  ref <308>: DATABASE ACCESSION NUMBER: ATCC 43479
aatgaagccattgttgtaaattttgaaagtgaaggcaaaaaacaaaaacttgttttagaagtagcagcacacttgggcgataatagagttagaactattgctatggatatgacagatggcttggtaagaggacttaaagcagaagctttgggtgctcctattagcgttcctgtgggtgaaaaagttttaggaagaatttttaatgttacgggagatttgatcgatgaaggtgaagaaatttcttttgataaaaaatgggcaattcatagagatccaccagcttttgaagatcaaagcacaaaaagtgagatttttgaaacagggattaaagttgtggatttacttgctccttatgcaaaaggtggtaaagtaggtctttttggtggtgcaggtgttggtaaaactgttattattatggagcttattcacaatgttgcatttaaacatagcggctattctgtatttgcaggtgtaggtgagagaactcgtgaaggaaatgacctttataatgaaatgaaagaaagtaatgttttagacaaagttgctctatgttatggacaaatgaatgaaccaccaggggcaagaaatcgtattgctttaacaggtttaacaatggctgagtattttagagatgaaatgggtcttgatgtgcttatgtttattgataatatctttagattttcacaatcaggttctgaaatgtcagcacttttaggaagaattccatcagctgtgggttatcaaccaaccctagcaagtgaaatgggtaaattccaagaaagaattacttcaactaaaaaaggatcaattacttcag

SEQ ID NO: 1850 - DNA, 775 bp, Campylobacter fetus subsp. fetus
  ref <308>: DATABASE ACCESSION NUMBER: ATCC 25936
aaggcaacacgcataaacttattttagagactgctgcacaccttggagataatcgtgtaagaactatcgctatggatatgagcgaaggacttacaagagggttagatgctatagcgcttgggtcgcctatcagtgttcctgttggagaaaaagttttaggaagaatattcaacgtaattggtgatcttatagacgaaggcgaagaagaaaaatttgataaaaaatggtcgattcatagagatccgccggcatttgaagatcaaagcacaaaaagtgaaatttttgaaacaggtataaaagtcgtagatcttttggctccttatgcaaaaggcggtaaagttggactatttggcggtgccggcgttggtaaaacagttatcattatggaacttatccacaacgttgcattcaaacacagcggctattcggtatttgccggtgtcggtgaaagaacaagagagggtaacgatctttataatgaaatgaaagaatccggcgttttggataaagttgccttatgttatggacaaatgaatgaaccgccgggtgcaagaaaccgtatagcgcttactggtcttacaatggctgagtattttcgtgacgagatgggactagatgttcttatgtttatcgataacatcttccgtttctcacaatcaggctcagagatgtcggctcttcttggacgtatcccaagtgcggttggttatcaaccaacgttagctagcgaaatgggaagacttcaagaaagaatcacatcaactaaaaaaggttc

SEQ ID NO: 1851 - DNA, 793 bp, Campylobacter fetus subsp. venerealis
  ref <308>: DATABASE ACCESSION NUMBER: ATCC 33561
cgaagctattgaagtaaattttacagtagaaggcaacacgcataaacttattttagagactgctgcacaccttggagataatcgtgtaagaactatcgctatggatatgagcgaaggacttacaagagggttagatgctatagcgcttgggtcgcctatcagtgttcctgttggagaaaaagttttaggaagaatattcaacgtaattggtgatcttatagacgaaggcgaagaagaaaaatttgataaaaaatggtcgattcatagagatccgccggcatttgaagatcaaagcacaaaaagtgaaatttttgaaacaggtataaaagtcgtagatcttttggctccttatgcaaaaggcggtaaagttggactatttggcggtgccggcgttggtaaaacagttatcattatggaacttatccacaacgttgcattcaaacacagcggctattcggtatttgccggtgtcggtgaaagaacaagagagggtaacgatctttataatgaaatgaaagaatccggcgttttggataaagttgccttatgttatggacaaatgaatgaaccgccgggtgcaagaaaccgtatagcgcttactggtcttacaatggctgagtattttcgtgacgagatgggactagatgttcttatgtttatcgataacatcttccgtttctcacaatcaggctcagagatgtcggctcttcttggacgtatcccaagtgcggttggttatcaaccaacgttagctagcgaaatgggaagacttcaagaaagaatcacatcaact

SEQ ID NO: 1852 - DNA, 825 bp, Campylobacter gracilis
  ref <308>: DATABASE ACCESSION NUMBER: ATCC 33236
ggactatttaccgaagattaacgaagctatcgaggttaaatttgacgtcgagggcgctcatcgcaggctgatcctagaggtagccgcgcaccttggagacaatcgcgtccgcacgatcgctatggatatgagcgatggacttaggcgagggcttgaggccgtcgctttgggcgcgcctattacggtgcctgtgggcgagaaagttttgggtagaatttttaatgttacgggcgatctgatcgacgaaggcgaggatgaaaaatttgaaacccgctggtcgatccacagagatccgcctagctttgaaaatcaaagcacgaagagtgaaatttttgaaaccggcattaaggtagtcgatctgctcgccccttatgcaaagggcggtaaggtaggactattcggcggtgctggcgtcggtaagaccgtcatcatcatggaactgattcacaacgtcgctttcaaacacagcggctactccgtatttgcgggtgtcggcgagcgaacgagagagggaaacgacctttataacgagatgaaagaatcgggcgttttggataaagtcgccttgacctatggtcagatgaacgaaccgccgggagcgagaaaccgtatcgcgctaaccggtcttacgatggccgagtatttccgcgacgagctagggcttgacgttttgatgtttattgataatatcttccgcttctcgcagtcgggttcggagatgtccgcgcttttaggacgaattccgtccgcggtcggttatcagcctacgcttgccagcgaaatgggtaaattacaggagcgcattacttctactaagaagggctc

SEQ ID NO: 1853 - DNA, 818 bp, Campylobacter jejuni subsp. jejuni
  ref <308>: DATABASE ACCESSION NUMBER: ATCC 33560
tttacctcaaattaatgaagcaattgttgtaaattttgaaagcgaaggaaaaaaacataaacttgttttagaagtagcagctcatttaggagataatagagttagaactattgctatggatatgacagatggtttggtaaggggcttaaaagctgaggctttaggtgctcctattagtgttcctgttggtgagaaagttttaggaagaattttcaatgttactggagatttgatcgatgaaggtgaagaaatttcttttgataaaaaatgggcaattcatagagatccgccagcttttgaagatcaaagcacaaaaagtgagatttttgaaacagggattaaagttgtagatttgcttgctccttatgcaaaaggtggtaaagtaggtctttttggtggtgcaggtgttggtaaaactgttattattatggagcttattcacaatgttgcatttaagcatagcggctattctgtatttgcaggtgtgggtgagagaactcgtgaaggaaatgacctttataatgaaatgaaagaaagtaatgttttagacaaagttgctctatgttatggacaaatgaatgaaccaccaggagcaagaaatcgtattgctttaacaggtttaacaatggctgagtattttagagatgaaatgggtcttgatgtgcttatgtttattgataatatctttagattttcacaatcaggttctgaaatgtcagcacttttaggaagaattccatcagctgtgggttatcaaccaaccctagcaagtgaaatgggtaaattccaagaaagaattacttcaactaaaaaaggct

SEQ ID NO: 1854 - DNA, 830 bp, Enterococcus cecorum
  ref <308>: DATABASE ACCESSION NUMBER: ATCC 43198
attacctgatatcaacaacgccttattggtctataaaaatgatgaacaaaaaagtaaaattgtgctagaagctgccttagaattaggtgatggcatcattcgtacaattgccatggaatcaacggatggtttacaacgtgggatggaagttgtcgatactggtaaaccaatttcagttccagttggtaaagaaacgctaggacgtgtctttaacgttttaggggatacgattgatatgcaagaaccatttgcacaagatgcagatcgttctgcaattcataaagctgcaccaaaatttgaagacttaagtacaagtactgaaattttagaaacagggattaaagttatcgacttattagcaccatatttaaaaggtggtaaagtcggtctattcgggggtgccggagtaggtaaaaccgttttaatccaagaattaatccataatattgcacaagaacatggtgggatttctgtatttaccggtgttggtgaacgtacacgtgaaggaaatgacttgtatcatgaaatgcgtgattcaggagttattgaaaaaactgccatggtgtttggtcaaatgaacgaaccacctggagctcgtatgcgtgttgctttaactgggttaacgattgctgaatatttccgtgatgtagaaggacaagatgtgttgctatttattgataacatcttccgtttcactcaagcgggttctgaagtatcagccttgcttggtcgtatgccatctgccgtgggttatcaacctacattggctacagaaatgggtcaattacaagaacgtatcacttcaactaagaagggctctatcacttcta

SEQ ID NO: 1855 - DNA, 823 bp, Enterococcus columbae
  ref <308>: DATABASE ACCESSION NUMBER: ATCC 51263
tctttaccagatatcaataatgcgcttattgtctataaaaatgatgaacaaaaaagtaaaatcgtgcttgaagctgctttagagctaggagatggcattattcgtacgattgcaatggaatcaactgatggattgcaacgtggaatggaagttttcgatacaggtaagccaatttcagtaccagtaggtcgtgaaacattaggtcgtgtatttaatgttttaggtgataccattgatacgcaagaagcttttcctgctgatgcgaatcgtgatgcgattcataaatcagctccagcttttgaagaattaagtacaagtactgaaatcctagaaacagggattaaagttatcgacttactagcaccatacttaaaaggtgggaaagttggtctattcggtggtgccggtgtaggtaaaaccgtattaattcaagaattaattcataatatcgcccaagaacatgggggtatttcagtatttaccggtgttggtgaacgtacacgtgaaggaaatgacttgtatcacgaaatgcgtgattcaggcgttatcgaaaaaactgctatggtgtttgggcaaatgaacgaaccacctggagcacgtatgcgtgttgcgctaactggactaactattgcggaatacttccgtgatgttgaaggccaagacgtattgctatttattgataatatcttccgttttactcaagcaggttctgaagtttctgccttacttggtcgtatgccttctgcggtaggttatcaacctactttggctactgaaatgggtcaattgcaagaacggattacatcaacgaagaaaggttcga

SEQ ID NO: 1856 - DNA, 826 bp, Enterococcus dispar
  ref <308>: DATABASE ACCESSION NUMBER: ATCC 51266
ttaccagacattaataatgccttggttgtctataaaaatgacgaacaaaaaaccaagattgtattagaagctgccttagaactaggagatggtgtgattcgaactatcgccatggaatctactgatggcttacaacggggaatggaagttgtcgatactggcagttccatttctgtaccggtaggaaaagaaacattgggtcgtgtatttaacgttttaggaaatacaattgacttagaagaaccttttccagcggatgctaaacgtagtggtatccataaaaaagcgcctgattttgatgaattaagcactagtacagaaattttagaaacagggattaaagttattgacctattagccccttatttaaaaggtggtaaagtcggattattcggtggtgccggagttggtaaaaccgttttaattcaagaattaattcataatattgcccaagaacatggtgggatttctgtttttactggtgttggtgaaagaacacgtgaaggtaatgacttgtattatgaaatgaaagaatctggcgttatcgaaaaaactgccatggtatttggtcaaatgaatgagccacctggtgcccggatgcgggttgctttaaccggacttaccattgcggaatacttccgggacgttgaaggacaagatgtattgctctttatcgataatattttccgttttacccaagctggttcagaagtatctgccttattaggacggatgccctctgccgttggttatcaaccaactttggctactgaaatgggacaacttcaagaacggattacctcaacgaaaaaaggttctattacat

SEQ ID NO: 1857 - DNA, 814 bp, Enterococcus malodoratus
  ref <308>: DATABASE ACCESSION NUMBER: ATCC 43197
tccttaccagacatcaacaatgcgttgattgtttacaaaaaaaataaaacaaaagttgttcttgaagctgctttggaacttggtgatggtgttatccgcacgatctctatggaatcaacagatggcttgcaacgtggaatggaagttgtcgatacaggcaaaccaatctcagttcccgttggtaaagaaactttaggtcgtgtgtttaacgtattaggtgaaacaatcgacaaagaagcgccttttccagaagatgcagtaaaaagcggtattcataaaaaagcgccggcttttgaagaacttagtaccagtaatgaaattttagaaacagggatcaaagttatcgacttattagctccttacttaaagggtggtaaagtcggactatttggtggtgccggtgttggtaaaaccgtcttgatccaagaattgattcataatatcgcccaagaacacggtggtatttcagtgtttacgggtgttggtgaacgtactcgtgaagggaacgacctttattatgaaatgaaggaatcaggcgttattgagaaaactgccatggtgtttggacaaatgaacgagccgccaggtgcgcgtatgcgtgttgccttgactggtttgacattggctgaatatttccgagatgaagaaggacaagatgtgctgttgtttatcgacaacatcttccgtttcactcaagccggttctgaagtttctgccttgcttggccggatgccttcagccgttggctaccaaccaactttggcaactgaaatgggtcaattgcaagaacgaatcacttcaacgaagaagggct

SEQ ID NO: 1858 - DNA, 791 bp, Enterococcus mundtii
  ref <308>: DATABASE ACCESSION NUMBER: ATCC 43186
cgcattagttgtttataaaaatgatgagcaaaaatcaaaagttgttcttgaagcagcattagaattaggtgacggtgtgatccgtacgatcgcaatggaatcgacggatggactacaacgtggaatggaagtcatcgacacaagcaaagcgatctctgtaccagttggaacagaaacattaggtcgtgtgttcaacgtgttaggtgaaacaatcgatttggaagcaccatttccagaggatgcccaaagaagcgagatccacaagaaagcaccaaattttgatgaattaagcacaagtacagagattcttgaaactgggatcaaagtcattgacttattagcaccttatttaaaaggtgggaaagttggattgtttgggggtgccggtgttggtaaaaccgtactgatccaagaattgatccataatatcgcccaagaacatgggggaatctcagtgtttaccggtgtaggggaacgtacccgtgaaggaaacgatctgtattacgaaatgaaagattcaggcgtaatcgaaaaaacagcgatggtgtttggacaaatgaatgagccaccaggtgctcgtatgcgtgtcgcactaactggattgacgattgcggaatatttccgtgatgtcgaaggacaagacgtgctcttatttattgataatattttccgtttcacccaagcaggttcagaagtatctgccttactaggacgtatgccatcagcggttggttatcaaccaaccttagcgactgaaatgggacaactccaagaacggatcacttcaacga

SEQ ID NO: 1859 - DNA, 817 bp, Enterococcus raffinosus
  ref <308>: DATABASE ACCESSION NUMBER: ATCC 49427
tccttaccagacatcaacaatgcgttgattgtttataaaaaagataaaacaaaagttgttcttgaagctgctttggaacttggtgatggtgttattcgcacaatcgccatggaatcaacggatggattacaacgtggaatggaagttgtcgatactggcaagcctatttctgttccagtaggaaaagaaactctaggtcgtgtatttaatgtattaggtgaaacaatcgacaaggaagcgccttttccagaagatgcagaaaaaagtggtattcacaagaaagcaccaactttcgaagaacttagcacaagtaatgagatcttagaaacaggaatcaaagttattgacttgttagctccttacttaaaaggtggtaaagttggattatttggtggtgccggtgttggtaaaacagtcttgattcaagagctaattcataatatcgctcaagaacatggtggtatttctgtgtttactggtgttggtgaacgtactcgtgaagggaacgacctttattatgaaatgaaagattctggtgttattgagaaaactgctatggtgttcggtcaaatgaacgagccgccaggtgcacgtatgcgtgttgccttaactggtttaaccttagccgaatacttccgtgatgaagaaggacaagatgtgttgctatttattgacaacattttccgtttcactcaagccggatcagaagtttctgccttacttggccgtatgccgtcagcagttggttaccaaccgactttagcaactgaaatgggtcaattacaagaacgtattacgtcgacgaaaaaaggttcaa

SEQ ID NO: 1860 - DNA, 852 bp, Globicatella sanguis
  ref <308>: DATABASE ACCESSION NUMBER: ATCC 51173
cctgacattcataatgcattaattgtaacgaacgctgatatggcggatgtaatgcaagaaaatatttcggatgaagaaaaattattaaccttagaagttgcactggatttaggtcatggaatggtccggacaattgcgatggaatcaaccgatggtttggaacgcggcatgacagttgtggattatttaacaccgattaaagtgccagtaggcgaagccactttaggtagagtattcaatgttttaggtgagacaattgatgaactagaaccggttggcgacgatgttgaactcaaaagtattcatcgtgaagcccctaaatatgaggacttagataatagttttcatgttttagaaaccggaattaaggtcatcgatttattagctccttatattaaagggggaaaaatcggtttattcggtggtgccggagtgggtaaaacggtcttaattcaagaattaattcataatattgcagaacaattaggaggtatctcagttttcactggggttggagaacgtacccgtgaagggaatgacctcgtttttgaaatgcgagagtcaggtgtaagcaagaagacggccatggttttcggtcaaatgaatgaaccacctggagcacgtatgcgtgttgtcttaacaggacttacaatggcggaatatttccgtgacgaattgaaacaagacgtcttattatttattgataatatttatcgttttactcaagcaggttccgaagtgtcagccttattaggtcgtatgccttcagcagtagggtatcaaccaactttagcaagtgaaatgggacaaatgcaagaacgtattacgtcwacgaagcrcggttccattaca

SEQ ID NO: 1861 - DNA, 828 bp, Lactococcus garvieae
  ref <308>: DATABASE ACCESSION NUMBER: ATCC 49156
gcgcgactcttcctgagattaataacgcactcatcgtttacaaagatgtagacggcgttaaaactaaaatcgtccttgaagtggcgttggaacttggtgatggtgccgtacgtaccatcgctatggaatcaactgatggcttgacacgtggacttgaagttctcgatacaggtaaagcaatcagcgtacctgttggtcaagaaacacttggacgtgtcttcaatgtacttggagatgctattgatggaggggaagcatttgctgaaaatgcagaacgcagccctatccataaaaaagccccatcttttgatgaactttcaacagcaaatgaaattctggtgacagggattaaagttattgacttgcttgccccataccttaaaggtggtaagattgggttgttcggtggtgccggagttggtaaaaccgtccttatccaagagttgattcacaatattgcccaagaacacggtggtatttccgtatttactggtgttggggaacgtacacgtgaagggaatgacctttactgggaaatgaaagaatcaggcgttatcgaaaaaacagccatggtcttcggtcaaatgaatgaaccacctggagcacgtatgcgtgttgctcttactggtttgacaattgctgaatatttccgtgatgtagaaaaacaagacgttttgcttttcattgataatatcttccgtttcacccaagccggttcagaagtatctgccctcttaggacgtatgccatcagccgttggttaccaacctacgcttgcaactgaaatgggtcaacttcaagaacgtatcacttcaacaaaacaaggtt

SEQ ID NO: 1862 - DNA, 828 bp, Lactococcus lactis
  ref <308>: DATABASE ACCESSION NUMBER: ATCC 11454
aattgcctgarattaacaatgccttgattgtctacaaagatgtcaatggcctaaaaacaaaaattactcttgaagttgctttggaacttggtgatggtgcagttcgtacaatcgctatggaatctactgatggcttgactcgtggacttgaagtccttgatacaggtaaagcagtcagcgttcctgttggggaagccactcttggtcgtgtttttaacgttcttggtgatgttattgacggtggggaagaatttgctgctgatgcagaacgtaatcctatccataaaaaagctccaacatttgacgaattgtcaactgcaaacgaagttctcgtaactgggattaaagttgtcgatttgcttgcaccttaccttaaaggtggtaaagttggacttttcggtggtgccggagttggtaaaaccgtccttattcaagaattgattcacaacatcgcccaagaacacggaggtatttctgtgtttaccggtgttggggaacgtactcgtgaagggaatgacctttactgggaaatgaaagaatcaggcgttattgaaaaaactgccatggtctttggtcaaatgaatgaaccaccaggagcacgtatgcgtgttgcccttactggtttgacaattgctgaatatttccgtgatgttcaaggtcaagacgtactgcttttcattgacaacatcttccgtttcacacaagctggttcagaagtttctgcccttttgggacgtatgccttctgccgttggttaccaaccaacacttgctactgaaatggggcaattgcaagaacgtatcacttctactaagaagggttctgtta

SEQ ID NO: 1863 - DNA, 825 bp, Listeria ivanovii
  ref <308>: DATABASE ACCESSION NUMBER: ATCC 19119
cttacctgaaatctacaacgccctagttattgaatataaatctgatgcagaagaagcaccaactagccaacttactttagaagtagccattcaattaggtgatgacgttgttcgtacaattgcaatggcatcaactgatggtgttcaaagaggtatggaagttattgatactgggagcccaatcacagttccagttggtacagtaacacttggtcgtgtatttaacgtattaggaaacactatcgatttggatgagccacttccaagcgatatcaagcgtaataaaattcaccgtgaagcaccaacatttgaccaattagcaacaactactgaaattcttgaaacaggaataaaagttgtagacttgctagccccatatttaaaaggtggtaaaattggtttgttcggcggagcgggtgttggtaaaaccgttttaatccaagaacttattcataatatcgctcaagaacatggtggtatttctgtgttcgctggtgttggagaacgtactcgtgaagggaacgatctttactttgaaatgaaagactctggtgtaattgaaaaaactgccatggtattcggtcaaatgaacgaaccaccaggtgctcgtatgcgtgtagctttaacaggtcttacaatcgctgaatatttccgtgatgaagaacaccaagatgtacttctattcattgataatattttccgctttactcaagctggttcagaggtttcggctttactaggtcgtatgccatctgcagtaggttatcaaccaactctagctaccgaaatgggacaattacaagaacgtattacttctactaatgt

SEQ ID NO: 1864 - DNA, 821 bp, Succinivibrio dextrinosolvens
  ref <308>: DATABASE ACCESSION NUMBER: ATCC 19716
gtcatattccagagctttatgacgctctggaggttaagggcgatggtaagcatcgttcagacctagttcttgaggttcaacagcagattggcggtggtgtggtacgctgcattgccatgggttcttctgacggtttgagcagaggaattgaggctgtaaatactggtgccggtgttaaggttccagttggtcgtgagaccctaggacgtattatgaacgttttaggtcagcctgtagatgagagaggtcctatcggacagaaagaggattgggaaattcaccgtccagctcctacctatgctgagcagtcatcaactacagaaattctagaaaccggtattaaggttatggaccttatctgcccatttgctaagggtggtaaagttggtctgttcggtggtgccggtgtgggtaagacagttaacatgatggagcttatcaataacattgctaaggctcactcaggtctatctgtatttaccggtgttggtgagcgtactcgtgagggtaacgacttctaccacgaaatgcaggaatcaaaggttatcgataaggtatcaatgatttacggtcagatgaacgagcctccagggaaccgtctacgtgttgctctgacaggtctgactgttgctgagaagttccgtgacgaaggtctggatgtgcttctgttcatcgataacatctatcgttatacactggctggtacagaggtatctgctctgttaggccgtatgccttcagctgtgggttaccagcctacactggctgaggaaatgggtgtattacaggagcgtattgcttcaactaagaaaggttctatt

SEQ ID NO: 1865 - DNA, 822 bp, Tetragenococcus halophilus
  ref <308>: DATABASE ACCESSION NUMBER: ATCC 33315
tgatactttaccagatatcaataatgcattagccgtatataaaaatgatgagaacaagacgcgtgttgtattggaagctactttagaacttggagatggggtaattcgtgccatttctatggggtctactgacggcttgcaacgtggcatggaagttgtggatacacaagaacctatttctgttccggtaggaaatgatactttaggtcgtgtatttaatgtgttaggagaaacaatagataatcaggagccatttcctgaagatgctgaaaaaagtggtattcacaaaaaagcccctagttttgatgaattaagtactagttcggaaatattagaaacagggatcaaagtgattgatttattagaaccttatctaagaggcggtaaagtcggattgtttggaggcgccggtgttggaaaaacggtgctaattcaagaattgatcaataatgttgcccaagaacacgggggtatttccgtgtttaatggtgtaggtgaacgtactcgtgaaggtaatgacttgtattatgaaatgcaggattcaggcgttatcgaaaaaacagccatggtgtttggtcaaatgaacgaaccaccaggtgctcgtatgcgtgttgctttaactggcctaacactggcagaatattttcgagatgttgaaggtcaagacgtattattatttattgataatattttccgttttacacaagcaggtaccgaagtttccgctttacttggtagaatgccatctgctgttggctatcaacccacactagcaactgaaatggggcaactgcaagaacggattacgtcaacggataaggg

SEQ ID NO: 1866 - DNA, 818 bp, Campylobacter fetus subsp. fetus
  ref <308>: DATABASE ACCESSION NUMBER: ATCC 25936
atctcctcaggatckataggacttgatatagctcttggtataggcggcgtaccaaaaggaagaatagtcgaaatttatgggccagaaagctctggtaaaacaactcttactttgcatttaatagcagaatctcaaaaagtcggcggagtttgcgcgtttgtagatgcagagcatgcacttgatgttaaatatgctaaaaatttaggcgttgatacggataacttatatatttctcaaccggacttcggagagcaagctcttgatatagtagaaactctagctagaagcggcgccgttgatcttatagtaatagatagcgtagcagctytaacaccaaaaagcgaaatagaaggcgatatgggagatcagcacgtagggctgcaagcaagactcatgagtcaagcacttagaaaattaaccggagttgtccataaaatgggaactacagttgtatttataaaccaaattcgtatgaaaatcggcgctatgggctatggcactcctgaaactactactggcggaaatgcgcttaaattttacgcttcagttagacttgacgtacgtaaaatagctactttaaaacagagcgatgagccaatcggaaaccgcgtaaaagtaaaagtagtaaaaaacaaagtcgctcctccttttagacaagccgaatttgatatcatgtttggagaaggtatcagcaaagaaggagagataatagattacggcgtaaaacttgatattatcgataaaagcggcgcttggtttagctatgataattcaaaattaggtcaaggcagagaaaactcaaaagcgtttttaaaaga

SEQ ID NO: 1867 - DNA, 814 bp, Campylobacter fetus subsp. venerealis
  ref <308>: DATABASE ACCESSION NUMBER: ATCC 33561
tctcctcaggatckataggacttgatatagctcttggtataggcggcgtaccaaaaggaagaatagtcgaaatttatgggccagaaagctctggtaaaacaactcttactttgcatttaatagcagaatctcaaaaagtcggcggagtttgcgcgtttgtagatgcagagcatgcacttgatgttaaatatgctaaaaatttaggcgttgatacggataacttatatatttctcaaccggacttcggagagcaagctcttgatatagtagaaactctagctagaagcggcgccgttgatcttatagtaatagatagcgtagcagctytaacaccaaaaagcgaaatagaaggcgatatgggagatcagcacgtagggctgcaagcaagactcatgagtcaagcacttagaaaattaaccggagttgtccataaaatgggaactacagttgtatttataaaccaaattcgtatgaaaatcggcgctatgggctatggcactcctgaaactactactggcggaaatgcgcttaaattttacgcttcagttagacttgacgtacgtaaaatagctactttaaaacagagcgatgagccaatcggaaaccgcgtaaaagtaaaagtagtaaaaaacaaagtcgctcctccttttagacaagccgaatttgatatcatgtttggagaaggtatcagcaaagaaggagagataatagattacggcgtaaaacttgatattatcgataaaagcggcgcttggtttagctatgataattcaaaattaggtcaaggcagagaaaactcaaaagcgtttttaaa

SEQ ID NO: 1868 - DNA, 824 bp, Campylobacter jejuni subsp. jejuni
  ref <308>: DATABASE ACCESSION NUMBER: ATCC 33560
gatagcataggcwcaggttcagttggacttgatcttgctttaggtataggcggtgttccaaaaggaagaattatagaaatttatgggcctgaaagttcaggtaaaactactctaactctacacattatcgcagaatgccaaaaagcaggtggggtttgtgcttttatcgatgcagaacatgcacttgatgtgaaatatgctaaaaatttaggtgtaaatacagatgatttgtatgtttctcaacctgattttggagagcaagccttagaaattgtagaaactatagcwagaagtggtgcagtagatcttatwgtagtagatagcgttgcagcwcttaccccaaaagcagaaattgaaggcgatatgggcgatcarcatgtaggacttcaagcaagacttatgtctcaagctctaagaaaacttacaggtatagttcataaaatgaataccacagtaattttcatcaaccaaattcgtatgaaaatcggtgctatgggttatggtactcctgaaaccacaacaggtggaaatgcattaaaattttatgcttctgtgcgtttagatgttagaaaagtagcaaccttaaamcaaaacgwagamcctataggaaaccgcgttaaagtaaaagtagttaaaaataaagttgctcctccattcagmcaagctgaatttgatgtgatgtttggagagggtttaagccgtgaaggtgaattgatcgattatggtgtaaaacttgatatcgtagataaaagtggtgcgtggttttcttataaagataaaaaacttggacaaggtagagaaaattcaaaagctttcttaaaaga

SEQ ID NO: 1869 - DNA, 388 bp, Enterococcus avium
  ref <308>: DATABASE ACCESSION NUMBER: ATCC 14025
agaaagttctggtaaaacaacggttgcactgcatgcgattgcagaagttcaaaaacatggcgggacggcagcctttattgatgccgagcacgcgttggaccctcaatacgcacaacgtctaggtgtaaacattgatgaattgctgctatcacaaccagatactggggaacaaggcttagaaattgcagatgctttagtttcaagtggcgcagtcgatattatcgttattgactcggtggccgcgctagtcccccgtgctgaaatcgatggcgagatgggtgatgcgcacgttggtctgcaggctcgtttgatgtcacaagcattgcgcaagctgtcaggctctatcaacaaaacaaagactatcgccgtctttattaaccaaattcgt

SEQ ID NO: 1870 - DNA, 388 bp, Enterococcus faecium
  ref <308>: DATABASE ACCESSION NUMBER: ATCC 19434
tgaaagttcaggtaaaacaacagttgcactacacgctattgcagaagtacaaaaaaatggcggaacggccgctttcattgatgctgagcatgcgttagatccgcaatatgcacaaaaattaggtgtgaatatcgatgaactacttctttcacagcctgacacaggagaacaaggtctagagatcgctgatgctttagtatcaagtggggctgtagatatcgtagtagtcgattcagttgctgctttagttccacgagcagaaatcgacggcgaaatgggtgactcacatgtcgggttacaagcacgtttgatgtctcaagcattgcgtaaactctctggttcgatcaacaaaacaaaaacaatcgctattttcatcaaccaaatccgt

SEQ ID NO: 1871 - DNA, 388 bp, Listeria monocytogenes
  ref <308>: DATABASE ACCESSION NUMBER: ATCC 15313
agagagttccggtaaaacaactgttgcgcttcatgcaattgcggaagtacaagcacaaggcggaacagcagcatttatcgatgctgagcatgcgttggatccggcttatgctaaaaacctaggtgtaaatattgatgaattattactatctcaaccagatacaggagaacaagctttagagattgctgaagctttagttagaagtggtgcagttgatatgttagtaattgactccgttgcagcacttgtaccacgtgctgaaatcgaaggcgagatgggcgatgctcatgttggattacaagcacgtttaatgtcccaagcattgcgtaaactttctggtgttattaataaatcaaaaaccattgctattttcattaaccaaattcgt

SEQ ID NO: 1872 - DNA, 388 bp, Streptococcus mitis
  ref <308>: DATABASE ACCESSION NUMBER: ATCC 49456
agagtcatctggtaagacaacggttgcccttcatgcagttgcgcaagcacaaaaagaaggtggtattgctgcctttatcgatgcggaacatgcccttgatccagcttatgctgcggcccttggtgtcaacattgacgaattgctcttgtcacaaccagactcaggagagcaaggtcttgagattgcaggaaaattgattgactcaggagccgtggatcttgtcgtagtcgactcagttgcggcccttgtccctcgtgcggaaattgatggagatatcggtgatagccacgttggtttgcaggctcgtatgatgagccaggctatgcgtaaacttggtgcttctatcaataaaaccaaaacaattgccatctttatcaaccaattgcgt

SEQ ID NO: 1873 - DNA, 430 bp, Streptococcus oralis
  ref <308>: DATABASE ACCESSION NUMBER: ATCC 35037
gaacatgacgccgactttttcacgcaattggttgataaagatggcaattgttttggttttattgatagaagctccgagtttacgcatggcctggctcatcattcgagcctgcaaaccaacgtgactgtctccaatatccccatcaatttccgcacgaggtacaagggccgcaactgagtcgataacgacaaggtcaactgcacctgagtcaatcaattttccagcaatttcaagaccttgttcacctgagtctggttgtgacaagagcaattcgtcaatattcacaccaagggctgcagcataggctgggtcaagagcatgttccgcatcgataaaggctgcaataccaccttctttctgtgcttgcgcaacagcgtgaagggcaaccgttgtcttaccagatgattctggcgcrtacayttcgatgata

SEQ ID NO: 1874 - DNA, 947 bp, Aspergillus fumigatus
  ref <308>: DATABASE ACCESSION NUMBER: ATCC 64746
ttgtcgttgttgctgcctccgacggtcagatgtaggtggaacatcttgggaaatacgtcgtaaaacacgtcgcttacgttttcgcgaataggccccagactcgtgagcatttgctgctcgcccgccaggttggtgtccagaagatcgttgtcttcgtcaacaaaatcgatgctattgatgatccggagatgctggaactggtcgaactcgagatgcgtgagctgctgaacagctacggtttcgagggtgaagagactccgatcattttcggttccgctctctgtgctctcgaaggacgccgtgacgacatcggtaaagacagaattgagcagcttatgaacgctgtcgacacctggatccccactcctcagcgtgacctcgacaaacctttcttgatgtctgtcgaggaagtgttctctatcgccggccgtggtaccgtggcttctggtcgtgtcgagcgtggtatcttgaagaaggactctgaggttgagattgttggaggctccttcgaacccaagaagaccaaagtcaccgacattgaaaccttcaagaagagctgtgatgaatcgcgtgctggtgacaactctggtctcctcctgcgtggtatccgacgtgaagacgtcaagcgtggtatggtcattgctgttcccggcagcaccaaggctcacgacaagttcctcgtctccatgtacgtcctgaccgaggcggagggtggtcgtcgtactggcttcggtgccaactaccgtccccaagtcttcatccgtactgcaggtaagttcccgcacaccgtgtccagatcttccgagagattagcgatatatgctaatgattcatcagacgaggctgctgacctcagcttccctgacggcgaccaatctcgcagagttatgcctggtgacaacgtcgagatgatcctgaagacccaccaccctgttgctgctgaggct

SEQ ID NO: 1875 - DNA, 923 bp, Aspergillus versicolor
  strain WSA-175
gctgcttccgatggtcaaatgtacgtcaaccttatatacaccctctgatatgacagaatgtcgcctaacagcacgcgtgaactaggccccaaacccgtgagcacttgctgcttgcccgccaggtcggtgtccagaagattgttgtgttcgtcaacaaggttgatgccgtcgatgaccctgagatgttggaacttgttgagctggaaatgcgtgagcttctcagcacttacggcttcgaaggcgaggagacccctatcatcttcggttccgccctatgcgccctcgagggtcgccgccccgatatcggtactgagcgaattgacagccttcttgaggccgttgacacctggatccctacccctcagcgtgacctggacaagcctttcctgatgtctgtcgaggaggtcttctccattgccggtcgtggtaccgttgcctctggccgtgttgagcgtggtctccttaagaaggacagcgaggtcgagattctcggaggtggtcaggtcatgaagaccaaggtcactgacattgagacattcaagaagcactgtgacgaatcccgtgctggtgacaactccggtcttcttctccgtggtatccgccgtgaggatgtcaagcgcggtatggttattgctgctcccgcctctatcaaggcccacaagaagttcatggtctccatgtacgtcctcactgaggcagaaggtggccgtcgcagtggcttcggtgtcaactatcgtccccaggcttacattcgcactgctggtaagttttcaaaacattcgacctctcgccttagaagaagaatacctctaacttgtatttagacgaggcttgcgacctttctttccccgatggcgacatgagccgccgtgtcatgcctggtgacaacgtggaaatgatcctcaacctcaacaaccctgtcg

SEQ ID NO: 1876 - DNA, 807 bp, Basidiobolus ranarum
  ref <308>: DATABASE ACCESSION NUMBER: ATCC 24670
catcattgttgtgtccgccactgatggtcaaatgcctcaaactcgtgagcatttgttgttggctcgccaagttggtgtccaacacttggttgtcttcatcaacaaggttgatgccgttgatgatcctgaaatgttggagttggtcgagatggaaatgcgtgatttgctttcccaatacggtttccccggagacaacgtccccattatccagggttccgctctctgcgctcttgaggaccgcaaccccgagatcggccgtaacgccatcatgaagttgatggaggctgttgatagcagcatccccacccctgcccgtgatttggacaaacctttcctcatgcccgttgaagatgtgttctccatctctggccgtggtactgttgccactggacgtgttgagcgtggtatggtcaccaagggtactgaagttgaaatcgtcggtatgggcgagcacttcaagaccaccttgaccggtattgaaatgttccacaaggaattggacaagggtatggctggtgacaacatgggttgcttgcttcgtggtgtcaagcgtgagcaagtccgtcgtggtatggttatctgtgcccccggatccgtcaagccacataagaagttcatggctcagctctacattctcaccaaggatgagggaggccgccacactcccttcgtcaacaactaccgcccacaaatgttcttcagaactgttgatgttaccgccatccttaagcacccccctggtacccccgatgctgatgagaagatggtcatgcccggagacaacgttcaactcgagtgcgagctctt

SEQ ID NO: 1877 - DNA, 806 bp, Campylobacter gracilis
  ref <308>: DATABASE ACCESSION NUMBER: ATCC 33236
agttgtttctgctgcggatggtcctatgcctcaaactcgcgagcatatcttgctttctcgtcaagtaggcgttccatacatcgtagttttcctaaacaaaaccgatatggtcgatgatccggatcttttagagttagttgaagaggaagttagagatcttttaaaagagtataaattccctggcgacgaaaccccaatcattaagggttctgctcttaaggctcttgaggaagctaaggccggacaagacggcgaatggtctgcaaagattatggagcttatggacgcggttgatagctatattccaactcctgttcgcgatactgataaagatttccttcttccgatcgaagatattttctcgatttccggtcgcggtaccgttgtaaccggtagaatcgaaaaaggtatcgttaaagttggtgatactatcgagatcgtaggtattaaacctactcagactactaccgtcactggcgttgagatgtttagaaaagagatggatcaaggtgaagccggcgataatgtaggtgttttattgcgcggtactaagaaagaggaagtagagcgcggtatggttttatgcaaaccaaaatcgatcactcctcatactaaatttgagggcgaggtttatatcctaactaaagaagaaggcggacgccatactccattctttaataattatagaccgcagttttacgttcgtacgacagatgttaccggttcgattactcttcctgaaggaaccgagatggttatgccgggcgacaacgttaaaatcaccgttgagctaatcgctccgatcg

SEQ ID NO: 1878 - DNA, 806 bp, Campylobacter jejuni subsp. jejuni
  ref <308>: DATABASE ACCESSION NUMBER: ATCC 33292
gctgcagatggccctatgccacaaactagagagcacattcttctttctcgtcaagtaggcgttccatatattgttgtttttatgaataaagcagatatggttgatgatgctgaacttttagagttagttgaaatggaaattagagaattattaagctcttatgatttcccaggcgatgatacacctattatttctggttctgctttaaaagctcttgaagaagctaaagctggacaagatggtgaatggtcagcaaaaattatggatcttatggctgcagttgatagctatattccaactccaactcgtgatactgaaaaagacttcttgatgccaattgaagatgttttctcaatttcaggtcgtggtactgttgttacaggtagaattgaaaaaggtgttgtaaaagtaggtgatactatcgaaatcgttggtattaaagatactcaaacaacaactgtaacaggtgttgaaatgttcagaaaagaaatggatcaaggcgaagcaggagataacgtaggtgttcttcttcgtggtactaaaaaagaagaagttatccgtggtatggttcttgctaaaccaaaatcaattactccacacactgacttcgaagctgaagtttatatcttaaataaagatgaaggtggtagacatactccattctttaacaactatagaccacagttttatgtaagaacaactgatgttacaggttcgattaaattagctgatggtgttgaaatggttatgccaggtgaaaatgtgagaattactgtaagcttgatcgctccagtagcacttgaaga

SEQ ID NO: 1879 - DNA, 896 bp, Coccidioides immitis
  strain WSA-222
atgtatgcaaccgagagcactcccggatcttggtttaaatggcactaatataagacaggcctcaaactcgagagcatttacttctcgcccgtcagatcggtatccaaaaaatcgtcgtcttcgtgaacaaggttgatgccatcgaggacaaagagatgttggagcttgttgaattggagatgcgtgaactcctaaccagctacggtttcsagggtgaagaaactcccatcatttttggctctgctctctgtgccctcsaaggaagacaacccgagatcggtgttaccaagattgatgagctcttgcaggccgtcgacacctggattcccactcctcagcgtgagactgacaagcccttcttgatgtccattgaggaagtgttctctatttccggacgaggaaccgttgtctccggccgtgtggagcgtggtatcctcaagaaggactccgaagttgaaattgtcggcggttcgcccgagccaatcaaaaccaaggttaccgatatcgaaacctttaagaagtcttgcgacgagtctcgcgctggtgataactccggcttgctcctacgaggcgttaagcgtgaagatattagccgtggcatggtcgtcgctgtaccaggaagtgtcaaggcccatactgaattcttagtttcgctttacgtcctcaccgaagctgagggtgggcgcaaatctggattcagcagcaagtaccgcccacagatgttcattcgcactgccggtatgtaatactgtgataatttcgttgacatggtactgattgaattctatagacgaagcggctcagctcagctggcccggagaagatcaagacaagatggctatgccaggagacaatatcgaaatgatttgcaccaccttgcacccagttgccgccga

SEQ ID NO: 1880 - DNA, 798 bp, Erwinia amylovora
  ref <308>: DATABASE ACCESSION NUMBER: ATCC 14976
ctggtagttgctgcgactgacggcccaatgcctcagacycgtgagcacatcctgctgggtcgccaggttggcgtgccatacatcatcgtgttcctgaacaaatgtgacatggttgatgatgaagagctgctggagctggttgaaatggaagtmcgtgacctgctgtcacagtacgacttcccaggcgacgacacgccaatcgtgcryggttctgcgctgaaagcgctggarggcgaagcagagtgggaagcgaagatcatcgaactggctggccatctggataactacatcccggaaccagagcgtgcgattgacaaaccgttcctgctgccaattgaagacgtgttctccatctctggccgtggtaccgttgttaccggtcgtgtagagcgcggtrtsgttaaagtgggtgaagaagttgaaatcgttggtatcaaagataccgtgaaatcaacctgtaccggcgttgagatgttccgtaagctgctggacgaaggccgtgcgggtgagaactgtggtatcctgctgcgcggtatcaagcgcgaagatatccagcgtggtcaggttctggcgaagccaggcaccatcaagccacacaccaagttcgagtcagaagtttatattctgtctaaagacgaaggcggccgtcatactccgttcttcaaaggctaccgtccacagttctacttccgtactactgacgtgaccgggactatcgaactgccagaaggcgttgagatggtgatgccaggcgacaacattcagatggttgtgaccctgatccacccgatcgccatg

SEQ ID NO: 1881 - DNA, 810 bp, Salmonella choleraesuis subsp. choleraesuis
  ref <308>: DATABASE ACCESSION NUMBER: ATCC 14028
atcctggttgttgctgcgactgacggyccgatgccgcagacccgtgagcacatcctgctgggtcgtcaggtaggcgttccgtacatcatcgtgttcctgaacaaatgcgacatggttgatgacgaagagctgctggaactggttgaaatggaagttcgygaactgctgtctcagtacgacttcccgggcgacgacactccgatcgttcgtggttctgctctgaaagcgctggaaggcgacgcagagtgggaagcgaaaatcatcgaactggctggcttcctggattcttacatyccggaaccagagcgtgcgattgacaagccgttcctgctgccgatcgaagacgtattctccatctccggtcgtggtaccgttgttaccggtcgtgtagarcgcggtatcatcaaagtgggcgaagaagttgaaatcgttggtatcaaagagactcagaagtctacctgtactggcgttgaaatgttccgcaaactgctggacgaaggccgtgccggtgagaacgtaggtgttctgctgcgtggtatcaaacgtgaagaaatcgaacgtggtcaggtactggctaagccgggcaccatcaagccgcacaccaagttcgaatctgaagtgtacattctgtccaaagatgaaggcggccgtcatactccgttcttcaaaggctaccgtccgcagttctacttccgtactactgacgtgactggcaccatcgaactgccggaaggcgtagagatggtaatgccgggcgacaacatcaaaatggttgttaccctgatccacccgatcgcgatggacgacggt

SEQ ID NO: 1882 - DNA, 888 bp, Staphylococcus cohnii
  strain BM10711
atgaatttttatttagaggagtttaacttgtctattcccgattcaggtccatacggtataacttcatcagaagacggaaaggtatggttcacacaacataaggcaaacaaaatcagcagtctagatcagagtggtaggataaaagaattcgaagttcctacccctgatgctaaagtgatgtgtttaattgtatcttcacttggagacatatggtttacagagaatggtgcaaataaaatcggaaagctctcaaaaaaaggtggctttacagaatatccattgccacagccggattctggtccttacggaataacggaaggtctaaatggcgatatatggtttacccaattgaatggagatcgtataggaaagttgacagctgatgggactatttatgaatatgatttgccaaataagggatcttatcctgcttttattactttaggttcggataacgcactttggttcacggagaaccaaaataattctattggaaggattacaaatacagggaaattagaagaatatcctctaccaacaaatgcagcggctccagtgggtatcactagtggtaacgatggtgcactctggtttgtcgaaattatgggcaacaaaataggtcgaatcactacaactggtgagattagcgaatatgatattccaactccaaacgcacgtccacacgctataaccgcggggaaaaatagcgaaatatggtttactgaatggggggcaaatcaaatcggcagaattacaaacgacaaaacaattcaagaatatcaacttcaaacagaaaatgcggaacctcatggtattacctttggaaaagatggatccgtatggtttgcattaaaatgtaaaattgggaagctgaatttgaacgaatga

SEQ ID NO: 1883 - DNA, 23 bp, Artificial Sequence
  Synthetic DNA Sequence
agccgcttgagcaaattaaacta

SEQ ID NO: 1884 - DNA, 23 bp, Artificial Sequence
  Synthetic DNA Sequence
gtatcccgcagataaatcaccac

SEQ ID NO: 1885 - DNA, 21 bp, Artificial Sequence
  Synthetic DNA Sequence
agcgaaaaacaccttgccgac

SEQ ID NO: 1886 - DNA, 18 bp, Artificial Sequence
  Synthetic DNA Sequence
gacgcccgcgccaccact

SEQ ID NO: 1887 - DNA, 19 bp, Artificial Sequence
  Synthetic DNA Sequence
gacgcccgcgacaccacta

SEQ ID NO: 1888 - DNA, 19 bp, Artificial Sequence
  Synthetic DNA Sequence
gacgcccgcaacaccacta

SEQ ID NO: 1889 - DNA, 20 bp, Artificial Sequence
  Synthetic DNA Sequence
gttcgcaactgcagctgctg

SEQ ID NO: 1890 - DNA, 19 bp, Artificial Sequence
  Synthetic DNA Sequence
ttcgcaacggcagctgctg

SEQ ID NO: 1891 - DNA, 18 bp, Artificial Sequence
  Synthetic DNA Sequence
  modified_base (14): i
ccggagctgccgancggg

SEQ ID NO: 1892 - DNA, 18 bp, Artificial Sequence
  Synthetic DNA Sequence
cggagctgccaarcgggg

SEQ ID NO: 1893 - DNA, 18 bp, Artificial Sequence
  Synthetic DNA Sequence
ggagctggcgarcggggt

SEQ ID NO: 1894 - DNA, 18 bp, Artificial Sequence
  Synthetic DNA Sequence
gaccggagctagcgarcg

SEQ ID NO: 1895 - DNA, 19 bp, Artificial Sequence
  Synthetic DNA Sequence
cggagctagcaarcggggt

SEQ ID NO: 1896 - DNA, 21 bp, Artificial Sequence
  Synthetic DNA Sequence
gaaacggaactgaatgaggcg

SEQ ID NO: 1897 - DNA, 21 bp, Artificial Sequence
  Synthetic DNA Sequence
cattaccatgggcgataacag

SEQ ID NO: 1898 - DNA, 22 bp, Artificial Sequence
  Synthetic DNA Sequence
ccattaccatgagcgataacag

SEQ ID NO: 1899 - DNA, 861 bp, Klebsiella pneumoniae
  strain 15571
atgcgttatattcgcctgtgtattatctccctgttagccaccctgccgctggcggtacacgccagcccgcagccgcttgagcaaattaaactaagcgaaagccagctgtcgggccgcgtaggcatgatagaaatggatctggccagcggccgcacgctgaccgcctggcgcgccgatgaacgctttcccatgatgagcacctttaaagtagtgctctgcggcgcagtgctggcgcgggtggatgccggtgacgaacagctggagcgaaagatccactatcgccagcaggatctggtggactactcgccggtcagcgaaaaacaccttgccgacggcatgacggtcggcgaactctgcgccgccgccattaccatgagcgataacagcgccgccaatctgctactggccaccgtcggcggccccgcaggattgactgcctttttgcgccagatcggcgacaacgtcacccgccttgaccgctgggaaacggaactgaatgaggcgcttcccggcgacgcccgcgacaccactaccccggccagcatggccgcgaccctgcgcaagctgctgaccagccagcgtctgagcgcccgttcgcaacggcagctgctgcagtggatggtggacgatcgggtcgccggaccgttgatccgctccgtgctgccggcgggctggtttatcgccgataagaccggagctggcgagcggggtgcgcgcgggattgtcgccctgcttggcccgaataacaaagcagagcgcattgtggtgatttatctgcgggataccccggcgagcatggccgagcgaaatcagcaaatcgccgggatcggcgcggcgctgatcgagcactggcaacgctaa

SEQ ID NO: 1900 - DNA, 780 bp, Klebsiella pneumoniae
  strain SLK-47
ctgttagccaccctgccgctggcggtacacgccagcccgcagccgcttgagcaaattaaactaagcgaaagccagctgtcgggccgcgtaggcatgatagaaatggatctggccagcggccgcacgctgaccgcctggcgcgccgatgaacgctttcccatgatgagcacctttaaagtagtgctctgcggcgcagtgctggcgcgggtggatgccggtgacgaacagctggagcgaaagatccactatcgccagcaggatctggtggactactcgccggtcagcgaaaaacaccttgccgacggcatgacggtcggcgaactctgcgccgccgccattaccatgagcgataacagcgccgccaatctgctactggccaccgtcggcggccccgcaggattgactgcctttttgcgccagatcggcgacaacgtcacccgccttgaccgctgggaaacggaactgaatgaggcgcttcccggcgacgcccgcgccaccactaccccggccagcatggccgcgaccctgcgcaagctgctgaccagccagcgtctgagcgcccgttcgcaacggcagctgctgcagtggatggtggacgatcgggtcgccggaccgttgatccgctccgtgctgccggcgggctggtttatcgccgataagaccggagctggcgagcggggtgcgcgcgggattgtcgccctgcttggcccgaataacaaagcagagcgcattgtggtgatttatctgcgggataccccggcgagcatggccgagcgaaat

SEQ ID NO: 1901 - DNA, 861 bp, Escherichia coli
atgcgttatattcgcctgtgtattatctccctgttagccaccctgccgctggcggtacacgccagcccgcagccgcttgagcaaattaaactaagcgaaagccagctgtcgggccgcgtaggcatgatagaaatggatctggccagcggccgcacgctgaccgcctggcgcgccgatgaacgctttcccatgatgagcacctttaaagtagtgctctgcggcgcagtgctggcgcgggtggatgccggtgacgaacagctggagcgaaagatccactatcgccagcaggatctggtggactactcgccggtcagcgaaaaacaccttgccgacggcatgacggtcggcgaactctgcgccgccgccattaccatgagcgataacagcgccgccaatctgctactggccaccgtcggcggccccgcaggattgactgcctttttgcgccagatcggcgacaacgtcacccgccttgaccgctgggaaacggaactgaatgaggcgcttcccggcgacgcccgcaacaccactaccccggccagcatggccgcgaccctgcgcaagctgctgaccagccagcgtctgagcgcccgttcgcaacggcagctgctgcagtggatggtggacgatcgggtcgccggaccgttgatccgctccgtgctgccggcgggctggtttatcgccgataagaccggagctggcgagcggggtgcgcgcgggattgtcgccctgcttggcccgaataacaaagcagagcgcattgtggtgatttatctgcgggataccccggcgagcatggccgagcgaaatcagcaaatcgccgggatcggcgcggcgctgatcgagcactggcaacgctaa

SEQ ID NO: 1902 - DNA, 861 bp, Klebsiella pneumoniae
  strain 803
atgcgttatattcgcctgtgtattatctccctgttagccaccctgccgctggcggtacacgccagcccgcagccgcttgagcaaattaaacaaagcgaaagccagctgtcgggccgcgtaggcatgatagaaatggatctggccagcggccgcacgctgaccgcctggcgcgccgatgaacgctttcccatgatgagcacctttaaagtagtgctctgcggcgcagtgctggcgcgggtggatgccggtgacgaacagctggagcgaaagatccactatcgccagcaggatctggtggactactcgccggtcagcgaaaaacaccttgccgacggcatgacggtcggcgaactctgcgccgccgccattaccatgagcgataacagcgccgccaatctgctgctggccaccgtcggcggccccgcaggattgactgcctttttgcgccagatcggcgacaacgtcacccgccttgaccgctgggaaacggaactgaatgaggcgcttcccggcgacgcccgcgacaccactaccccggccagcatggccgcgaccctgcgcaagctgctgaccagccagcgtctgagcgcccgttcgcaacggcagctgctgcagtggatggtggacgatcgggtcgccggaccgttgatccgctccgtgctgccggcgggctggtttatcgccgataagaccggagctgccgagcggggtgcgcgcgggattgtcgccctgcttggcccgaataacaaagcagagcgcattgtggtgatttatctgcgggatacgccggcgagcatggccgagcgaaatcagcaaatcgccgggatcggcgcggcgctgatcgagcactggcaacgctaa

SEQ ID NO: 1903 - DNA, 896 bp, Klebsiella pneumoniae
  ref <308>: DATABASE ACCESSION NUMBER: ATCC 700603
atgcgttattttcgcctgtgtattatctccctgttagccaccctgccgctggcggtacacgccagcccgcagccgcttgagcaaattaaactaagcgaaagccagctgtcgggcagcgtaggcatgatagaaatggatctggccagcggccgcacgctgaccgcctggcgcgccgatgaacgctttcccatgatgagcacctttaaagtagtgctctgcggcgcagtgctggcgcgggtggatgccggtgacgaacagctggagcgaaagatccactatcgccagcaggatctggtggactactcgccggtcagcgaaaaacaccttgccgacggcatgacggtcggcgaactctgtgccgccgccattaccatgagcgataacagcgccgccaatctgctgctggccaccgtcggcggccccgcaggattgactgcctttttgcgccagatcggcgacaacgtcacccgccttgaccgctgggaaacggaactgaatgaggcgcttcccggcgacgcccgcgacaccactaccccggccagcatggccgcgaccctgcgcaagctgctgaccagccagcgtctgagcgcccgttcgcaacggcagctgctgcagtggatggtggacgatcgggtcgccggaccgttgatccgctccgtgctgccggcgggctggtttatcgccgataagaccggagctgccaaacggggtgcgcgcgggattgtcgccctgcttggcccgaataacaaagcagagcggattgtggtgatttatctgcgggatacgccggcgagcatggccgagcgaaatcagcaaatcgccgggatcggcgcggcgctgatcgagcactggcaacgctaacccggcggtggccgcgcgcgttatccggctcgtag

SEQ ID NO: 1904 - DNA, 861 bp, Escherichia coli
  strain JC2926
atgcgttatattcgcctgtgtattatctccctgttagccaccctgccgctggcggtacacgccagcccgcagccgcttgagcaaattaaactaagcgaaagccagctgtcgggccgcgtaggcatgatagaaatggatctggccagcggccgcacgctgaccgcctggcgcgccgatgaacgctttcccatgatgagcacctttaaagtagtgctctgcggcgcagtgctggcgcgggtggatgccggtgacgaacagctggagcgaaagatccactatcgccagcaggatctggtggactactcgccggtcagcgaaaaacaccttgccgacggcatgacggtcggcgaactctgcgccgccgccattaccatgagcgataacagcgccgccaatctgctactggccaccgtcggcggccccgcaggattgactgcctttttgcgccagatcggcgacaacgtcacccgccttgaccgctgggaaacggaactgaatgaggcgcttcccggcgacgcccgcgacaccactaccccggccagcatggccgcgaccctgcgcaagctgctgaccagccagcgtctgagcgcccgttcgcaacggcagctgctgcagtggatggtggacgatcgggtcgccggaccgttgatccgctccgtgctgccggcgggctggtttatcgccgataagaccggagctagcgagcggggtgcgcgcgggattgtcgccctgcttggcccgaataacaaagcagagcgcattgtggtgatttatctgcgggataccccggcgagcatggccgagcgaaatcagcaaatcgccgggatcggcgcggcgctgatcgagcactggcaacgctaa

SEQ ID NO: 1905 - DNA, 861 bp, Pseudomonas aeruginosa
atgcgttatattcgcctgtgtattatctccctgttagccaccctgccgctggcggtacacgccagcccgcagccgcttgagcaaattaaactaagcgaaagccagctgtcgggccgcgtaggcatgatagaaatggatctggccagcggccgcacgctgaccgcctggcgcgccgatgaacgctttcccatgatgagcacctttaaagtagtgctctgcggcgcagtgctggcgcgggtggatgccggtgacgaacagctggagcgaaagatccactatcgccagcaggatctggtggactactcgccggtcagcgaaaaacaccttgccgacggcatgacggtcggcgaactctgcgccgccgccattaccatgagcgataacagcgccgccaatctactactggccaccgtcggcggccccgcaggattgactgcctttttgcgccagatcggcgacaacgtcacccgccttgaccgctgggaaacggaactgaatgaggcgcttcccggcgacgcccgcgacaccactaccccggccagcatggccgcgaccctgcgcaagctgctgaccagccagcgtctgagcgcccgttcgcaacggcagctgctgcagtggatggtggacgatcgggtcgccggaccgttgatccgctccgtgctgccggcgggctggtttatcgccgataagaccggagctagcaaacggggtgcgcgcgggattgtcgccctgcttggcccgaataacaaagcagagcgcattgtggtgatttatctgcgggatacgccggcgagcatggccgagcgaaatcagcaaatcgccgggatcggcgcggcgctgatcgagcactggcaacgctaa

SEQ ID NO: 1906 - DNA, 20 bp, Artificial Sequence
  Synthetic DNA Sequence
ccttattcccttttttgcgg

SEQ ID NO: 1907 - DNA, 22 bp, Artificial Sequence
  Synthetic DNA Sequence
cacctatctcagcgatctgtct

SEQ ID NO: 1908 - DNA, 23 bp, Artificial Sequence
  Synthetic DNA Sequence
aacagcggtaagatccttgagag

SEQ ID NO: 1909 - DNA, 22 bp, Artificial Sequence
  Synthetic DNA Sequence
atgacttggttaagtactcacc

SEQ ID NO: 1910 - DNA, 22 bp, Artificial Sequence
  Synthetic DNA Sequence
atgacttggttgagtactcacc

SEQ ID NO: 1911 - DNA, 22 bp, Artificial Sequence
  Synthetic DNA Sequence
ccataaccatgggtgataacac

SEQ ID NO: 1912 - DNA, 22 bp, Artificial Sequence
  Synthetic DNA Sequence
ccataaccatgagtgataacac

SEQ ID NO: 1913 - DNA, 20 bp, Artificial Sequence
  Synthetic DNA Sequence
cgccttgatcattgggaacc

SEQ ID NO: 1914 - DNA, 20 bp, Artificial Sequence
  Synthetic DNA Sequence
cgccttgatcgttgggaacc

SEQ ID NO: 1915 - DNA, 20 bp, Artificial Sequence
  Synthetic DNA Sequence
cgccttgatagttgggaacc

SEQ ID NO: 1916 - DNA, 20 bp, Artificial Sequence
  Synthetic DNA Sequence
cgtgggtcttgcggtatcat

SEQ ID NO: 1917 - DNA, 20 bp, Artificial Sequence
  Synthetic DNA Sequence
cgtgggtctggcggtatcat

SEQ ID NO: 1918 - DNA, 21 bp, Artificial Sequence
  Synthetic DNA Sequence
gtgggtctcacggtatcattg

SEQ ID NO: 1919 - DNA, 21 bp, Artificial Sequence
  Synthetic DNA Sequence
cgtgggtctctcggtatcatt

SEQ ID NO: 1920 - DNA, 20 bp, Artificial Sequence
  Synthetic DNA Sequence
  misc_feature (1)...(20): n=a,t,c or g
cgtggntctcgcggtatcat

SEQ ID NO: 1921 - DNA, 21 bp, Artificial Sequence
  Synthetic DNA Sequence
cgtgggtctagcggtatcatt

SEQ ID NO: 1922 - DNA, 24 bp, Artificial Sequence
  Synthetic DNA Sequence
gttttccaatgattagcactttta

SEQ ID NO: 1923 - DNA, 24 bp, Artificial Sequence
  Synthetic DNA Sequence
gttttccaatgataagcactttta

SEQ ID NO: 1924 - DNA, 23 bp, Artificial Sequence
  Synthetic DNA Sequence
gttttccaatgctgagcactttt

SEQ ID NO: 1925 - DNA, 23 bp, Artificial Sequence
  Synthetic DNA Sequence
cgttttccaatgatgagcacttt

SEQ ID NO: 1926 - DNA, 23 bp, Artificial Sequence
  Synthetic DNA Sequence
gttttccaatggtgagcactttt

SEQ ID NO: 1927 - DNA, 861 bp, Neisseria meningitidis
  strain MC9690-129
atgagtattcaacattttcgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggtgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgctgccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaa

SEQ ID NO: 1928 - DNA, 861 bp, Escherichia coli 220>
  strain HB251
atgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttaagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcattgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaa

SEQ ID NO: 1929 - DNA, 808 bp, Klebsiella oxytoca
  strain 26W
atgagtattcaacatttccgtgtcgcccttattcccttttttgcggcattttgccttcctgtttttgctcacccagaaacgctggtgaaagtaaaagatgctgaagatcagttgggtgcacgagtgggttacatcgagctggatctcaacagcggtaagatccttgagagttttcgccccgaagaacgttttccaatgatgagcacttttaaagttctgctatgtggtgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaacccgccttgatagttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtaagcgtggatctcgcggtatcattgcagcactggggccagatggtaagccctcccgtatcgtagttatctacacgacggggagtcaggcaactatggatg

SEQ ID NO: 1930 - DNA, 861 bp, Escherichia coli
atgagtattcaacattttcgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgctgccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctggcggtatcattgcagcactggggccagatggtaagccctcccgtatcgtagttatctacacgacggggagtcaggcaactatggatgaacgaaatagacagatcgctgagataggtgcctcactgattaagcattggtaa

SEQ ID NO: 1931 - DNA, 861 bp, Escherichia coli
  strain BM2728
atgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctctcggtatcattgcagcactggggccagatggtaagccctcccgtatcgtagttatctacacgacggggagtcaggcaactatggatgaacgaaatagacagatcgctgagataggtgcctcactgattaagcattggtaa

SEQ ID NO: 1932 - DNA, 861 bp, Escherichia coli
atgagtattcaacattttcgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgctgagcacttttaaagttctgctatgtggtgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgctgccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctagcggtatcattgcagcactggggccagatggtaagccctcccgtatcgtagttatctacacgacggggagtcaggcaactatggatgaacgaaatagacagatcgctgagataggtgcctcactgattaagcattggtaa

SEQ ID NO: 1933 - DNA, 861 bp, Escherichia coli
atgagtattcaacatttccgtgtcgcccttattcccttttttgcggcattttgccttcctgtttttgctcacccagaaacgctggtgaaagtaaaagatgctgaagatcagttgggtgcacgagtgggttacatcgagctggatctcaacagcggtaagatccttgagagttttcgccccgaagaacgttttccaatggtgagcacttttaaagttctgctatgtggtgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaacccgccttgatcgtcgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggatctcgcggtatcattgcagcactggggccagatggtaagccctcccgtatcgtagttatctacacgacggggagtcaggcaactatggatgaacgagatagacagatcgctgagataggtgcctcactgattaagcattggtaa

SEQ ID NO: 1934 - DNA, 25 bp, Artificial Sequence
  Synthetic DNA Sequence
gaacgccagcgcgaaattcaaaaag

SEQ ID NO: 1935 - DNA, 21 bp, Artificial Sequence
  Synthetic DNA Sequence
agctcggcatacttcgacagg

SEQ ID NO: 1936 - DNA, 15 bp, Artificial Sequence
  Synthetic DNA Sequence
taccacccgcacggc

SEQ ID NO: 1937 - DNA, 17 bp, Artificial Sequence
  Synthetic DNA Sequence
cggagtcgccgtcgatg

SEQ ID NO: 1938 - DNA, 41 bp, Artificial Sequence
  Synthetic DNA Sequence
ccgcgcaccattgcttcgtacactgaggagtctccgcgcgg

SEQ ID NO: 1939 - DNA, 46 bp, Artificial Sequence
  Synthetic DNA Sequence
cgacccggatggtagtatcgataatgatccgccagcggccgggtcg

SEQ ID NO: 1940 - DNA, 19 bp, Artificial Sequence
  Synthetic DNA Sequence
gtatcgttggtgacgtaat

SEQ ID NO: 1941 - DNA, 18 bp, Artificial Sequence
  Synthetic DNA Sequence
gcaatggtccgtttaagt

SEQ ID NO: 1942 - DNA, 27 bp, Artificial Sequence
  Synthetic DNA Sequence
gactggaacaaagcctataaaaaatca

SEQ ID NO: 1943 - DNA, 16 bp, Artificial Sequence
  Synthetic DNA Sequence
gctggtggacggccag

SEQ ID NO: 1944 - DNA, 19 bp, Artificial Sequence
  Synthetic DNA Sequence
tttcgccgccatgcgttac

SEQ ID NO: 1945 - DNA, 17 bp, Artificial Sequence
  Synthetic DNA Sequence
cggcgactacgcggtat

SEQ ID NO: 1946 - DNA, 17 bp, Artificial Sequence
  Synthetic DNA Sequence
cggcgacttcgcggtat

SEQ ID NO: 1947 - DNA, 19 bp, Artificial Sequence
  Synthetic DNA Sequence
cggtatacggcaccatcgt

SEQ ID NO: 1948 - DNA, 19 bp, Artificial Sequence
  Synthetic DNA Sequence
gcggtatacaacaccatcg

SEQ ID NO: 1949 - DNA, 19 bp, Artificial Sequence
  Synthetic DNA Sequence
cggtatacgccaccatcgt

SEQ ID NO: 1950 - DNA, 15 bp, Artificial Sequence
  Synthetic DNA Sequence
ggcgacatcgcctgc

SEQ ID NO: 1951 - DNA, 17 bp, Artificial Sequence
  Synthetic DNA Sequence
ggcgacagagcctgcta

SEQ ID NO: 1952 - DNA, 19 bp, Artificial Sequence
  Synthetic DNA Sequence
cctgctatggagcgatggt

SEQ ID NO: 1953 - DNA, 21 bp, Artificial Sequence
  Synthetic DNA Sequence
cgcctgctataaagcgatggt

SEQ ID NO: 1954 - DNA, 589 bp, Klebsiella pneumoniae subsp. pneumoniae
  ref <308>: DATABASE ACCESSION NUMBER: ATCC 13883
acaccggtcaacattgaggaagagcttaagaactcttatctggattatgcgatgtcggtcattgttggccgtgcgctgccggatgtccgagatggcctgaagccggtacaccgtcgcgtactttacgccatgaacgtattgggcaatgactggaacaaagcctataaaaaatcagcccgtgtcgttggtgacgtaatcggtaaataccacccgcacggcgactccgcggtatacgacaccatcgtgcgtatggcgcagccgttctcgctgcgttacatgctggtggacggccagggtaactttggttccatcgacggcgactccgccgcggcgatgcgttataccgaaattcgtctggcgaaaatcgctcatgagctgatggccgatcttgaaaaagagacggtcgatttcgtcgacaactatgacggtacggagcgtattccggacgtcatgccgaccaaaattcctaacctgctggtgaacggcgcctccgggatcgccgtagggatggccaccaacataccgccacataacctgacggaagtgattaacggctgtctggcgtatgttgacgatgaagacatcagca

SEQ ID NO: 1955 - DNA, 38 bp, Artificial Sequence
  Synthetic DNA Sequence
cgcgcaaccattgcttcgtacactgaggagtctgcgcg

SEQ ID NO: 1956 - DNA, 989 bp, Candida inconspicua
  ref <308>: DATABASE ACCESSION NUMBER: ATCC 16783
cggtaaaaccactttaactgctgcaatcaccaaagttttatctgaagaaggtggtgcagatttcttagattattcatctattgataaagcaccagaagagagagctagaggtattaccatttctactgctcatgttgaatatgaaactccaaacagacattattcacatgttgattgtccaggtcatcaagattatattaagaacatgattactggtgcagctcaaatggatggtgctattattgttgttgcagctactgatggtcaaatgccacaaactaaggaacatttattattagctagacaagttggtgttcaacatttagttgtttttgttaacaagtgtgataccgttgatgatccagaaatgttrgaattagttgaaatggaaatgagagaattattgaccgaatatggattygatggtgataacacaccagttattatgggttctgcattaatggcattagaaggtaagagaccagaagttggtaaagaatctattgttaagttaatggaagctgttgatacttggattccaactccacaaagagacttagaaaaaccattcttattaccaattgatgaagttttctctatttctggtagaggtactgttgtttctggtactgttgatagaggtacattaaagaagggtgaagaagttgaaattgttggtggtaaagaaggtgttattaagactactgttaccggtattgaaatgtatcacaaggaattagatcaagcacaagctggtgatactccaggtattttgttaagaggtgttaagagagatcaaattgcaagaggtcaaattcttgcaaagccaggwtctgttaaggcatacaagaagttcttatcatcattatacattttaacaaaggaagaaggtggtagacatactccattttctgaaaattacagacctcaaatgtacattagaacttccaatgttaatgttactttgaagttcccagaaactgaagaag

SEQ ID NO: 1957 - DNA, 991 bp, Candida utilis
  ref <308>: DATABASE ACCESSION NUMBER: ATCC 22023
ggtaagaccacccttactgccgccatcaccaagtgccttgctgagaagggaggtgcctcgttcttggactacagtgccatcgacaaggcgccagaggagagagcaagaggtatcaccatctccactgcgcacgttgagtatgaaactgccaacagacactactcgcacgttgactgtccaggtcacgctgattacatcaagaacatgattaccggtgctgcgcagatggacggtgctatcattgtcgttgcagccactgacggtcagatgccacagaccagagaacacttgttgcttgccagacaagttggtgtccagcacattgttgtcttcgtcaacaaggttgacaccatcgacgaccctgagatgcttgagcttgttgaaatggagatgagagagttgcttacttcgtatggatttgacggtgataacaccccagttatcatgggttctgctttgtgtgctttggaaggccgtgagccagagattggtgctaaggccattgacaagttgatggaggccattgatgagtacatcccaactcctcagagagacctggaaaagccattcytgatgggtgttgaagacgtgttctcgatctctggtagaggtaccgttgtcacrggccgtgttgagcgtggtaacttgaagaaaggtgatgaaattgaacttgttggctacaacaagaacccaatcaagaccaccgtcaccggtatcgaaatgttcaagaaggagttggaatctgccatggctggtgacaactgtggtatcttgttgcgtggtatcaagagagatgacgtcaagagaggtatggttgctgctaagccaggctccgtctctgcacacaccaagttcctcgcttccttgtacatcctgacraaggaggaaggtggtcgtcacagtgcctttgctgagaactacagaccacagatgttcatcagaaccggagatgtcaccaccatcttgacatggccagaggagcacgctgacc

SEQ ID NO: 1958 - DNA, 985 bp, Candida zeylanoides
  ref <308>: DATABASE ACCESSION NUMBER: ATCC 7351
cggtaagaccactttgaccgccgccatcaccaaggtgttgagcgccaaaggtggtgcttccttcttggactacgggtccatcgacagagcccctgaggagagagccagaggtattactatctcgactgcccacgttgagtacgagaccgataagagacactacgcccacgttgattgccctggtcacgctgattacatcaagaacatgatcactggtgccgcccaaatggacggtgccattattgtcgttgctgcttctgatggccaaatgccgcagaccagagagcacttgttgcttgccagacaggttggtgtgcagaacttggttgtgtttgttaacaaggtggacaccatcgacgaccccgaaatgttggagttggtggagatggaaatgagagaattgttgacccactacggctttgacggtgacaacacccctgtcatcatgggttcggcgttgtgtgccttggaagacaggcagcctgagattggcgagcaagccatcatgaagttgttggacgctgtcgacgagtacattcccactcctcagagagacttggagcaaccatttttgatgcccgttgaggatgttttctccatctctggcagaggtactgttgtcaccggtcgtgttgagagaggctcattgaagaagggtgaggagattgagattgttggcgacttccccaagcccttcaagactaccgtcaccggcattgagatgttcaagaaggagttggatgccgcgatggcgggcgacaacgccgggatcttgttgagaggtgtcaagagagacgaggtctcgagaggtatggttttggccaagcccggtactgtcacttcgcacaccaaggtgttggcgtcgctttacatcttgaccaaagaggaaggtggccgccactcgccctttggtgagaactacaagccacagttattcatcagaacctccgatgtcactggtactttgaggttccccgccggtgag

SEQ ID NO: 1959 - DNA, 973 bp, Candida catenulata
  ref <308>: DATABASE ACCESSION NUMBER: ATCC 10565
cggtaagaccaccttgactgccgccatcaccaaggttctctccgagaagggtggtgccgacttcttggactacggtgccattgacagagcccccgaggagcgtgcccgtggtatcaccatctccactgcccacgttgagtacgagactgacaaccgtcactacgcccacattgactgtcccggtcacgctgattacatcaagaacatgattaccggtgccgcccagatggacggtgccattattgtccttgctgctactgacggtgccatgccccagacccgcgagcacttgcttctcgcccgtcaggttggtatccaggaattggttgtgtttgtgaacaaggttgacaccatcgacgaccccgagatgttggagctcgttgagatggagatccgcgagttgttgtctgagttcggttttgacggtgacaacacccccgtcatcatgggttccgctttgtgcgctttggagggcaagcagcccgagattggtgagcaggctatcaccaagttgatggccgccgttgacgagcacatccccaccccccagcgtgacttggagcagcctttcttgatgcctgttgagggtgttttctctatctctggccgtggtaccgtggtgactggtaaggttgcccgtggtgtcctcaagaagggtgaggagattgagattgttggcaactttgacaagccctacaaggtgactgttactggtattgagatgttcaagaaggagttggaccaggccatggctggtgacaacgccggtatcttgttgcgtggtgtcaagcgtgacgaggtgtctcgtggtatggttttggccaagcccggcactgttgtctcgcacaagaaggttttggcttcgctttacatcttgacccaggaggagggtggccgtaagaccggcttcggctccaactacaagccccagttgttcttgcgcactaccgacgtcactggtaccctcaccttc

SEQ ID NO: 1960 - DNA, 985 bp, Candida krusei
  ref <308>: DATABASE ACCESSION NUMBER: ATCC 28870
aagactaccttgactgctgcaatcaccaaggtcttagctgatcaaggtggtgctgatttcttagattatgcatctattgacaaggctcctgaagaaagagcaagaggtattactatctctactgctcacgttgagtatgaaaccccaaacagacattattctcatgtcgattgtcctggccatcaagattatattaagaatatgattactggtgctgcacaaatggatggtgctattattgttgttgctgctactgatggtcaaatgccacaaactaaggaacatttattattagcaagacaagttggtgttcaacatttagttgtctttgttaataaatgtgacaccattgatgacccagaaatgttggaattagttgaaatggaaatgagagaactattgtctgaatatggttttgatggtgataacactccagttattatgggttctgcattgatggctttagaagacaagagacctgaagttggtaaggaatctattttaaagttaatggaagcygttgacacatggattccaaccccagagagagatttagaaaaaccatttttgttacctattgatgaagttttctcaatctctggtagaggtactgtcgtttctggtactgtcgaaagaggtactttgaagaagggtgaagaagttgaaattgttggtggtaaggatggttctattaaaactactgtcacaggtattgaaatgtatcacaaggaattagaccaagcgcaagcaggtgatactccaggtattttattaagaggtgtcaagagagaccaaatcaagagaggtcaaattttagcaaagccagattccgttaaggcatacaagaagttcttggcttccctttatatcttaaccaaggaagaaggtggtagacatacaccattctctgaaaactacagaccacaaatgtacatcagaactaccaatgttaacgttactttgaagttcccagacactgaagaag

SEQ ID NO: 1961 - DNA, 22 bp, Artificial Sequence
  Synthetic DNA Sequence
gctcaaggcagatggcattccc

SEQ ID NO: 1962 - DNA, 22 bp, Artificial Sequence
  Synthetic DNA Sequence
ggacaaggcggttgcgtttgat

SEQ ID NO: 1963 - DNA, 22 bp, Artificial Sequence
  Synthetic DNA Sequence
cattcccgtctcgctcgacagt

SEQ ID NO: 1964 - DNA, 19 bp, Artificial Sequence
  Synthetic DNA Sequence
atctgcctgcccgtcttgc

SEQ ID NO: 1965 - DNA, 816 bp, Unknown Organism
  Description of Unknown Organism: Plasmid pGS05
atgaataaatcgctcatcattttcggcatcgtcaacataacctcggacagtttctccgatggaggccggtatctggcgccagacgcagccattgcgcaggcgcgtaagctgatggccgagggggcagatgtgatcgacctcggtccggcatccagcaatcccgacgccgcgcctgtttcgtccgacacagaaatcgcgcgtatcgcgccggtgctggacgcgctcaaggcagatggcattcccgtctcgctcgacagttatcaacccgcgacgcaagcctatgccttgtcgcgtggtgtggcctatctcaatgatattcgcggttttccagacgctgcgttctatccgcaattggcgaaatcatctgccaaactcgtcgttatgcattcggtgcaagacgggcaggcagatcggcgcgaggcacccgctggcgacatcatggatcacattgcggcgttctttgacgcgcgcatcgcggcgctgacgggtgccggtatcaaacgcaaccgccttgtccttgatcccggcatggggttttttctgggggctgctcccgaaacctcgctctcggtgctggcgcggttcgatgaattgcggctgcgcttcgatttgccggtgcttctgtctgtttcgcgcaaatcctttctgcgcgcgctcacaggccgtggtccgggggatgtcggggccgcgacactcgctgcagagcttgccgccgccgcaggtggagctgacttcatccgcacacacgagccgcgccccttgcgcgacgggctggcggtattggcggcgctgaaagaaaccgcaagaattcgttaa

SEQ ID NO: 1966 - DNA, 19 bp, Artificial Sequence
  Synthetic DNA Sequence
catgccagtcttgccaacg

SEQ ID NO: 1967 - DNA, 23 bp, Artificial Sequence
  Synthetic DNA Sequence
cagcaataagtaatccagcgatg

SEQ ID NO: 1968 - DNA, 20 bp, Artificial Sequence
  Synthetic DNA Sequence
ggagagatttcaccgcatag

SEQ ID NO: 1969 - DNA, 22 bp, Artificial Sequence
  Synthetic DNA Sequence
agccaaccatcatgctattcca

SEQ ID NO: 1970 - DNA, 1206 bp, Unknown Organism
  Description of Unknown Organism: Transposon Tn10
atgaatagttcgacaaagatcgcattggtaattacgttactcgatgccatggggattggccttatcatgccagtcttgccaacgttattacgtgaatttattgcttcggaagatatcgctaaccactttggcgtattgcttgcactttatgcgttaatgcaggttatctttgctccttggcttggaaaaatgtctgaccgatttggtcggcgcccagtgctgttgttgtcattaataggcgcatcgctggattacttattgctggctttttcaagtgcgctttggatgctgtatttaggccgtttgctttcagggatcacaggagctactggggctgtcgcggcatcggtcattgccgataccacctcagcttctcaacgcgtgaagtggttcggttggttaggggcaagttttgggcttggtttaatagcggggcctattattggtggttttgcaggagagatttcaccgcatagtcccttttttatcgctgcgttgctaaatattgtcactttccttgtggttatgttttggttccgtgaaaccaaaaatacacgtgataatacagataccgaagtaggggttgagacgcaatcgaattcggtatacatcactttatttaaaacgatgcccattttgttgattatttatttttcagcgcaattgataggccaaattcccgcaacggtgtgggtgctatttaccgaaaatcgttttggatggaatagcatgatggttggcttttcattagcgggtcttggtcttttacactcagtattccaagcctttgtggcaggaagaatagccactaaatggggcgaaaaaacggcagtactgctcgaatttattgcagatagtagtgcatttgcctttttagcgtttatatctgaaggttggttagatttccctgttttaattttattggctggtggtgggatcgctttacctgcattacagggagtgatgtctatccaaacaaagagtcatgagcaaggtgctttacagggattattggtgagccttaccaatgcaaccggtgttattggcccattactgtttactgttatttataatcattcactaccaatttgggatggctggatttggattattggtttagcgttttactgtattattatcctgctatcgatgaccttcatgttaacccctcaagctcaggggagtaaacaggagacaagtgcttag

SEQ ID NO: 1971 - DNA, 21 bp, Artificial Sequence
  Synthetic DNA Sequence
cygactgygccatcctyatca

SEQ ID NO: 1972 - DNA, 21 bp, Artificial Sequence
  Synthetic DNA Sequence
  modified_base (3): i
  modified_base (13): i
mgncagctcatynttgcwksc

SEQ ID NO: 1973 - DNA, 21 bp, Artificial Sequence
  Synthetic DNA Sequence
  modified_base (9): i
  modified_base (16): i
racaccrgnyttggwntcctt

SEQ ID NO: 1974 - DNA, 22 bp, Artificial Sequence
  Synthetic DNA Sequence
  modified_base (8): i
acaagggntggrmsaaggagac

SEQ ID NO: 1975 - DNA, 21 bp, Artificial Sequence
  Synthetic DNA Sequence
tgrccrgggtggttraggacg

SEQ ID NO: 1976 - DNA, 21 bp, Artificial Sequence
  Synthetic DNA Sequence
  modified_base (16): i
gatggaytcygtyaantggga

SEQ ID NO: 1977 - DNA, 21 bp, Artificial Sequence
  Synthetic DNA Sequence
gatggaytcygtyaartggga

SEQ ID NO: 1978 - DNA, 23 bp, Artificial Sequence
  Synthetic DNA Sequence
  modified_base (5): i
catcntgyaatggyaatctyaat

SEQ ID NO: 1979 - DNA, 23 bp, Artificial Sequence
  Synthetic DNA Sequence
catcytgyaatggyaasctyaat

SEQ ID NO: 1980 - DNA, 22 bp, Artificial Sequence
  Synthetic DNA Sequence
  modified_base (9): i
  modified_base (12): i
  modified_base (14): i
tcratggcntcnanragrgtyt

SEQ ID NO: 1981 - DNA, 21 bp, Artificial Sequence
  Synthetic DNA Sequence
  modified_base (9): i
  modified_base (15): i
tggacaccnscaagnggkcyg

SEQ ID NO: 1982 - DNA, 21 bp, Artificial Sequence
  Synthetic DNA Sequence
  modified_base (9): i
  modified_base (15): i
tggacacynscaagnggkcyg

SEQ ID NO: 1983 - DNA, 21 bp, Artificial Sequence
  Synthetic DNA Sequence
  modified_base (14): i
cygaytgcgcyatnctcatca

SEQ ID NO: 1984 - DNA, 21 bp, Artificial Sequence
  Synthetic DNA Sequence
cygaytgygcyatyctsatca

SEQ ID NO: 1985 - DNA, 1383 bp, Cryptococcus neoformans
  strain M1-106
atgggtaaggacaagctgcacgtcaacgtcgttgttatcggtcacgtcgactccggtaagtcgaccaccaccggtcacttgatctacaagtgcggtggtatcgacaagcgaaccattgagaagttcgagaaggaggctcaagagctcggaaagtcttctttcaagtacgcttgggttcttgacaagcttaaggccgagcgagagcgaggtatcaccatcgacattgctctttggaagttcgagacccctaagtaccaggttaccgtcattgacgcccccggtcaccgagacttcatcaagaacatgatcaccggtacctcccaggctgactgtgccatcctcatcattgccaccggtatcggtgagttcgaggctggtatctccaaggacggtcagacccgagagcacgccctcctcgccttcaccctcggtgtcaggcagctcattgttgcttgcaacaagatggacacctgcaagtggtctgaggaccgattcaacgaaatcgtcaaggagaccaacggtttcatcaagaaggttggttacaaccccaaggctgtccccttcgtccccatctctggttggcacggtgacaacatgttggaggagaccaccaacatgccctggtacaagggatggaccaaggagaccaagtccggtgtttccaagggtaagacccttctcgaggccatcgacgccagtaggccccctacccgacccaccgacaagcccctccgtctccctctccaggacgtctacaagatcggtggtatcggcacagtccctgtcggccgagtcgagaccggtgtcatcaaggccggtatggtcgtcaagttcgcccccaccaacgtcaccactgaagtcaagtccgttgagatgcaccacgagcagatccccgagggtctccccggagacaacgttggtttcaacgtcaagaacgtttccatcaaggacatccgacgaggtaacgtctgtggtgactccaagaacgacccccctatggaggctgcttctttcaacgcccaggttatcgtccttaaccaccctggtcagatcggtgccggttacacccccgttctcgactgtcacactgcccacattgcttgcaagttctctgagttgatcgagaagattgaccgacgaaccggtaaggtcatggaggccgcccccaagttcgtcaagtctggtgacgccgccattgtcaagcttgtttcccagaagcctctctgtgttgagacctacgccgactacccccctcttggtcgattcgccgtccgagacatgcgacagaccgttgccgttggtgttattaagagtgtggagaagtccgatgggaagagcggcaaggttaccaaggccgccgagaaggctgctaagaagaagtaa

SEQ ID NO: 1986 - DNA, 1380 bp, Cryptococcus neoformans
  strain B3501
atgggtaaggacaagctgcacgtcaacgtcgttgttatcggtcacgtcgactccggtaagtcgaccaccaccggtcacttgatctacaagtgcggtggtatcgacaagcgaaccattgagaagttcgagaaggaggctcaagagctcggaaagtcttctttcaagtacgcttgggttcttgacaagcttaaggccgagcgagagcgaggtatcaccatcgacattgctctttggaagttcgagacccccaggtaccaggtcaccgtcattgacgcccccggtcaccgagacttcatcaagaacatgatcaccggtacctcccaggctgactgtgccatcctcatcattgccaccggtatcggtgagttcgaggccggtatctccaaggacggtcagacccgagagcacgccctcctcgccttcaccctcggtgtcaggcagctcattgttgcttgcaacaagatggacacctgcaagtggtccgaggaccgattcaacgaaatcgtcaaggagaccaacggtttcatcaagaaggttggctacaaccccaaggctgtccccttcgtccccatctctggttggcacggtgacaacatgttggaggagaccaccaacatgccctggtacaagggatggaccaaggagaccaagtctggtgtttccaggggtaagacccttctcgaggccatcagcgccagtaggccccatacccgacccaccgacaagcccctccgtctccctctccaggacgtctacaagatcggtggtatcggcacagtccctgtcggccgagtcgagaccggtgtcatcaaggccggtatggtcgtcaagttcgcccccaccaacgtcaccactgaagtcaagtccgttgagatgcaccacgagcagatccccgagggtcttcccggagacaacgttggtttcaacgtcaagaacgtttccatcaaggacatccgacgaggtaacgtctgtggtgactccaagaacgacccccctatggaggctgcttctttcaacgcccaggttatcgtccttaaccaccctggtcagatcggtgccggttacacccccgttctcgactgtcacactgcccacattgcctgcaagtttgctgagttgatcgagaagattgaccgacgaaccggtaaggtcatggaggccgcccccaagttcgtcaagtctggtgacgccgccattgtcaagcttgttgcccagaagcccctctgtgttgagacctacgccgactacccccctcttggtcgattcgccgtccgagacatgcgacagaccgttgccgttggtgttatcaagagcgtggacaagaccgagaagggtggcaaggtcaccaaggctgctgagaaggctgccaagaagaagtaa

SEQ ID NO: 1987 - DNA, 1377 bp, Saccharomyces cerevisiae
atgggtaaagagaagtctcacattaacgttgtcgttatcggtcatgtcgattctggtaagtctaccactaccggtcatttgatttacaagtgtggtggtattgacaagagaaccatcgaaaagttcgaaaaggaagccgctgaattaggtaagggttctttcaagtacgcttgggttttggacaagttaaaggctgaaagagaaagaggtatcactatcgatattgctttgtggaagttcgaaactccaaagtaccaagttaccgttattgatgctccaggtcacagagatttcatcaagaacatgattactggtacttctcaagctgactgtgctatcttgattattgctggtggtgtcggtgaattcgaagccggtatctctaaggatggtcaaaccagagaacacgctttgttggctttcaccttgggtgttagacaattgattgttgctgtcaacaagatggactccgtcaaatgggacgaatccagattccaagaaattgtcaaggaaacctccaactttatcaagaaggttggttacaacccaaagactgttccattcgtcccaatctctggttggaacggtgacaacatgattgaagctaccaccaacgctccatggtacaagggttgggaaaaggaaaccaaggccggtgtcgtcaagggtaagactttgttggaagccattgacgccattgaacaaccatctagaccaactgacaagccattgagattgccattgcaagatgtttacaagatcggtggtattggtactgtgccagtcggtagagttgaaaccggtgtcatcaagccaggtatggttgttactttcgccccagctggtgttaccactgaagtcaagtccgttgaaatgcatcacgaacaattggaacaaggtgttccaggtgacaacgttggtttcaacgtcaagaacgtttccgttaaggaaatcagaagaggtaacgtctgtggtgacgctaagaacgatccaccaaagggttgcgcttctttcaacgctaccgtcattgttttgaaccatccaggtcaaatctctgctggttactctccagttttggattgtcacactgctcacattgcttgtagattcgacgaattgttggaaaagaacgacagaagatctggtaagaagttggaagaccatccaaagttcttgaagtccggtgacgctgctttggtcaagttcgttccatctaagccaatgtgtgttgaagctttcagtgaatacccaccattaggtagattcgctgtcagagacatgagacaaactgtcgctgtcggtgttatcaagtctgttgacaagactgaaaaggccgctaaggttaccaaggctgctcaaaaggctgctaagaaataa

SEQ ID NO: 1988 - DNA, 1377 bp, Saccharomyces cerevisiae; identical to SEQ ID NO: 665

SEQ ID NO: 1989 - DNA, 1377 bp, Eremothecium gossypii
  ref <308>: DATABASE ACCESSION NUMBER: ATCC 10895
atgggtaaggaaaagactcacgttaacgttgtcgtcatcggtcacgtcgactctggtaagtctactaccaccggtcacttgatctacaagtgtggtggtattgacaagagaaccatcgagaagttcgagaaggaggctgccgagttgggtaagggttctttcaagtacgcctgggttttggacaaattgaaggctgagagagagagaggtatcaccatcgacattgcgttgtggaagttcgagactccaaagtaccacgtcactgtcattgacgccccaggccacagagacttcatcaagaacatgattaccggtacttctcaagctgactgtgccatcttgatcattgctggtggtgtcggtgagttcgaggctggtatctccaaggacggtcagaccagagagcacgctttgttggcttacaccttgggtgtcaagcagttgatcgttgccatcaacaagatggactccgtcaagtgggacgagtccagataccaggagattgtcaaggagacctccaacttcatcaagaaggtcggttacaaccctaagactgttccattcgttccaatctccggctggaacggtgacaacatgattgaggccaccaccaacgccccatggtacaagggctgggagaaggagaccaaggctggtgccgtcaagggtaagaccttgttggaggccattgacgccattgagccacctgtcagaccaactgacaaggcattgagattgccattgcaggatgtctacaagatcggtggtattggtacggttccagtcggcagagtcgagaccggtgtcatcaagccaggtatggttgttaccttcgccccatccggtgtcaccactgaagtcaagtccgtcgagatgcaccacgagcaattggaggagggtgtcccaggtgacaacgttggtttcaacgtcaagaacgtctccgtcaaggagatcagaagaggtaacgtttgcggtgactccaagaacgacccaccaaaggctgctgagtccttcaacgctaccgtcattgtcttgaaccacccaggtcaaatctctgccggttactctccagtcttggactgtcacactgcccacattgcttgtaagttcgacgagttgttggagaagaacgacagaagaaccggtaagaagttggaagactctccaaagttcctaaaggccggtgacgctgccatggtcaagtttgtcccatccaagccaatgtgtgttgaggctttcaccgactacccaccattgggtagattcgctgtcagagacatgagacagaccgttgctgtcggtgtcatcaagtctgttgtcaagtccgacaaggctggtaaggtcaccaaggccgcccaaaaggctggtaagaaatag

SEQ ID NO: 1990 - DNA, 1377 bp, Eremothecium gossypii
atgggtaaggaaaagactcacgttaacgttgtcgtcatcggtcacgtcgactctggtaagtctactaccaccggtcacttgatctacaagtgtggtggtattgacaagagaaccatcgagaagttcgagaaggaggctgccgagttgggtaagggttctttcaagtacgcctgggttttggacaaattgaaggctgagagagagagaggtatcaccatcgacattgcgttgtggaagttcgagactccaaagtaccacgtcactgtcattgaccccccaggccacagagacttcatcaagaacatgattaccggtacttctcaagctgactgtgccatcttgatcattgctggtggtgtcggtgagttcgaggctggtatctccaaggacggtcagaccagagagcacgctttgttggcttacaccttgggtgtcaagcagttgatcgttgccatcaacaagatggactccgtcaagtgggacgagtccagataccaggagattgtcaaggagacctccaacttcatcaagaaggtcggttacaaccctaagactgttccattcgttccaatctccggctggaacggtgacaacatgattgaggccaccaccaacgccccatggtacaagggctgggagaaggagaccaaggctggtgccgtcaagggtaagaccttgttggaggccattgacgccattgagccacctgtcagaccaactgacaaggcattgagattgccattgcaggatgtctacaagatcggtggtattggtacggttccagtcggcagagtcgagaccggtgtcatcaagccaggtatggttgttaccttcgccccatccggtgtcaccactgaagtcaagtccgtcgagatgcaccacgagcaattggaggagggtgtcccaggtgacaacgttggtttcaacgtcaagaacgtctccgtcaaggagatcagaagaggtaacgtttgcggtgactccaagaacgacccaccaaaggctgctgagtccttcaacgctaccgtcattgtcttgaaccacccaggtcaaatctctgccggttactctccagtcttggactgtcacactgcccacattgcttgtaagttcgacgagttgttggagaagaacgacagaagaaccggtaagaagttggaagactctccaaagttcctaaaggccggtgacgctgccatggtcaagtttgtcccatccaagccaatgtgtgttgaggctttcaccgactacccaccattgggtagattcgctgtcagagacatgagacagaccgttgctgtcggtgtcatcaagtctgttgtcaagtccgacaaggctggtaaggtcaccaaggccgcccaaaaggctggtaagaaatag

SEQ ID NO: 1991 - DNA, 1646 bp, Aspergillus oryzae
  strain KBN616
tggggtaagtttatcaacccgtcgagttgtgttgcatctcagatcatggctgacaagtactttcctccttacagtaaggaagacaagcagcacatcaacatcgtcgttatcggccacgtcgattccggcaagtccaccaccactggtcacttgatctacaagtgtggtggtatcgaccagcgtaccatcgagaagttcgagaaggaagccgctgagctcggtaagggttccttcaagtacgcctgggttcttgacaagctcaagtccgagcgtgagcgtggtatcaccatcgatatcgccctctggaagttccagacctccaagtatgaggtcaccgtcattggtaagcatttgagttccaacctacgttgcccaacatttacagtcatctaacaaagttcaatagatgcccccggtcaccgtgacttcatcaagaacatgatcactggtacttcccaggctgactgcgctatcctcatcattgcctccggtactggtgaattcgaggctggtatctccaaggatggtcagacccgtgagcacgctctgctcgctttcaccctcggtgtccgtcagctcatcgttgccctcaacaagatggacacctgcaagtggtctcaggatcgttacaacgaaatcgttaaggagacttccaacttcatcaagaaggtcggatacaaccccaagagcgttcctttcgtccccatctccggtttcaacggtgacaacatgattgaggcctccaccaactgcccctggtacaagggctgggagaaggagaccaaggctggcaagtccaccggtaagacccttctcgaggccatcgatgccatcgagccccccgtccgtcccaccgacaagcctctccgtcttcccctccaggatgtctacaagatctctggtatcggtactgtgcccgtcggtcgtgtcgagactggtgtcatcaagcctggtatggtcgttactttcgctcctgccaacgtgaccactgaagtcaagtccgttgaaatgcaccaccagcagctccaggccggtaaccccggtgacaacgttggtttcaacgtcaagaacgtctccgtcaaggaagtccgccgtggtaacgttgccggtgactccaagaacgacccccctgctggctgcgattccttcaacgcccaggtcatcgtccttaaccaccccggtcaggtcggcaacggttacgctcccgtcctggactgccacaccgctcacattgcttgcaagttcgctgagctccttgagaagattgaccgccgtaccggtaaatctgttgaggacaagcccaagttcatcaagtctggtgatgctgccatcgtcaagatgattccctccaagcccatgtgtgtggagtctttcactgacttcccccctcttggtcgtttcgctgtccgtgacgtaagtttttccctcttgactatcttcacaatttttcacatattttcacgcctcgtcccactctttttcctcccttcctctttggttcccctttttgcctgcaagttctctatagctaacatgatgtctagatgcgtcaaactgttgccgtcggagttatcaagtcggttgagaagaacactggcggttctggcaaggtcaccaaggccgcccagaaggctggcaagaaataa

SEQ ID NO: 1992 - DNA, 1380 bp, Aureobasidium pullulans
  strain R106
atgggtaaggaaaagtcccacatcaacgtcgtcgttatcggccacgtcgactccggtaagtcgaccaccaccggtcacttgatctacaagtgcggtggtatcgacaagcgtaccatcgagaagttcgagaaggaagccgccgaactcggcaagggttccttcaagtacgcctgggtcctcgacaagctgaagtctgagcgtgagcgtggtatcactatcgatatcgctctgtggaagttcgagacccccaagtacatggtcaccgtcatcgatgcccccggtcaccgtgatttcatcaagaacatgatcactggtacctcccaggctgactgcgccattctcatcattgccgccggtactggtgagttcgaggctggtatctccaaggatggccagactcgtgagcacgcccttctcgcctacacccttggtgtcaagcagctcatcgtcgctatcaacaagatggacaccaccaagtggtctgaggcccgttaccaggagatcatcaaggagacctccggtttcatcaagaaggtcggctacaaccccaagcacgttccctttgtccccatctcgggtttcaacggtgacaacatgattgaggtttcttccaactgcccctggtacaagggttgggagaaggagaccaaggccaaggccactggtaagactctcctcgaggccattgacgccatcgaccctccttcgcgccccaccgacaagcccctccgtcttcccctccaggatgtctacaagatcggtggtattggcacggtgcccgtcggccgtgtcgagaccggtaccatcaagggtggtatggtcgtcaccttcgcccccgctggtgtcaccactgaggtcaagtccgtcgagatgcaccacgagcagctctccgagggtctccccggtgacaacgtcggcttcaacgtcaagaacgtctccgtcaaggagatccgtcgtggtaacgttgccggtgactccaagaacgacccccccaagggttgcgactccttcaacgcccaggtcatcgtcctcaaccaccccggtcaggtcggtgctggttacgcacccgtcctcgattgccacactgcccacatcgcctgcaagttctccgagcttgttgagaagattgaccgccgtaccggcaagtccgttgaggccgcccccaagttcatcaagtctggtgacgccgccatcgtcaagatggttccctccaagcctatgtgtgttgaggccttcactgactaccctcctctcggtcgtttcgccgtccgtgacatgagacagaccgtcgctgtcggtgtcatcaagtccgtcgccaagtccgacaagcagggtgccggtaaggttaccaaggccgctgtcaaggctggcaagaagtaa

SEQ ID NO: 1993 - DNA, 1383 bp, Histoplasma capsulatum
  strain 186AS
atgggtaaggaagacaagactcacattaacctcgtcgtcatcggccacgtcgattcgggcaaatctaccaccactggtcatttgatctacaaatgcggtggtattgacagccgtaccattgagaagttcgaaaaggaagccgaagagttgggcaagaaatccttcaaatatgcgtgggtccttgacaaactgaagtctgagcgtgagcgtggtatcaccatcgatattgccctctggaaattcgagactccgaagtacagtgtcactgtcattgatgctcccggccatcgtgacttcatcaagaacatgatcactggtacctcccaggctgactgcgctatcctcatcattgctgccggtactggtgagttcgaggctggtatctccaaggatggccagactcgtgagcacgctctgcttgctttcacccttggtgtgaggcaactcatcgttgccatcaacaagatggacaccaccaagtggtccgagtcccgtttcaacgaaatcatcaaggaggtttccaacttcatcaagaaggtcggatataaccccaaggctgttcccttcgtgccaatctctggtttcgagggtgacaacatgattgaaccctcccccaactgcacatggtacaagggctggaacaaggagactgcctctggcaagtcttctggtaaaacccttctcgatgccattgacgccattgaacccccaacccgtcctaccgataagcccctccgtcttcccctccaggatgtgtacaaaatctctggtattggcactgttcccgtcggacgtgttgagactggtgtcatcaagcccggtatggtcgtgactttcgctccctccaacgtcaccactgaagtcaagtccgtcgaaatgcaccaccaacaactccaggctggttaccctggcgacaacgtcggcttcaacgtcaagaacgtttcagtcaaggaagtccgccgtggcaacgttgctggcgactccaaaaatgatccccctaagggctgcgaatccttcaatgcccaggtcatcgtccttaaccaccccggccaggttggcgctggttatgccccagtcctcgactgccacactgcccacattgcttgcaagttctctgagcttattgagaagatcgaccgccgtaccggaaagtctgttgagaacaaccccaagttcatcaagtctggtgatgctgctatcgtcaagatggttccctccaagcccatgtgcgtggagcccttcactgactatccccctcttggacgtttcgctgtccgtgacatgagacaaaccgtcgctgtcggtgtcatcaagtccgtcatcaagtctgacaagactgctggcaaggtcaccaaggccgcgcagaaggccaccaagaaataa

SEQ ID NO: 1994 - DNA, 1383 bp, Neurospora crassa
atgggcaaggaggacaagactcacatcaacgtcgtcgttatcggccacgtcgattccggcaagtctaccactaccggtcacttgatctacaagtgcggtggtatcgacaagcgtaccatcgagaagttcgagaaggaagccgctgagctcggtaagggttccttcaagtatgcctgggttcttgacaagctcaaggccgagcgtgagcgtggtatcaccatcgatatcgccctctggaagttcgagactcccaagtactacgtcaccgtcatcgatgcccccggtcatcgtgatttcatcaagaacatgatcactggtacctcccaggctgattgcgctatcctcatcattgccgccggtactggtgagttcgaggctggtatctccaaggatggccagacccgtgagcacgccctgctcgcctacaccctcggtgtcaagcagctcattgttgccatcaacaagatggacaccacccagtggtcccagactcgtttcgaggagatcatcaaggagaccaagaacttcatcaagaaggttggctacaaccccgctggtgtcgctttcgtccccatctccggcttcaacggcgacaacatgcttgagccctccaccaactgcccctggtacaagggttgggagaaggagaccaaggccggcaaggccactggcaagaccctcctcgaggccatcgacgccattgagccccccaagcgtcctaccgacaagcccctccgtcttcccctccaggatgtctacaagatcggtggtatcggcacagtgcccgtcggccgtatcgagactggtgtcctcaagcccggtatggtcgttaccttcgctccttccaacgtcaccactgaagtcaagtccgtcgagatgcaccacgagcagcttgctcagggtgtccccggtgacaacgtcggcttcaacgtgaagaacgtttccgtcaaggatatccgccgtggtaacgttgccggtgactccaagaacgacccccctgctggcgccgcctctttcaccgcccaggtcatcgttctcaaccaccccggtcaggtcggtgcccgctacgcccccgtcctcgactgccacactgcccacattgcctgcaagttcgccgagctcctcgagaagatcgaccgccgtactggtaaggctgttgaggcctcccccaagttcatcaagtctggtgatgctgccatcgtcaagatgattccctccaagcccatgtgcgttgaggctttcaccgactaccctcccctcggccgtttcgccgtccgtgacatgcgtcagaccgtcgccgtcggtgtcatcaaggccgtcgacaagtccaccgctgccgctggcaaggtcaccaagtccgctgccaaggccgccaagaagtaa

SEQ ID NO: 1995 - DNA, 1383 bp, Podospora anserina
atgggcaaggaggacaagactcacatcaacgtcgtcgttatcggccacgtcgattccggcaagtcgaccaccactggtcacttgatctacaagtgcggtggtattgacaagcgtaccatcgagaagttcgagaaggaagctgctgagctcggcaagggctctttcaagtatgcctgggttcttgacaagttgaaggccgagcgtgagcgtggtatcaccatcgatattgccctctggaagttcgagacccccaagtactatgtcaccgtcattgatgcccccggccatcgtgatttcatcaagaacatgattactggtacttcccaggccgattgcgccattctcatcattgccgccggtactggtgagttcgaggctggtatctccaaggatggccagacccgtgagcacgctctcctcgcctacaccctcggtgtgaagcagctcatcgtcgccatcaacaagatggacaccaccaagtggtccgaggcccgcttcaacgagatcatcaaggagacctccaacttcatcaagaaggtcggctacaaccccaagactgttgccttcgtccccatctccggtttcaacggcgacaacatgcttgaggcttccaccaactgcccctggtacaagggctgggagaaggaggtcaagggtggcaaggccaccggcaagaccctccttgaggccatcgactccatcgagccccccaagcgtcccaccgacaagcccctccgtcttcccctccaggatgtctacaagatcggcggtatcggcacagtccctgtcggccgtatcgagactggtatcctcaagcccggtatggtcgttaccttcgctccttccaacgtcaccactgaagtcaagtccgtcgagatgcaccacgagcagctcgctgagggtgttcccggtgacaacgttggtttcaacgtgaagaacgtctccgtcaaggaaatccgccgtggcaacgttgccggtgactccaagaacgacccccccatgggcgccgcctctttcgatgcccaggtcatcgtcctcaaccaccccggccaggtcggtgctggttacgcccccgtcctcgattgccacactgcccacatcgcctgcaagttctctgagctcctgcagaagatcgaccgccgtactggtaaggccgttgaggagagccccaagttcatcaagtctggtgatgctgccatcgtcaagatggttccctccaagcccatgtgcgttgaggctttcactgagtaccctcccctcggtcgtttcgccgtccgtgacatgcgtcagaccgtcgctgtcggtgtcatcaagaaggtcgagaaggccgctgctggttccggcaaggttaccaagtccgctgccaaggctggcaagaaataa

SEQ ID NO: 1996 - DNA, 1386 bp, Podospora curvicolla
  strain VLV
atgggcaaggaggacaagactcacatcaacgtcgtcgttatcggccacgtcgattccggcaagtcgaccaccactggtcacttgatctacaagtgcggtggtattgacaagcgtaccatcgagaagttcgagaaggaagctgctgagctcggcaagggctctttcaagtatgcctgggttcttgacaagttgaaggccgagcgtgagcgtggtatcaccattgatatcgccctctggaagttcgagacccccaagtactatgtcaccgtcatcgatgcccccggccatcgtgatttcatcaagaacatgattactggtacttcccaggccgattgcgccattctcatcattgccgccggtactggtgagttcgaggctggtatctccaaggatggccagacccgtgagcacgctctcctcgcctacaccctcggtgtgaagcagctcatcgtcgccatcaacaagatggacaccaccaaatggtccgaggcccgcttcaacgagatcatcaaggagacctccaacttcatcaagaaggtcggctacaaccccaagactgttgccttcgtccccatctccggtttcaacggcgacaacatgcttgaggcttccaccaactgcccctggtacaagggttgggagaaggaggtcaagggtggcaaggctactggcaagaccctcctcgaggccatcgactccatcgagccccccaagcgtcccaccgacaagcccctccgtcttccccttcaggacgtttacaagatcggcggtatcggcacagtccctgtcggccgtatcgagactggtatcctcaagcccggtatggtcgttaccttcgccccttccaacgtcaccactgaagtcaagtccgtcgagatgcaccacgagcagctctctgagggtgtccccggtgacaacgttggtttcaacgtgaagaacgtctccgtcaaggaaatccgccgtggcaacgttgccggtgactccaagaacgacccccctcttggcgccgcttctttcgatgcccaggtcatcgtcctcaaccaccccggccaggtcggtgctggttacgcccccgtcctcgattgccacactgcccacatcgcctgcaagttcgctgagctcctgcagaagatcgatcgccgtactggtaaggctgttgaggagagccctaagttcatcaagtctggtgatgctgccatcgtcaagatgattccctccaagcccatgtgcgttgaggctttcactgagtaccctcccctcggtcgtttcgctgtccgtgacatgcgtcagaccgtcgctgtcggtgtcatcaagaaggtcgagaaggccgctgctggttccggcaaggtcaccaagtccgctgccaaggctggtggcaagaaataa

SEQ ID NO: 1997 - DNA, 1383 bp, Sordaria macrospora
  strain OOO
atgggtaaggaagacaaggctcacatcaacgtcgtcgttatcggccacgtcgattccggcaagtccaccactaccggtcacctgatctacaagtgcggtggtatcgacaagcgtaccatcgagaagttcgagaaggaagccgctgagctcggcaagggttccttcaagtatgcctgggttcttgacaagctcaaggccgagcgtgagcgtggtatcaccatcgatatcgccctctggaagttcgagactcccaagtactacgtcaccgtcatcgatgcccccggccatcgtgatttcatcaagaacatgatcactggtacctcccaggctgattgcgctattctcatcattgccgctggtactggtgagttcgaggctggtatctccaaggatggccagactcgtgagcacgctcttctcgcctacaccctcggtgtcaagcagctcatcgttgccatcaacaagatggacaccacccagtggtcccaggctcgtttcgaggagatcatcaaggagaccaagaacttcatcaagaaggtcggctacaaccccgccaccgtcgctttcgtccccatctccggcttcaacggcgacaacatgcttgaggcctccaccaactgcccctggtacaagggttgggagaaggagaccaaggccggcaagtccactggcaagaccctcctcgaggccatcgacgccattgagcagcccaagcgcccgaccgacaagcccctccgtcttcccctccaggatgtctacaagatcggcggtatcggcacagtgcccgtcggccgtatcgagactggtgtcctcaagcccggtatggtcgttaccttcgctccttccaacgtcaccactgaagtcaagtccgtcgagatgcaccacgagcagcttgctcagggtgttcccggtgacaacgtcggcttcaacgtgaagaacgtttccgtcaaggatatccgtcgtggtaacgttgccggtgactccaagaacgacccccctgtcggcgctgcctctttcaccgcccaggtcatcgtccttaaccaccccggtcaggtcggtgccggctacgctcccgtcctcgattgccacactgcccacattgcctgcaagttcgccgagctcctcgagaagatcgatcgccgtactggtaaggctgttgagacttctcccaagttcatcaagtctggtgatgctgccatcgtcaagatgattccctccaagcccatgtgcgtcgaggctttcaccgactaccctcccctcggtcgtttcgccgtccgtgacatgcgtcagaccgtcgctgtcggtgtcatcaaggccgtcgacaagacccaggctgtcgctggcaaggtcaccaagtctgctgccaaggctgccaagaagtaa

SEQ ID NO: 1998 - DNA, 1383 bp, Trichoderma reesei
  strain QM9414
atgggtaaggaggacaagactcacatcaacgtggtcgtcatcggccacgtcgactccggcaagtctaccaccactggtcacttgatctaccagtgcggtggtatcgacaagcgtaccattgagaagttcgagaaggaagccgccgaactcggcaagggttccttcaagtacgcgtgggttcttgacaagctcaaggccgagcgtgagcgtggtatcaccatcgacattgccctctggaagttcgagactcccaagtactatgtcaccgtcattgacgctcccggccaccgtgacttcatcaagaacatgatcactggtacttcccaggccgactgcgctatcctcatcatcgctgccggtactggtgagttcgaggctggtatctccaaggatggccagacccgtgagcacgctctgctcgcctacaccctgggtgtcaagcagctcatcgtcgccatcaacaagatggacactgccaactgggccgaggctcgttaccaggaaatcatcaaggagacttccaacttcatcaagaaggtcggcttcaaccccaaggccgttgctttcgtccccatctccggcttcaacggtgacaacatgctcaccccctccaccaactgcccctggtacaagggctgggagaaggagaccaaggctggcaagttcaccggcaagaccctccttgaggccatcgactccatcgagccccccaagcgtcccacggacaagcccctgcgtcttcccctccaggacgtctacaagatcggtggtatcggaacagttcccgtcggccgtatcgagactggtgtcctcaagcccggtatggtcgttaccttcgctccctccaacgtcaccactgaagtcaagtccgtcgagatgcaccacgagcagctcgctgagggccagcctggtgacaacgttggtttcaacgtgaagaacgtttccgtcaaggaaatccgccgtggcaacgttgccggtgactccaagaacgacccccccatgggcgccgcttctttcaccgcccaggtcatcgtcatgaaccaccccggccaggtcggtgccggctacgcccccgtcctcgactgccacactgcccacattgcctgcaagttcgccgagctcctcgagaagatcgaccgccgtaccggtaaggctaccgagtctgcccccaagttcatcaagtctggtgactccgccatcgtcaagatgatcccctccaagcccatgtgcgttgaggctttcaccgactaccctcccctgggtcgtttcgccgtccgtgacatgcgccagaccgtcgctgtcggtgtcatcaaggccgtcgagaagtcctctgccgccgccgccaaggtcaccaagtccgctgccaaggccgccaagaaataa

SEQ ID NO: 1999 - DNA, 29 bp, Artificial Sequence
  Synthetic DNA Sequence
catgtcaayattggtactattggtcatgt

SEQ ID NO: 2000 - DNA, 25 bp, Artificial Sequence
  Synthetic DNA Sequence
  modified_base (9): i
ccaccytcnctcamgttgaarcgtt

SEQ ID NO: 2001 - DNA, 23 bp, Artificial Sequence
  Synthetic DNA Sequence
  modified_base (6): i
  modified_base (12): i
acyacnttracngcygcyatyac

SEQ ID NO: 2002 - DNA, 21 bp, Artificial Sequence
  Synthetic DNA Sequence
  modified_base (3): i
  modified_base (15): i
ccngargaragagcnmgwggt

SEQ ID NO: 2003 - DNA, 21 bp, Artificial Sequence
  Synthetic DNA Sequence
  modified_base (9): i
catytcranrttgtcacctgg

SEQ ID NO: 2004 - DNA, 1360 bp, Candida albicans
  strain SC5314
gctgccttcgaccgttctaaacctcatgtcaacattggtactattggtcatgttgatcatggtaaaactacattgactgctgctatcaccaaagttttagccgaacaaggtggtgccaacttcttggattatggttctattgatagagctccagaagaaagagctagaggtatcactatttccactgcccacgttgaatacgaaaccaagaacagacactatgcccacgttgattgtccaggacacgctgattatatcaaaaatatgattactggtgccgctcaaatggatggtgctatcattgttgttgctgccactgatggtcaaatgcctcaaaccagagaacatttgttattggccagacaagttggtgttcaagacttggttgtgtttgtcaacaaagtcgatactattgatgaccctgaaatgttggaattagtcgaaatggaaatgagagaattgttatccacctacggttttgatggtgacaacactccagttattatgggatctgctttaatggctttggaagacaagaaaccagaaattggtaaggaagctatcttgaaattgttagatgctgtcgatgaacacattccaactccatcaagagacttggaacaaccatttttgttaccagttgaagacgtgttctccatctccggtagaggaactgttgtcactggtagagttgaaagaggtgttttgaagaagggtgaagaaatcgaaattgttggtggttttgacaaaccttacaagactactgttaccggtattgaaatgttcaaaaaagaattagactctgctatggctggtgacaactgtggtgttttgttaagaggtgttaaaagagatgaaatcaagagaggtatggttttggccaaaccaggtactgctacttctcacaagaagttcttggcttccttgtatattttgacttccgaagaaggtggtcgttccactccatttggtgaaggttacaagcctcaatgcttcttcagaactaacgatgtcactaccacattttcattcccagaaggagaaggtgttgatcattctcaaatgatcatgccaggtgacaacattgaaatggttggtgaattgatcaaatcttgtccattagaagtcaaccaacgtttcaacttgagagaaggtggtaaaactgttggtactggtttgattaccagaatcatcgaataaacagaatgtgcactgtgaataataaaaagaaaagaggtatatataggtgactttgtattttgtattgaacaataaaattctgtaaatagtaagggcctcagaagttttgatttgatttatgccatgtggacttgtagagatatccttctcaaacttcttg

SEQ ID NO: 2005 - DNA, 1342 bp, Schizosaccharomyces pombe
aagccgcatgtcaatattggtactattggtcatgttgaccacggtaaaacgacgttgacggctgctattactaaatgcctttctgatcttggtcaagctagttttatggattatagtcaaattgacaaggcccccgaggaaaaggcacgtggtattaccatttcatctgcccatgttgaatacgaaactgctaatcgtcactatgcccatgtggattgtcctggtcacgccgattacattaagaatatgattactggtgctgctacaatggatggcgctatcattgttgtttctgctaccgatggtcaaatgcctcaaactcgtgaacatttgcttctggctcgtcaagtcggtgtaaagcaaattgttgtatacatcaataaagtcgatatggtcgagcctgatatgatcgagcttgtcgaaatggaaatgcgtgagctactctccgaatacggatttgatggtgacaatactccaattgttagcggcagtgctttatgtgccttagagggtcgtgagcctgagattggtctcaatagtattactaaattgatggaagctgttgatagttatattactcttcctgaaagaaaaacggatgtccctttcttgatggccatcgaggacgttttttcaatttcaggtcgcggaactgtagtcactggccgtgtcgagcgcggtactttaaagaagggtgctgaaatcgaaatcgtcggttatggtagccatttaaagactaccgttactggaattgaaatgttcaaaaagcagcttgatgccgccgttgccggtgacaattgtggccttttacttcgttctatcaagcgagagcaattaaaacgtggaatgattgtcgctcaaccaggaaccgttgctcctcatcagaaattcaaggcatcattctatattttgacaaaagaggaaggaggtcgtcgtaccggtttcgttgacaagtatcgtccccaactgtacagtcgtacttccgacgttactgtcgaacttacccaccctgatcctaacgactcagacaaaatggttatgcctggagacaatgtcgagatgatctgtacgcttattcaccccattgtcatcgaaaaaggacaacgcttcacagttcgtgagggtggaagcactgtaggcacagctttggttactgaacttttggattagtgcatttatgaacttattggctttaaaaattttgcatgctgaataccaatattatgtcccttctcagaattctataactacagtgtcattattgtaataagacttttgcatccattgacaatggtatttgatacttttatagtttctactattgttagccaaagttataaaa

SEQ ID NO: 2006 - DNA, 18 bp, Artificial Sequence
  Synthetic DNA Sequence
tggagccggtgagcgtgg

SEQ ID NO: 2007 - DNA, 18 bp, Artificial Sequence
  Synthetic DNA Sequence
tggagccagtgagcgtgg

SEQ ID NO: 2008 - DNA, 19 bp, Artificial Sequence
  Synthetic DNA Sequence
tctggagccgatgagcgtg

SEQ ID NO: 2009 - DNA, 19 bp, Artificial Sequence
  Synthetic DNA Sequence
ctggagccagtaagcgtgg

SEQ ID NO: 2010 - DNA, 861 bp, Klebsiella pneumoniae
  strain KMK107
atgagtattcaacattttcgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggtgcggtattatcccgtgttgacgccgggcaagagcaactcggtcgccgcatacactattctcagaatgacttggttaagtactcaccagtcacagaaaagcatcttacggatggcatgacagtaagagaattatgcagtgctgccataaccatgagtgataacactgctgccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgacgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccagtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaa

SEQ ID NO: 2011 - DNA, 861 bp, Klebsiella pneumoniae
  strain CLSiS L-491
atgagtattcaacatttccgtgtcgcccttattcccttttttgcggcattttgctttcctgtttttgctcacccagaaacgctggtgaaagtaaaagatgctgaagatcagttgggtgcacgagtgggttacatcgagctggatctcaacagcggtaagatccttgagagttttcgccccgaagaacgttttccaatgatgagcacttttaaagttctgctatgtggtgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaacccgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccagtaagcgtggatctcgcggtatcattgcagcactggggccagatggtaagccctcccgtatcgtagttatctacatgacggggagtcaggcaactatggatgaacgaaatagacagatcgctgagataggtgcctcactgattaagcattggtaa

SEQ ID NO: 2012 - DNA, 49 bp, Artificial Sequence
  Synthetic DNA Sequence
  modified_base (29): n = guanidyl-MR-HEG
ccgcggattattaaaccgcccttccgcgnatgtcagagggatagatcca

SEQ ID NO: 2013 - DNA, 353 bp, Kluyvera ascorbata
  ref <308>: DATABASE ACCESSION NUMBER: ATCC 33433
agcttaagaactcttatctggattacgcgatgtcggtcattgttggccgtgcgctgccggatgtccgagatggcctgaagccggtacaccgtcgcgtactttacgccatgaacgtattgggcaatgactggaacaaagcctacaaaaaatcagcccgtgtcgtgggtgacgtgatcggtaaatatcacccgcatggtgatactgccgtctatgacactatcgtccgtatggcacagccattctcactgcgatacatgctggtagatggtcaaggtaacttcggttctgtcgatggcgactccgccgcagcgatgcgttatacggaaatccgtatgtcgaaaatcgcccatgag

SEQ ID NO: 2014 - DNA, 355 bp, Kluyvera georgiana
  ref <308>: DATABASE ACCESSION NUMBER: ATCC 51603
agctcctatctggattatgcgatgtcggtcattgttggccgtgcgctgccagatgtccgagatggcctgaagccggtacaccgtcgcgtactttacgccatgaacgtactaggcaatgactggaacaaagcctataaaaaatctgcccgtgtcgttggtgacgtaatcggtaaataccatccccatggtgactcggcggtctatgacacgatcgtccgcatggcgcagccattctcgctgcgttatatgctggtagacggtcagggtaacttcggttctatcgacggcgactctgcggcggcaatgcgttatacggaaatccgtctggcgaaaattgcccatgaactgatggccg

SEQ ID NO: 2015 - DNA, 22 bp, Artificial Sequence
  Synthetic DNA Sequence
ccaagaagctcaaaaacatctg

SEQ ID NO: 2016 - DNA, 20 bp, Artificial Sequence
  Synthetic DNA Sequence
tadcctgtccawacagccat

SEQ ID NO: 2017 - DNA, 22 bp, Artificial Sequence
  Synthetic DNA Sequence
actttgaataaggtcggtctag

SEQ ID NO: 2018 - DNA, 22 bp, Artificial Sequence
  Synthetic DNA Sequence
acactaaacaaggttggtttag

SEQ ID NO: 2019 - DNA, 22 bp, Artificial Sequence
  Synthetic DNA Sequence
acactaaacaaggtcggtctag

SEQ ID NO: 2020 - DNA, 22 bp, Artificial Sequence
  Synthetic DNA Sequence
gtagctccagatgaaatgtttg

SEQ ID NO: 2021 - DNA, 22 bp, Artificial Sequence
  Synthetic DNA Sequence
gtagctccagacgaaatgtttg

SEQ ID NO: 2022 - DNA, 22 bp, Artificial Sequence
  Synthetic DNA Sequence
gtagctccagatgaaacgtttg

SEQ ID NO: 2023 - DNA, 22 bp, Artificial Sequence
  Synthetic DNA Sequence
gtaactccagatgaaatgtttg

SEQ ID NO: 2024 - DNA, 20 bp, Artificial Sequence
  Synthetic DNA Sequence
agtgaaaagatggctgctgc

SEQ ID NO: 2025 - DNA, 20 bp, Artificial Sequence
  Synthetic DNA Sequence
agtgagaaaatggctgctgc

SEQ ID NO: 2026 - DNA, 23 bp, Artificial Sequence
  Synthetic DNA Sequence
tccaagcatgcattatgcaaacg

SEQ ID NO: 2027 - DNA, 23 bp, Artificial Sequence
  Synthetic DNA Sequence
tcggtctagatagagctaaaacg

SEQ ID NO: 2028 - DNA, 20 bp, Artificial Sequence
  Synthetic DNA Sequence
tatgctcttcaacaatcacg

SEQ ID NO: 2029 - DNA, 22 bp, Artificial Sequence
  Synthetic DNA Sequence
agccgttgagactttgaataag

SEQ ID NO: 2030 - DNA, 19 bp, Artificial Sequence
  Synthetic DNA Sequence
cttaatggtcttggtatcg

SEQ ID NO: 2031 - DNA, 22 bp, Artificial Sequence
  Synthetic DNA Sequence
cgtgactggggttctgctatga

SEQ ID NO: 2032 - DNA, 22 bp, Artificial Sequence
  Synthetic DNA Sequence
cgtgactggggatcatcaatga

SEQ ID NO: 2033 - DNA, 22 bp, Artificial Sequence
  Synthetic DNA Sequence
cgtgactggggttctgccatga

SEQ ID NO: 2034 - DNA, 22 bp, Artificial Sequence
  Synthetic DNA Sequence
atcaagaacactggctatgtag

SEQ ID NO: 2035 - DNA, 22 bp, Artificial Sequence
  Synthetic DNA Sequence
atcaagaacactggctacgtag

SEQ ID NO: 2036 - DNA, 22 bp, Artificial Sequence
  Synthetic DNA Sequence
atcaagaacactggttacgtag

SEQ ID NO: 2037 - DNA, 22 bp, Artificial Sequence
  Synthetic DNA Sequence
atcaaaaatactggttatgtag

SEQ ID NO: 2038 - DNA, 22 bp, Artificial Sequence
  Synthetic DNA Sequence
atcaagaatactggctacgtag

SEQ ID NO: 2039 - DNA, 22 bp, Artificial Sequence
  Synthetic DNA Sequence
atcaaaaacactggctatgtag

SEQ ID NO: 2040 - DNA, 19 bp, Artificial Sequence
  Synthetic DNA Sequence
tgtgaccccagacaaaccc

SEQ ID NO: 2041 - DNA, 20 bp, Artificial Sequence
  Synthetic DNA Sequence
gttgagcggcagcactatct

SEQ ID NO: 2042 - DNA, 20 bp, Artificial Sequence
  Synthetic DNA Sequence
cacggggatttctctattta

SEQ ID NO: 2043 - DNA, 20 bp, Artificial Sequence
  Synthetic DNA Sequence
cacggggattactctattta

SEQ ID NO: 2044 - DNA, 20 bp, Artificial Sequence
  Synthetic DNA Sequence
accgtaagtcggccaagtca

SEQ ID NO: 2045 - DNA, 19 bp, Artificial Sequence
  Synthetic DNA Sequence
gttctttctccgtatcgtc

SEQ ID NO: 2046 - DNA, 20 bp, Artificial Sequence
  Synthetic DNA Sequence
acggggatttttctatctat

SEQ ID NO: 2047 - DNA, 2160 bp, Streptococcus pneumoniae
  strain CS109
atgaacaaaccaacgattctgcgcctaatcaagtatctgagcattagcttcttaagcttggttatcgcagccattgtcttaggcggaggagtttttttctactatgttagcaaggctcctagcctatccgagagtaaactagttgcaacaacctctagtaaaatctacgacaataaaaatcaactcattgctgacttgggttctgaacgccgcgtcaatgcccaagctaatgatattcccacagatttggttaaggcaatcgtttctatcgaagaccatcgcttcttcgaccacagggggattgataccatccgtatcctgggagctttcttgcgcaatctgcaaagcaattccctccaaggtggatcaactctcacccaacagttgattaaattgacttacttttcaacctcgacttccgaccagactatttctcgtaaggctcaggaagcttggttagcgattcagttagaacaaaaagcaaccaaacaggaaatcttgacctactatataaataaggtctacatgtctaatggcaactatggaatgcagacagcagctcaaaactactatggtaaagacctcaataatttaagtttacctcagttagccttgctggctggaatgcctcaggcaccaaaccaatatgacccctattcacatccagaagcagcccaagaccgccgaaacttggtcttatctgaaatgaaaaatcaaggttacatctctgctgaacagtatgagaaagcagtcaatacaccaattactgatggactacaaagtctcaaatcagcaagtaattaccctgcttacatggataattacctcaaggaagtcatcaatcaagttgaagaagaaactggctataaccttctaactactgggatggatgtttacacaaatgtagaccaagaagctcaaaaacatctgtgggatatctacaactccgatcaatacgtctcttaccctgacgatgatttgcaagtcgcatctacggtcgtagatgtttcaaatggtaaagtcatcgcacaacttggtgctcgtcatcaagcaagtaatgtttcattcggtaccaaccaggccgtagaaaccaatcgtgactggggatcatcaatgaaaccaatcactgactatgctcccgctttagaatatggagtctatgactctactgcttctattgtacatgatgtcccttataactatcctggcactgatactccactctacaactgggatcatgtctactttggaaacattacaatccagtatgctcttcaacaatcacgaaatgtcacagccgttgagactttgaataaggtcggtctagatagagctaaaaccttccttaatggtcttggtatcgactatccaagcatgcattatgcaaacgccatttcaagtaacacaactgaatccaacaaaaaatatggtgcaagtagtgaaaaaatggctgctgcctacgctgcttttgctaatggtggtatttatcacaaaccaatgtatatcaataaaatcgtctttagtgatggtagcgaaaaagaattttctgatgctggtacacgagctatgaaagagactactgcctatatgatgactgaaatgatgaaaactgttttaacttacggaacaggacgtggagcctacctaccatggcttccacaagcaggtaagacaggtacttctaactatactgacgaagaaattgaaaagtatatcaagaacactggttacgtagctccagatgaaatgtttgtagggtatacccgtaaatatgcaatggctgtttggacaggatactcaaatcgtctaactccaatcatcggagatggtttccttgttgctggtaaagtctatcgttcaatgataacttacctttctgaagatgaccaacctggagattggacaatgccagatggcttgtatagaaatggagaattcgtatttaaaaatggtgctcgttctacgtggagctcacctgctccacaacaacccccatcaactgaaagttcaagctcatcatcagatagttcaacttcacagtctaactcaaccactccaagcacaaataatagtacgactaccaatcctaacaataatacgcaacaatcaaatacaacccctgatcaacaaaatcagaatcctcaaccagcacaaccataa

SEQ ID NO: 2048 - DNA, 2160 bp, Streptococcus pneumoniae
  strain R6
atgaacaaaccaacgattctgcgcctaatcaagtatctgagcattagcttcttaagcttggttatcgcagccattgtcttaggcggaggagtttttttctactacgttagcaaggctcctagcctatccgagagtaaactagttgcaacaacttctagtaaaatctacgacaataaaaatcaactcattgctgacttgggttctgaacgccgcgtcaatgcccaagctaatgatattcccacagatttggttaaggcaatcgtttctatcgaagaccatcgcttcttcgaccacagggggattgataccatccgtatcctgggagctttcttgcgcaatctgcaaagcaattccctccaaggtggatcagctctcactcaacagttgattaagttgacttacttttcaacttcgacttccgaccagactatttctcgtaaggctcaggaagcttggttagcgattcagttagaacaaaaagcaaccaagcaagaaatcttgacctactatataaataaggtctacatgtctaatgggaactatggaatgcagacagcagctcaaaactactatggtaaagacctcaataatttaagtttacctcagttagccttgctggctggaatgcctcaggcaccaaaccaatatgacccctattcacatccagaagcagcccaagaccgccgaaacttggtcttatctgaaatgaaaaatcaaggctacatctctgctgaacagtatgagaaagcagtcaatacaccaattactgatgggctacaaagtctcaaatcagcaagtaattaccctgcttacatggataattacctcaaggaagtcatcaatcaagttgaagaagaaacaggctataacctactcacaactgggatggatgtctacacaaatgtagaccaagaagctcaaaaacatctgtgggatatttacaatacagacgaatacgttgcctatccagacgatgaattgcaagtcgcttctaccattgttgatgtttctaacggtaaagtcattgcccagctaggagcacgccatcagtcaagtaatgtttccttcggaattaaccaagcagtagaaacaaaccgcgactggggatcaactatgaaaccgatcacagactatgctcctgccttggagtacggtgtctacgagtcaactgccactatcgttcacgatgagccctataactaccctgggacaaatacccctgtttataactgggataggggctactttggcaacatcaccttgcaatacgccctgcaacaatcgcgaaacgtcccagccgtggaaactctaaacaaggtcggactcaaccgcgccaagactttcctaaatggtctcggaatcgactacccaagtattcactactcaaatgccatttcaagtaacacaaccgaatcagacaaaaaatatggagcaagtagtgaaaagatggctgctgcttacgctgcctttgcaaatggtggaacttactataaaccaatgtatatccataaagtcgtctttagtgatgggagtgaaaaagagttctctaatgtcggaactcgtgccatgaaagaaacgacagcctatatgatgaccgacatgatgaaaacagtcttgagttatggaactggacgaaatgcctatcttgcttggctccctcaggctggtaaaacaggaacctctaactatacagacgaggaaattgaaaaccacatcaagacctctcaatttgtagcacctgatgaactatttgctggctatacgcgtaaatattcaatggctgtatggacaggctattctaaccgtctgacaccacttgtaggcaatggccttacggtcgctgccaaagtttaccgctctatgatgacctacctgtctgaaggaagcaatccagaggattggaatataccagaggggctctacagaaatggagaattcgtatttaaaaatggtgctcgttctacgtggagctcacctgctccacaacaacccccatcaactgaaagttcaagctcatcatcagatagttcaacttcacagtctagctcaaccactccaagcacaaataatagtacgactaccaatcctaacaataatacgcaacaatcaaatacaacccctgatcaacaaaatcagaatcctcaaccagcacaaccataa

SEQ ID NO: 2049 - DNA, 2160 bp, Streptococcus pneumoniae
  strain URU-E159
atgaacaaaccaacgattctgcgcctaatcaagtatctgagcattagcttcttaagcttggttatcgcagccattgtcttaggcggaggagtttttttctactacgttagcaaggctcctagcctatccgagagtaaactagttgcaacaacttctagtaaaatctacgacaataaaaatcaactcattgctgacttgggttctgaacgccgcgtcaatgcccaagctaatgatattcccacagatttggttaaggcaatcgtttctatcgaagaccatcgcttcttcgaccacagggggattgattccatccgtatcctgggagctttcttgcgcaatctgcaaagtaattccctccaaggtggatcaactctcacccaacagttgattaagttgacttacttttcaacctcgacttccgaccagactatttctcgtaaggctcaggaagcttggttagcgattcagttagaacaaaaagcaaccaaacaggaaatcttgacctactatataaataaggtctacatgtctaatggcaactatggaatgcagacagcagctcaaaactactatggtaaagacctcaataatttaagtttacctcagttagccttgctggctggaatgcctcaggcaccaaaccaatatgacccctattcacatccagaagcagcccaagaccgccgaaacttggtcttatctgaaatgaaaaatcaaggttacatctctgctgaacagtatgagaaagcagtcaatacaccaattactgatggactacaaagtctcaaatcagcaagtaattaccctgcttacatggataattacctcaaggaggtcatcaatcaagtagaacaagaaactggctataaccttctaactactgggatggatgtttacacaaatgtagaccaagaagctcaaaaacatctgtgggatatctacaactccgatcaatacgtctcttaccctgacgatgatttgcaagtcgcatctacggtcgtagatgtttcaaatggtaaagtcatcgcccaacttggagctcgtcaccaagcaagtaacgtttcatttggtaccaaccaagctgtggaaaccaatcgtgactggggttctgctatgaaaccaatcaccgattatgcacctgccatagaatacggtgtttatgattccactgcaactatggttaatgatattccttataactatccgggaacaagcacacctgtctacaactgggatagagcatatttcggtaatattactctgcaatatgctcttcaacaatcacgaaatgtcacagccgttgagactttgaataaggtcggtctagatagagctaaaaccttccttaatggtcttggtatcgactatccaagcatgcattatgcaaacgccatttcaagtaatacaacagaatctaataaacaatacggagcaagtagtgaaaaaatggctgctgcttatgctgcctttgcaaatggtggcacttactataaaccaatgtatatccataaagtcgtcttcagtgatggaagtaaaaaagagttctctaatgtcggaactcgtgccatgaaggaaacgacagcctatatgatgaccgacatgatgaaaacagtcttgacttatggaactgggcgtggagcctatcttccttggcttcctcaagctggtaaaacaggaacctctaactatacagatgaggaagttgaaaaccacatcaagaacactggctatgtagctccagatgaaatgtttgttggttatactcgtaagtattctatggctgtatggacaggttattcgaatcgtttaactcctatcgttggagatggtttcctagttgcagctaaagtttatcgctcaatgataacgtatctatcagaagatactcatccagaagactggacgatgccagacggacttttcagaaatggagaattcgtatttaaaaatggtgctcgttctacgtggaactcacctgctccacaacaacccccatcaactgaaagttcaagctcatcatcagatagttcaacttcacagtctagctcaaccactccaagcacaaataatagtacgactaccaatcctaacaataatacgcaacaatcaaatacaacccctgatcaacaaaatcagaatcctcaaccagcacaaccataa

SEQ ID NO: 2050 - DNA, 930 bp, Streptococcus pneumoniae
  strains 8303; 35193
ctgtgggatatctacaactccgatcaatacgtctcttaccctgacgatgatttgcaagtcgcatctacggtcgtagatgtttcaaatggtaaagtcatcgcccaacttggagctcgtcaccaagcaagtaacgtttcatttggtaccaaccaagctgtggaaaccaatcgtgactggggttctgctatgaaaccaatcaccgattatgcacctgccatagaatacggtgtttatgattccactgcaactatggttaatgatattccttataactatccgggaacaagcacacctgtctacaactgggatagagcatatttcggtaatattactctgcaatatgctcttcaacaatcacgaaatgtcacagccgttgagactttgaataaggtcggtctagatagagctaaaaccttccttaatggtcttggtatcgactatccaagcatgcattatgcaaacgccatttcaagtaatacaacagaatctaataaacaatacggagcaagtagtgaaaaaatggctgctgcttatgctgcctttgcaaatggtggcacttactataaaccaatgtatatccataaagtcgtcttcagtgatggaagtaaaaaagagttctctaatgtcggaactcgtgccatgaaggaaacgacagcctatatgatgaccgacatgatgaaaacagtcttgacttatggaactgggcgtggagcctatcttccttggcttcctcaagctggtaaaacaggaacctctaactatacagatgaggaagttgaaaaccacatcaagaacactggctatgtagctccagatgaaatgtttgttggttatactcgtaagtattctatggctgtatggacaggttattcgaatcgtttaactcctatcgttggagatggtttcctagttgcagctaaagtttatcgc

SEQ ID NO: 2051 - DNA, 930 bp, Streptococcus pneumoniae
  strains 63509; M11
ctgtgggatatttacaatacagacgaatacgttgcctatccagatgatgacatgcaagtagcttcgactattgtagatgtatctaatggtaacgttattgcacaacttggtgctcgtcatcaagcaagtaatgtttcattcggcaccaaccaggctgtggagaccaatcgtgactggggttcttctatgaaaccaatcactgactatgctcccgctttagaatatggagtctatgactctactgcttctattgtacatgatgttccttataactatcctggcactgatactccagtctacaactgggatcatgtctactttggaaacattacaatccagtatgctcttcaacaatcacgaaatgtcacagccgttgagactttgaataaggtcggtctagatagagctaaaaccttccttaatggtcttggtatcgactatccaagcatgcattatgcaaacgccatttcaagtaacacaactgaatccaacaaacagtacggtgcaagtagtgaaaagatggctgctgcttatgccgccttttctaatggtggtatttaccacaaaccaatgtatatcaataaaatcgtcttcagtgatggtagtgaaaaagaattttctgatgctggtacacgagctatgaaagaaactactgcctatatgatgaccgaaatgatgaaaactgttttagcttacggaaccggacgtggtgcttacctaccatggcttccacaagcaggtaagacaggtacttctaactatactgacgacgaaattgaaaagtatatcaagaacactggctacgtagctccagatgaaatgtttgttggttatactcgtaagtattctatggctgtatggactggttactcaaatcgtttaactccaatcgtaggagatggtttcctagttgctgctaaggtttatcgc

SEQ ID NO: 2052 - DNA, 1195 bp, Streptococcus pneumoniae
  strain #22/HA5
gtctcttaccctgacgatgatttgcaagtcgcatctacggtcgtagatgtttccaatggtaaagtcatcgcccaacttggagctcgtcaccaagcaagtaacgtttcatttggtaccaaccaagctgtggaaaccaatcgtgactggggttcaacaatgaaaccaatcaccgattatgcacctgccatagaatacggtgtatatgattccactgcaactatggttaatgatattccttataactatccgggaacaagcacacctgtctacaactgggatcgagcatattttggtaatattactctgcaatatgcccttcaacaatcacgtaatgttacagcagttgaaacattaaacaaggttggtttagatcgagccaaaactttcctaaatggcttaggtatcgattacccaagcatacactatgctaacgccatttcaagtaatacaacagaatctaacaaacattacggtgcaagtagtgaaaaaatggctgctgcttatgccgcctttgctaatggtggtatttaccacaaaccaatgtatatcaataaaatcgtctttagtgatggtagtgagaaagaattttctgatgctggtacacgagctatgaaagaaactactgcctatatgatgaccgaaatgatgaaaactgttttagcttacggaaccggacgtggtgcttacctaccatggcttccacaagcaggtaagacaggtacttctaactatactgatgacgaaatcgaaaaacatatcaagaatactggctacgtagctccagatgaaatgtttgtaggctatactcgtaagtattctatggctgtatggactggttactcaaatcgtttaactccaattgttggagatggtttcctagttgctgctaaggtttatcgctcaatgatatcgtatctatcagaagatgaccaacctggagattggacgatgccagacggcctgttccgaaatggagaattcgtatttaaaaatggtgctcgttctacgtggaactcacctgctccacaacaacccccatcaactgaaagttcaagctcatcatcagatagttcaacttcacagtctagctcaaccactccaagcacaaataatagtacgactaccaatcctaacaataatacgcaacaatcaaatacaacccctgatcaacaaaatcagaatcctcaaccagcac

SEQ ID NO: 2053 - DNA, 930 bp, Streptococcus pneumoniae
  strain 17619
ctgtgggatatttacaatacagacgaatacgttgcctatccagacgatgaattgcaagtcgcttctaccattgttgatgtttctaacggtaaagtcattgcccagctaggagcacgccatcagtcaagtaatgtttccttcggaattaaccaagcagtagaaacaaaccgcgactggggatcaactatgaaaccgatcacagactatgctcctgccttggagtacggtgtctacgattcaactgctactatcgttcacgatgagccctataactaccctgggacaaatactcctgtttataactgggataggggctactttggcaacatcaccttgcaatacgccctgcaacaatcgcgaaacgtcccagccgtggaaactctaaacaaggtcggactcaaccgcgccaagactttcctaaatggtctcggaatcgactacccaagtattcactactcaaatgccatttcaagtaacacaaccgaatcagacaaaaaatatggagcaagtagtgaaaagatggctgctgcttacgctgcctttgcaaatggtggaacttactataaaccaatgtatatccataaagtcgtctttagtgatgggagtgaaaaagagttctctaatgtcggaactcgtgccatgaaggaaacgacagcctatatgatgaccgaaatgatgaaaacagtcttgagttatggaactggacgaaatgcctatcttgcttggcttcctcaagctggtaaaacaggtacctctaactatacagatgaagaaattgaaaaacacatcaaaaacactggctatgtagctccagatgaaacgtttgttggttatactcgtaagtattctatggctgtatggacaggttacacaaaccgtctcacaccaattgtgggggatggcttcacagttgctgccaaagtttaccgc

SEQ ID NO: 2054 - DNA, 306 bp, Streptococcus pneumoniae
  strain R6
cgtcgcattctctacggaatgaatgaattgggtgtgaccccagacaaaccccataaaaaatctgctcgtattacaggggatgtcatgggtaaataccacccacacggggattcctctatttatgaagccatggtccgtatggctcaatggtggagctaccgttacatgcttgtagatggtcatgggaattttggttccatggatggagatagtgctgccgctcaacgttataccgaggcacgtatgagcaagattgctctggaaatgcttcgtgatatcaacaaaaatacagttgatttcgttgat

SEQ ID NO: 2055 - DNA, 2472 bp, Streptococcus pneumoniae
  strain 7785
atgtctaacattcaaaacatgtccctggaggacatcatgggagagcgctttggtcgctactccaagtacattattcaagaccgggctttgccagatattcgtgatgggttgaagccggttcagcgccgtattctttattctatgaataaggatagcaatacttttgacaagagctaccgtaagtcggccaagtcagtcgggaacatcatggggaatttccacccacacggggattcttctatctatgatgccatggttcgtatgtcacagaactggaaaaatcgtgagattctagttgaaatgcacggtaataacggttctatggacggagatcctcctgcggctatgcgttatactgaggcacgtttgtctgaaattgcaggctaccttcttcaggatatcgagaaaaagacagttccttttgcatggaactttgacgatacggagaaagaaccaacggtcttgccagcagcctttccaaacctcttggtcaatggttcgactgggatttcggctggttatgccacagacattcctccccataatttagctgaggtcatagatgctgcagtttacatgattgaccacccaactgcaaagattgataaactcatggaattcttacctggaccagacttccctacaggggctattattcagggtcgtgatgaaatcaagaaagcttatgagactgggaaagggcgcgtggttgttcgttccaagactgaaattgaaaagctaaaaggtggtaaggaacaaatcgttattactgagattccttatgaaatcaataaggccaatctagtcaagaaaatcgatgatgttcgtgttaataacaaggtagctgggattgctgaggttcgtgatgagtctgaccgtgatggtcttcgtatcgctatcgaacttaagaaagacgctaatactgagcttgttctcaactacttatttaagtacaccgacctacaaatcaactacaactttaatatggtggcgattgacaatttcacacctcgtcaggttgggattgttccaatcctgtctagctacatcgctcaccgtcgagaagtgattttggcgcgttcacgctttgacaaagaaaaggctgagaaacgtctccatatcgtcgaaggtttgattcgtgtgatttcgattttggatgaagtcattgctcttatccgtgcttctgagaataaggcggacgccaaggaaaacctcaaagttagctatgattttacggaagaacaggctgaggctatcgtaactttgcaactgtaccgtttgaccaataccgatgtggttgtcttgcaggaagaagaagcagagcttcgtgagaagattgctatgctggcggctattatcggtgatgaaaggactatgtacaatctcatgaagaaagaacttcgtgaggtcaagaagaaatttgcaactcctcgtttgagttctttagaagacactgcgaaagcaattgagattgatacagctagtcttatcgctgaggaagatacctacgtcagcgtgaccaaggcaggttacatcaagcgtaccagtccacgttcctttgcggcttccaccttggaagaaattggcaagcgtgatgatgaccgtttgatttttgttcaatctgccaagacaacccagcacctcttgatgttcacaagtcttggaaatgtcatctacagaccaatccatgagttggcagatattcgttggaaggacatcggagagcatctgagccaaaccatcacaaactttgaaacgaatgaagaaatcctttatgtggaagtactggatcagtttgacgatgcgacaacctactttgcagtgactcgccttggtcaaatcaaacgggtagagcgaaaagaattcactccatggcggacctatagatctaagtctgtcaagtatgctaagctcaaagacgatacagatcagattgtagcagtggctccgattaaactagatgatgttgtcttggttagtcaaaatggttatgccctgcgtttcaatatcgaagaggttccggttgtcggtgctaaggcagcaggtgtcaaggctatgaatttgaaagaagatgatgtcctccaatctggctttatctgtaatacttcgtccttctacctcttgacccagcgtggaagcttgaaacgtgtttctattgaggaaattctagcaaccagccgtgccaaacgaggattacaagtcttgcgtgagttgaaaaacaaaccgcatcgtgtcttcttggcaggagcagttgcagagcaaggatttgttggcgatttcttcagtacggaagtggatgtgaacgaccaaactctgcttgtccaatccaataaaggaacaatctatgaaagccgattgcaagacttgaacttgtcagaacgcactagcaatggaagcttcatttctgacacgatttcagatgaagaagtttttgacgcttatcttcaggaagtagttactgaagataaataa

SEQ ID NO: 2056 - DNA, 1212 bp, Streptococcus pneumoniae
  strain StrR-16
aagctcaaaaacatctgtgggatatctacaactccgatcaatacgtctcttaccctgacgatgatttgcaagtcgcatctacggtcgtagatgtttcaaatggtaaagtcattgcccaacttggagctcgtcaccaagcaagtaacgtttcatttggcaccaaccaagctgtggaaaccaatcgtgactggggttcaacaatgaaaccaatcacagactatgctcctgccttggaatacggtgtctacgattcaactgctactatcgttcacgatgagccctataactatcctgggacagatacccctgtctataactgggataggggctactttggcaatatcaccttgcaatacgccctgcaacaatcgcgaaacgtcccagccgtggaaacactaaacaaggtcgggctcaaccgcgccaagacttttctaaatggtctcggaatcgactacccaagtattcactactcaaatgccatttcaagtaacacaaccgagtcagacaaaaaatatggagcaagtagtgaaaagatggctgctgcttacgctgcctttgcaaatggtggaacttactataaaccaatgtatatccataaagtcgtctttagtgatggaagtgaaaaagagttctctaatgtcggaactcgcgccatgaaagaaacgactgcttacatgatgacagaaatgatgaaaacagtcttgacgtacggaattggtcgtggtgcctacctgccttggcttcctcaagctggtaaaacaggtacttctaactatactgacgaagaaattgaaaagtatatcaagaacactggttacgtaactccagatgaaatgtttgtagggtatacccgtaaatatgcaatggctgtatggacaggctattctaaccgtctgacaccacttgtaggcgatggccttacggtcgctgccaaggtttaccgctctatgatgacctacctgtctgaaggaagcaatccagaggattggaatataccagaggggctctacagaaatggagaattcgtatttaaaaatggtgctcgttctacgtggagctcacctgctccacaacaacccccatcaactgaaagttcaagctcatcatcagatagttcaacttcacagtctagctcaaccactccaagcacaaataatagtacgactaccaatcctaacaataatacgcaacaatcaaatacaacccctgatc

SEQ ID NO: 2057 - DNA, 1242 bp, Streptococcus pneumoniae
  strain StrR-17
atgtagaccaagaagctcaaaaacatctgtgggatatttacaatacagacgaatacgttgcctatccagacgatgaattgcaagtcgcttctaccattgttgatgtttctaacgggaaagttattgctcagttaggttctcgtcaccaatcaagcaatgtttccttcggaatcaaccaagctgttgaaaccaaccgtgactggggttctgccatgaagccaatcacagactatgctcctgccttagagtatgacatctacgactcaactgcttcgattgtacatgatgttccttataactatccaggtactgatactcccctctacaactgggataaagtctactttggaaatattacaatccagtatgcacttcaacagtcacgtaatgtcacagccgttgagactttgaataaggtcggtctagatagagctaaaacctttcttaatggtcttggtatcgactatccaagcatgcattatgcaaacgccatttcaagtaatacgactgagtcaaacaaaaagtacggagcaagtagtgagaaaatggctgctgcttacgctgcttttgctaacggtggtatctaccataaaccaatgtatatcaacaaaatcgtctttagcgatggtagctcaaaagaatacgctgatcctggtactcgtgccatgaaagagacgaccgcctatatgatgacagaaatgatgaagactgtcttggcatacggaacgggtcgtggtgcttatctcccttggctacctcaagctggtaagactggtacatcaaactatacagatgatgaaattgaaaactacatcaaaaatactggttatgtagctccagacgaaatgtttgttggttatactcgcaaatattcaatggcggtatggacaggttactcaaaccgcctgactcctatcgttggtgatggcttctatgttgcagctaaggtttaccgttcaatgatgacttatctgtctgaggataacaaccctggcgactggactatgccagaaggtctctatcgaagtggtgagttcgtctttaaaaaaggtgctcgttctgcatggactgctcctgctccgcaacaggccccaacaccagaaagttcgagctcgacatcagaaagttcaacttcacagtcaagctcaactactccaagcacgaataatagtgcaaacaataataccaataaccagcaaccaaatacaacgcctggtcaacaaaaccagaaccaaaatcaga

SEQ ID NO: 2058 - DNA, 1225 bp, Streptococcus pneumoniae
  strain StrR-18
gaagctcaaaaacatctgtgggatatttacaatacagacgaatacgttgcctatccagacgatgaattgcaagtcgcttctaccattgttgatgtttctaacgggaaagttattgctcagttaggttctcgtcaccaatcaagcaatgtttccttcggaatcaaccaagctgttgaaaccaaccgtgactggggttctgccatgaagccaatcacagactatgctcctgccttagagtatgacatctacgactcaactgcttcgattgtacatgatgttccttataactatccaggtactgatactcccctctacaactgggataaagtctactttggaaatattacaatccagtatgcacttcaacagtcacgtaatgtcacagccgttgagactttgaataaggtcggtctagatagagctaaaacctttcttaatggtcttggtatcgactatccaagcatgcattatgcaaacgccatttcaagtaatacgactgagtcaaacaaaaagtacggagcaagtagtgagaaaatggctgctgcttacgctgcttttgctaacggtggtatctaccataaaccaatgtatatcaacaaaatcgtctttagcgatggtagctcaaaagaatacgctgatcctggtactcgtgccatgaaagagacgaccgcctatatgatgacagaaatgatgaagactgtcttggcatacggaacgggtcgtggtgcttatctcccttggctacctcaagctggtaagactggtacatcaaactatacagatgatgaaattgaaaactacatcaaaaatactggttatgtagctccagacgaaatgtttgttggttatactcgcaaatattcaatggcggtatggacaggttactcaaaccgcctgactcctatcgttggtgatggcttctatgttgcagctaaggtttaccgttcaatgatgacttatctgtctgaggataacaaccctggcgactggactatgccagaaggtctctatcgaagtggtgagttcgtctttaaaaaaggtgctcgttctgcatggactgctcctgctccgcaacaggccccaacaccagaaagttcgagctcgacatcagaaagttcaacttcacagtcaagctcaactactccaagcacgaataatagtgcaaacaataataccaataaccagcaaccaaatacaacgcctggtcaacaaaaccagaaccaaa

SEQ ID NO: 2059 - DNA, 554 bp, Streptococcus pneumoniae
  strain StrR-38
tggctactttggaaacattacagtccagtatgctcttcaacaatcacgaaatgtcacagccgttgagactttgaataaggtcggtctagatagagctaaaaccttcctcaatggacttggtatcgattatccaagcatgctttatgcaaacgccatttcaagtaacacaactgaatccaacaaaaagtacggagcaagtagtgaaaaaatggccgctgcctacgcagcttttgctaatggtggtacttaccacaaaccaatgtatatcaataaaatcgtctttagtgatggtagtgaaaaagaattttctgatgccggtactcgggctatgaaagaaactactgcctatatgatgaccgaaatgatgaaaactgtcttattatacggaaccggacgtggagcctacctaccttggcttccacaagcaggtaagacaggtacttctaactatactgacgaagaaattgaaaagtatatcaagaatgctggttacgtagctccagatgaaatgtttgttggttatacccgcaaatatgcaatggctgtttggacag

SEQ ID NO: 2060 - DNA, 1249 bp, Streptococcus pneumoniae
  strain StrR-57
caactgggatggatgtctacacaaatgtagaccaagaagctcaaaaacatctgtgggatatttacaatacagacgaatacgttgcctatccagacgatgaattgcaagtcgcttctaccattgttgatgtttctaacggtaaagtcattgcccagctaggagcacgccatcagtcaagtaatgtttccttcggaattaaccaagcagtagaaacaaaccgcgactggggatcaactatgaaaccgatcacagactatgctcctgccttggagtacggtgtctacgattcaactgctactatcgttcacgatgagccctataactaccctgggacaaatactcctgtttataactgggataggggctactttggcaacatcaccttgcaatacgccctgcaacaatcgcgaaacgtcccagccgtggaaactctaaacaaggtcggactcaaccgcgccaagactttcctaaatggtctaggaatcgactacccaagtattcactactcaaatgccatttcaagtaacacaaccgaatcagacaaaaaatatggagcaagtagtgaaaagatggctgctgcttacgctgcctttgcaaatggtggaacttactataaaccaatgtatatccataaagtcgtctttagtgatgggagtgaaaaagagttctctaatgtcggaactcgtgccatgaaggaaacgacagcctatatgatgaccgacatgatgaaaacagtcttgacttatggaactggacgaaatgcctatcttgcttggctccctcaggctggtaaaacaggaacctctaactatacagacgaggaaattgaaaaccacatcaagacctctcaatttgtagcacctgatgaactatttgctggctatacgcgtaaatattcaatggctgtatggacaggctattctaaccgtctgacaccacttgtaggcaatggccttacggtcgctgccaaagtttaccgctctatgatgacctacctgtctgaaggaagcaatccagaagattggaatataccagaggggctctacagaaatggagaattcgtatttaaaaatggtgctcgttctacgtggagctcacctgctccacaacaacccccatcaactgaaagttcaagctcatcatcagatagttcaacttcacagtctagctcaaccactccaagcacaaataatagtacgactaccaatcctaacaataatacgcaacaatcaaatacaacccctgatca

SEQ ID NO: 2061 - DNA, 579 bp, Streptococcus pneumoniae
  strain StrR-60
gaagttgaacagactggtcaccaagctccttcatatccgccaacactgcaattttcttgccaccttcattggctggaatggcagagaaagtctctaaaatcagtttcatagcagttggattggcattataaacatctgacaggatatctgctccattggctgctttcttccactcggtacggttacgcgtcaattcaagatgttggaaggccaaacgaatttgctcctctgaaactccttcttgcaaggcaacataggatgcaatcatagcatttgtcgcattgtacttgccagttactggcaaatcaagggcttgctctaagaaattgaccttgaaggtcagactatctttgcgctcaaccaagtcggtaattcccagctctgctccttgaccaaaacgaaccacctttttatcagttggcaaatagtcctctacgatagggtcagccggcgctaaaagcaaggaacctgaagccattccgtctgcaatttgcatttttcctttagcaatctcagaacggtctttgaaaaaggccaaatgagcttctccaaccaaggtcacgatggctgtatggacag

SEQ ID NO: 2062 - DNA, 1216 bp, Streptococcus pneumoniae
  strain StrR-63
aagctcaaaaacatctgtgggatatctacaactccgatcaatacgtctcttaccctgacgatgatttgcaagtcgcatctacggtcgtagatgtttcaaatggtaaagtcatcgcacaacttggtgctcgtcatcaagcaagtaatgtttcattcggtaccaaccaggccgtagaaaccaatcgtgactggggatcatcaatgaaaccaatcactgactatgctcccgctttagaatatggagtctatgactctactgcttctattgtacatgatgtcccttataactatcctggcactgatactccactctacaactgggatcatgtctactttggaaacattacaatccagtatgctcttcaacaatcacgaaatgtcacagccgttgagactttgaataaggtcggtctagatagagctaaaaccttccttaatggtcttggtatcgactatccaagcatgcattatgcaaacgccatttcaagtaacacaactgaatccaacaaaaaatatggtgcaagtagtgaaaaaatggctgctgcctacgctgcttttgctaatggtggtatttatcacaaaccaatgtatatcaataaaatcgtctttagtgatggtagcgaaaaagaattttctgatgctggtacacgagctatgaaagagactactgcctatatgatgactgaaatgatgaaaactgttttaacttacggaacaggacgtggagcctacctaccatggcttccacaagcaggtaagacaggtacttctaactatactgacgaagaaattgaaaagtatatcaagaacactggttacgtagctccagatgaaatgtttgtagggtatacccgtaaatatgcaatggctgtttggacaggatactcaaatcgtctaactccaatcatcggagatggtttccttgttgctggtaaagtctatcgttcaatgataacttacctttctgaagatgaccaacctggagattggacaatgccagatggcttgtatagaaatggagaattcgtatttaaaaatggtgctcgttctacgtggagctcacctgctccacaacaacccccatcaactgaaagttcaagctcatcatcagatagttcaacttcacagtctagctcaaccactccaagcacaaataatagtacgactaccaatcctaacaataatacgcaacaatcaaatacaacccctgatcaaca

SEQ ID NO: 2063 - DNA, 810 bp, Streptococcus pneumoniae
  ref <308>: DATABASE ACCESSION NUMBER: ATCC 700673
aatacgtctcttaccctgacgatgatttgcaagtcgcatccacggtcgtagatgtttcaaatggtaaagtcatcgcccaacttggagctcgtcaccaagcaagtaacgtttcatttggtaccaaccaagctgtggaaaccaatcgtgactggggttcaacaatgaaacccatcaccgattatgcacctgccatagaatacggtgtatatgattccactgcaactatggttaatgatattccttataactatccgggaacaagcacacctgtctacaactgggatcgagcatattttggtaatattactctgcaatatgcccttcaacaatctcgtaacgtacccgccgttgagacactaaacaaggttggtttagatagagctaaaagtttcctaaatggtttaggaatcgactatcctgtaatgcactattcaaatgctatttcaagtaatactaccgaatctagtaaacagtacggggcaagtagtgaaaaaatggccactgcctatgccgcattcgcaaacggcggtatttaccacaaaccaatgtacatcaataaggttgtctttagcgatggtagcgaaaaagaattttctgaccctggcacaagagccatgaaagaaacgactgcttacatgatgacagagatgatgaaaacagtctggacttacggaactggtcgcggtgcctacctaccttggcttccacaagcaggtaaaacaggtacttctaactatactgacgaagaaattgaaaagtatatcaagaacactggttacgtagctccagatgaaatgtttgtagggtata

SEQ ID NO: 2064 - DNA, 782 bp, Streptococcus pneumoniae
  ref <308>: DATABASE ACCESSION NUMBER: ATCC 700678
tcttaccctgacgatgatttgcaagtcgcatctacggtcgtagatgtttcaaatggtaaagtcatcgcccaacttggagctcgtcaccaagcaagtaacgtttcatttggtaccaaccaagctgtggaaaccaatcgtgactggggatcaactatgaaaccaatcacagactatgctcctgccttggagtacggtgtctacgattcaactgctactatcgttcacgatgagccctataactaccctgggacagatatccctctctataactgggatcgagcatatttcggtaatattactctgcaatatgcccttcaacaatctcgtaacgtacctgccgttgaaacactaaacaaggtcggtctagataaggctaaaaccttccttaatggtcttggtatcgactatccaagcatgcattatgcaaacgccatttcaagtaatacaactgaatccaacaaaaaatatggtgcaagtagtgaaaaaatagctaccgcctatgccgcattcgcaaatggtggtatttaccacaaaccaatgtacatcaataaagttgtctttagcgatggtagcgaaaaagaattttctgaccctggcacaagagccatgaaagaaacgactgcttacatgatgacagaaatgatgaaaacagtctggacgtacggaactggtcgtggtgcctacctgccttggcttcctcaagctggtaaaacaggtacctctaactatactgacgaagaaattgaaaagtatatcaagaacactggttacgtagctccaga

SEQ ID NO: 2065 - DNA, 22 bp, Artificial Sequence
  Synthetic DNA Sequence
ccaggacgtggaggcgatcaca

SEQ ID NO: 2066 - DNA, 22 bp, Artificial Sequence
  Synthetic DNA Sequence
caccgacagcgagccgatcaga

SEQ ID NO: 2067 - DNA, 18 bp, Artificial Sequence
  Synthetic DNA Sequence
agctgagccaattcatgg

SEQ ID NO: 2068 - DNA, 19 bp, Artificial Sequence
  Synthetic DNA Sequence
attcatggaccagaacaac

SEQ ID NO: 2069 - DNA, 18 bp, Artificial Sequence
  Synthetic DNA Sequence
cgctgtcggggttgaccc

SEQ ID NO: 2070 - DNA, 18 bp, Artificial Sequence
  Synthetic DNA Sequence
gttgacccacaagcgccg

SEQ ID NO: 2071 - DNA, 18 bp, Artificial Sequence
  Synthetic DNA Sequence
cgactgtcggcgctgggg

SEQ ID NO: 2072 - DNA, 3534 bp, Mycobacterium tuberculosis
  strain Rv
gtgctggaaggatgcatcttggcagattcccgccagagcaaaacagccgctagtcctagtccgagtcgcccgcaaagttcctcgaataactccgtacccggagcgccaaaccgggtctccttcgctaagctgcgcgaaccacttgaggttccgggactccttgacgtccagaccgattcgttcgagtggctgatcggttcgccgcgctggcgcgaatccgccgccgagcggggtgatgtcaacccagtgggtggcctggaagaggtgctctacgagctgtctccgatcgaggacttctccgggtcgatgtcgttgtcgttctctgaccctcgtttcgacgatgtcaaggcacccgtcgacgagtgcaaagacaaggacatgacgtacgcggctccactgttcgtcaccgccgagttcatcaacaacaacaccggtgagatcaagagtcagacggtgttcatgggtgacttcccgatgatgaccgagaagggcacgttcatcatcaacgggaccgagcgtgtggtggtcagccagctggtgcggtcgcccggggtgtacttcgacgagaccattgacaagtccaccgacaagacgctgcacagcgtcaaggtgatcccgagccgcggcgcgtggctcgagtttgacgtcgacaagcgcgacaccgtcggcgtgcgcatcgaccgcaaacgccggcaaccggtcaccgtgctgctcaaggcgctgggctggaccagcgagcagattgtcgagcggttcgggttctccgagatcatgcgatcgacgctggagaaggacaacaccgtcggcaccgacgaggcgctgttggacatctaccgcaagctgcgtccgggcgagcccccgaccaaagagtcagcgcagacgctgttggaaaacttgttcttcaaggagaagcgctacgacctggcccgcgtcggtcgctataaggtcaacaagaagctcgggctgcatgtcggcgagcccatcacgtcgtcgacgctgaccgaagaagacgtcgtggccaccatcgaatatctggtccgcttgcacgagggtcagaccacgatgaccgttccgggcggcgtcgaggtgccggtggaaaccgacgacatcgaccacttcggcaaccgccgcctgcgtacggtcggcgagctgatccaaaaccagatccgggtcggcatgtcgcggatggagcgggtggtccgggagcggatgaccacccaggacgtggaggcgatcacaccgcagacgttgatcaacatccggccggtggtcgccgcgatcaaggagttcttcggcaccagccagctgagccaattcatggaccagaacaacccgctgtcggggttgacccacaagcgccgactgtcggcgctggggcccggcggtctgtcacgtgagcgtgccgggctggaggtccgcgacgtgcacccgtcgcactacggccggatgtgcccgatcgaaacccctgaggggcccaacatcggtctgatcggctcgctgtcggtgtacgcgcgggtcaacccgttcgggttcatcgaaacgccgtaccgcaaggtggtcgacggcgtggttagcgacgagatcgtgtacctgaccgccgacgaggaggaccgccacgtggtggcacaggccaattcgccgatcgatgcggacggtcgcttcgtcgagccgcgcgtgctggtccgccgcaaggcgggcgaggtggagtacgtgccctcgtctgaggtggactacatggacgtctcgccccgccagatggtgtcggtggccaccgcgatgattcccttcctggagcacgacgacgccaaccgtgccctcatgggggcaaacatgcagcgccaggcggtgccgctggtccgtagcgaggccccgctggtgggcaccgggatggagctgcgcgcggcgatcgacgcggcgacgtcgtcgtcgcaagaaagcggcgtcatcgaggaggtgtcggccgactacatcactgtgatgcacgacaacggcacccggcgtacctaccggatgcgcaagtttgcccggtccaaccacggcacttgcgccaaccagtgccccatcgtggacgcgggcgaccgagtcgaggccggtcaggtgatcgccgacggtccctgtactgacgacggcgagatggcgctgggcaagaacctgctggtggccatcatgccgtgggagggccacaactacgaggacgcgatcatcctgtccaaccgcctggtcgaagaggacgtgctcacctcgatccacatcgaggagcatgagatcgatgctcgcgacaccaagctgggtgcggaggagatcacccgcgacatcccgaacatctccgacgaggtgctcgccgacctggatgagcggggcatcgtgcgcatcggtgccgaggttcgcgacggggacatcctggtcggcaaggtcaccccgaagggtgagaccgagctgacgccggaggagcggctgctgcgtgccatcttcggtgagaaggcccgcgaggtgcgcgacacttcgctgaaggtgccgcacggcgaatccggcaaggtgatcggcattcgggtgttttcccgcgaggacgaggacgagttgccggccggtgtcaacgagctggtgcgtgtgtatgtggctcagaaacgcaagatctccgacggtgacaagctggccggccggcacggcaacaagggcgtgatcggcaagatcctgccggttgaggacatgccgttccttgccgacggcaccccggtggacattattttgaacacccacggcgtgccgcgacggatgaacatcggccagattttggagacccacctgggttggtgtgcccacagcggctggaaggtcgacgccgccaagggggttccggactgggccgccaggctgcccgacgaactgctcgaggcgcatgcgaacgccattgtgtcgacgccggtgttcgacggcgcccaggaggccgagctgcagggcctgttgtcgtgcacgctgcccaaccgcgacggtgacgtgctggtcgacgccgacggcaaggccatgctcttcgacgggcgcagcggcgagccgttcccgtacccggtcacggttggctacatgtacatcatgaagctgcaccacctggtggacgacaagatccacgcccgctccaccgggccgtactcgatgatcacccagcagccgctgggcggtaaggcgcagttcggtggccagcggttcggggagatggagtgctgggccatgcaggcctacggtgctgcctacaccctgcaggagctgttgaccatcaagtccgatgacaccgtcggccgcgtcaaggtgtacgaggcgatcgtcaagggtgagaacatcccggagccgggcatccccgagtcgttcaaggtgctgctcaaagaactgcagtcgctgtgcctcaacgtcgaggtgctatcgagtgacggtgcggcgatcgaactgcgcgaaggtgaggacgaggacctggagcgggccgcggccaacctgggaatcaatctgtcccgcaacgaatccgcaagtttcgaggatcttgcgtaa

SEQ ID NO: 2073 - DNA, 38 bp, Artificial Sequence
  Synthetic DNA Sequence
ccgagcaacatgattgaaccatccaccaactggctcgg

SEQ ID NO: 2074 - DNA, 38 bp, Artificial Sequence
  Synthetic DNA Sequence
ccgagcaacatgattgaagcttccaccaactggctcgg

SEQ ID NO: 2075 - DNA, 41 bp, Artificial Sequence
  Synthetic DNA Sequence
ccgagccaggttctgaagtctctgcattattaggtgctcgg

SEQ ID NO: 2076 - DNA, 39 bp, Artificial Sequence
  Synthetic DNA Sequence
ccgagcygayaacattttcagattcacccargcgctcgg

SEQ ID NO: 2077 - DNA, 33 bp, Artificial Sequence
  Synthetic DNA Sequence
ccgagcaaccgatccagctccagctacgctcgg

SEQ ID NO: 2078 - DNA, 34 bp, Artificial Sequence
  Synthetic DNA Sequence
ccgagccttggtcttcggccaaatgaacgctcgg

SEQ ID NO: 2079 - DNA, 36 bp, Artificial Sequence
  Synthetic DNA Sequence
ccgagcgttcagttacttcagtccaagccggctcgg

SEQ ID NO: 2080 - DNA, 31 bp, Artificial Sequence
  Synthetic DNA Sequence
ccgagccgaagagggccaagatgtcgctcgg

SEQ ID NO: 2081 - DNA, 24 bp, Artificial Sequence
  Synthetic DNA Sequence
gratyrtyaaagttggtgaggaag

SEQ ID NO: 2082 - DNA, 22 bp, Artificial Sequence
  Synthetic DNA Sequence
cmacttcatcycgcttcgtacc

SEQ ID NO: 2083 - DNA, 44 bp, Artificial Sequence
  Synthetic DNA Sequence
  modified_base (27): i
ccgccgatgttccgtaaattacttgangaaggtcgagccggcgg

SEQ ID NO: 2084 - DNA, 38 bp, Artificial Sequence
  Synthetic DNA Sequence
cacgcgtcaacacccgtacaagtcgtcttttgcgcgtg

SEQ ID NO: 2085 - DNA, 24 bp, Artificial Sequence
  Synthetic DNA Sequence
caaactaaagaacatatcttgcta

SEQ ID NO: 2086 - DNA, 23 bp, Artificial Sequence
  Synthetic DNA Sequence
atataatttgcatcaccttcaag

SEQ ID NO: 2087 - DNA, 22 bp, Artificial Sequence
  Synthetic DNA Sequence
tcagctcgtgggattaggagag

SEQ ID NO: 2088 - DNA, 22 bp, Artificial Sequence
  Synthetic DNA Sequence
aggcttcacgctgttaggctga

SEQ ID NO: 2089 - DNA, 20 bp, Artificial Sequence
  Synthetic DNA Sequence
atgctgaacttattgacctt

SEQ ID NO: 2090 - DNA, 19 bp, Artificial Sequence
  Synthetic DNA Sequence
cgttactggagtcgaaatg

SEQ ID NO: 2091 - DNA, 39 bp, Artificial Sequence
  Synthetic DNA Sequence
cgcgacttgagatggaacttagtgagcttcttggtcgcg

SEQ ID NO: 2092 - DNA, 38 bp, Artificial Sequence
  Synthetic DNA Sequence
cgcgacgaaagaacttcctgaaggtcgtgcaggtccag

SEQ ID NO: 2093 - DNA, 20 bp, Artificial Sequence
  Synthetic DNA Sequence
tgttggcaatcgaagacacc

SEQ ID NO: 2094 - DNA, 24 bp, Artificial Sequence
  Synthetic DNA Sequence
ttcaatttcttgacctactttcaa

SEQ ID NO: 2095 - DNA, 18 bp, Artificial Sequence
  Synthetic DNA Sequence
cggtcgggttgaacgtgg

SEQ ID NO: 2096 - DNA, 34 bp, Artificial Sequence
  Synthetic DNA Sequence
cgcgaccggtaccacggccagtaatcgtgtcgcg

SEQ ID NO: 2097 - DNA, 1185 bp, Mycoplasma pneumoniae
  ref <308>: DATABASE ACCESSION NUMBER: ATCC 29342
atggcaagagagaaatttgaccgatctaaaccccacgttaatgtaggtactattggccacattgaccacggtaaaacaactttaacagcagctatttgtactgtattagcaaaagaaggtaaatcagctgctactcgttacgaccaaatcgataaggctccggaagaaaaagcacggggaattacgattaactccgctcacgtggagtactcctctgacaagcgtcactatgctcacgttgactgtccaggacacgctgactacattaagaacatgattactggtgctgcacaaatggatggtgccattctagtagtttcagcaactgacagtgttatgccccaaacccgtgaacacattttgttggcccgccaagtgggtgtgccacgcatggtagtgttcctaaacaagtgtgacattgcaactgatgaagaagtgcaagagttagtagcagaagaggtacgtgacttattaacttcttacggctttgatggcaagaacacccctattatttatggttctgcacttaaagcgcttgaaggtgatcctaagtgggaagctaagatccatgatttaatgaatgcagttgatgaatggattccaactcctgaacgtgaagtggacaaacccttcttgttggcaatcgaagacaccatgacgattactggccgtggtaccgtggttaccggtcgggttgaacgtggtgaattgaaagtaggtcaagaaattgaaatcgttggtttacgtccaatccgtaaagcagttgttaccggaatcgaaatgttcaaaaaggaacttgattcagcaatggctggggacaacgctggggtattactccgtggtgtggaccgtaaagaagtggaacgtggtcaagtgttagctaaaccaggttcgattaaaccgcacaagaaatttaaagcggaaatctatgctttaaagaaggaagaaggtggtcgtcacaccggtttcttaaacggttaccgtccccaattctacttccgtactacagacgttactggttcgatttccctaccagaaaacaccgaaatggtgctaccaggtgacaatacctcgattacagttgaactaattgcaccaattgcttgtgaaaaaggtagtaagttctccatccgtgaaggtggtcgaacggttggtgctggttcagtcacggaagtgcttgaatag

SEQ ID NO: 2098 - DNA, 22 bp, Artificial Sequence
  Synthetic DNA Sequence
ctgagtcacaccgacaaacgtc

SEQ ID NO: 2099 - DNA, 22 bp, Artificial Sequence
  Synthetic DNA Sequence
ccaggactgaacgggatacgaa

SEQ ID NO: 2100 - DNA, 18 bp, Artificial Sequence
  Synthetic DNA Sequence
gcgagacgataggttgtc

SEQ ID NO: 2101 - DNA, 2609 bp, Mycobacterium tuberculosis
  strain H37Rv
cagcccgcgagcgtaacctggctgcgatttccggcgcggattttcgcagtgcggttacgctcggaaagcgcgggcctcgcccacgcggcggatgatgtcagcggggtggtcctcggcgacgacccggaccacgatccacccgtagcggtgctggactttctcgtgccggaggatgtctttccggtagtggtagcgactggtcagatggtggtcgccgtcatactcggccgcgaccttgatgtcttgccagcccatatccaaatgggcttccgcccagccccattcgttgcgcaccgcgatctgcgtctgggggcgcggaaagccggcgcggatcaacaacaagcgcagccaggtttccttgggggactgggcaccgccgtcgacgaggtccagagcggctcttgcggccttcatgccacggcggccccgatagcgctcgatcagcggctcgacgtcggccaccttcaaatcggtggcctgtatcagggcgtcgacggccgcgacggcggggtccaatggaaatcgactggtcaggtcgagcgccgttcgctccggtgtggtcacgcgcatgccctcgatgacgcagatctcgtcgggctcgatgcgctcttcccagacttgcagccccggggcacggcggcggttggtgtcgatgatcgcggcgggaagatccgcgtcgatccacttggcgccatggaaggcagaagccgagtagccggccagcacgccgcggcggcgcgagcgcagccacagcgcttttgcacgcaattgcgcggtcagttccacaccctgcggcacgtacacgtctttatgtagcgcgacatacctgctgcgcaattcgtagggcgtcaatacacccgcagccagggcctcgctgcccagaaagggatccgtcatggtcgaagtgtgctgagtcacaccgacaaacgtcacgagcgtaaccccagtgcgaaagttcccgccggaaatcgcagccacgttacgctcgtggacataccgatttcggcccggccgcggcgagacgataggttgtcggggtgactgccacagccactgaaggggccaaacccccattcgtatcccgttcagtcctggttaccggaggaaaccgggggatcgggctggcgatcgcacagcggctggctgccgacggccacaaggtggccgtcacccaccgtggatccggagcgccaaaggggctgtttggcgtcgaatgtgacgtcaccgacagcgacgccgtcgatcgcgccttcacggcggtagaagagcaccagggtccggtcgaggtgctggtgtccaacgccggcctatccgcggacgcattcctcatgcggatgaccgaggaaaagttcgagaaggtcatcaacgccaacctcaccggggcgttccgggtggctcaacgggcatcgcgcagcatgcagcgcaacaaattcggtcgaatgatattcataggttcggtctccggcagctggggcatcggcaaccaggccaactacgcagcctccaaggccggagtgattggcatggcccgctcgatcgcccgcgagctgtcgaaggcaaacgtgaccgcgaatgtggtggccccgggctacatcgacaccgatatgacccgcgcgctggatgagcggattcagcagggggcgctgcaatttatcccagcgaagcgggtcggcacccccgccgaggtcgccggggtggtcagcttcctggcttccgaggatgcgagctatatctccggtgcggtcatcccggtcgacggcggcatgggtatgggccactgacacaacacaaggacgcacatgacaggactgctggacggcaaacggattctggttagcggaatcatcaccgactcgtcgatcgcgtttcacatcgcacgggtagcccaggagcagggcgcccagctggtgctcaccgggttcgaccggctgcggctgattcagcgcatcaccgaccggctgccggcaaaggccccgctgctcgaactcgacgtgcaaaacgaggagcacctggccagcttggccggccgggtgaccgaggcgatcggggcgggcaacaagctcgacggggtggtgcattcgattgggttcatgccgcagaccgggatgggcatcaacccgttcttcgacgcgccctacgcggatgtgtccaagggcatccacatctcggcgtattcgtatgcttcgatggccaaggcgctgctgccgatcatgaaccccggaggttccatcgtcggcatggacttcgacccgagccgggcgatgccggcctacaactggatgacggtcgccaagagcgcgttggagtcggtcaacaggttcgtggcgcgcgaggccggcaagtacggtgtgcgttcgaatctcgttgccgcaggccctatccggacgctggcgatgagtgcgatcgtcggcggtgcgctcggcgaggaggccggcgcccagatccagctgctcgaggagggctgggatcagcgcgctccgatcggctggaacatgaaggatgcgacgccggtcgccaagacggtgtgcgcgctgctgtctgactggctgccggcgaccacgggtgacatcatctacgccgacggcggcgcgcacacccaattgctctag

SEQ ID NO: 2102 - DNA, 20 bp, Artificial Sequence
  Synthetic DNA Sequence
caccttcaccctgaccgacg

SEQ ID NO: 2103 - DNA, 23 bp, Artificial Sequence
  Synthetic DNA Sequence
cgaaccagcggaaatagttggac

SEQ ID NO: 2104 - DNA, 18 bp, Artificial Sequence
  Synthetic DNA Sequence
  modified_base (12): i
ctgggcatggcncgagtc

SEQ ID NO: 2105 - DNA, 3297 bp, Mycobacterium tuberculosis
  strain H37Rv
atgacacagtgcgcgagcagacgcaaaagcaccccaaatcgggcgattttgggggcttttgcgtctgctcgcgggacgcgctgggtggccaccatcgccgggctgattggctttgtgttgtcggtggcgacgccgctgctgcccgtcgtgcagaccaccgcgatgctcgactggccacagcgggggcaactgggcagcgtgaccgccccgctgatctcgctgacgccggtcgactttaccgccaccgtgccgtgcgacgtggtgcgcgccatgccacccgcgggcggggtggtgctgggcaccgcacccaagcaaggcaaggacgccaatttgcaggcgttgttcgtcgtcgtcagcgcccagcgcgtggacgtcaccgaccgcaacgtggtgatcttgtccgtgccgcgcgagcaggtgacgtccccgcagtgtcaacgcatcgaggtcacctctacccacgccggcaccttcgccaacttcgtcgggctcaaggacccgtcgggcgcgccgctgcgcagcggcttccccgaccccaacctgcgcccgcagattgtcggggtgttcaccgacctgaccgggcccgcgccgcccgggctggcggtctcggcgaccatcgacacccggttctccacccggccgaccacgctgaaactgctggcgatcatcggggcgatcgtggccaccgtcgtcgcactgatcgcgttgtggcgcctggaccagttggacgggcggggctcaattgcccagctcctcctcaggccgttccggcctgcatcgtcgccgggcggcatgcgccggctgattccggcaagctggcgcaccttcaccctgaccgacgccgtggtgatattcggcttcctgctctggcatgtcatcggcgcgaattcgtcggacgacggctacatcctgggcatggcccgagtcgccgaccacgccggctacatgtccaactatttccgctggttcggcagcccggaggatcccttcggctggtattacaacctgctggcgctgatgacccatgtcagcgacgccagtctgtggatgcgcctgccagacctggccgccgggctagtgtgctggctgctgctgtcgcgtgaggtgctgccccgcctcgggccggcggtggaggccagcaaacccgcctactgggcggcggccatggtcttgctgaccgcgtggatgccgttcaacaacggcctgcggccggagggcatcatcgcgctcggctcgctggtcacctatgtgctgatcgagcggtccatgcggtacagccggctcacaccggcggcgctggccgtcgttaccgccgcattcacactgggtgtgcagcccaccggcctgatcgcggtggccgcgctggtggccggcggccgcccgatgctgcggatcttggtgcgccgycatcgcctggtcggcacgttgccgttggtgtcgccgatgctggccgccggcaccgtcatcctgaccgtggtgttcgccgaccagaccctgtcaacggtgttggaagccaccagggttcgcgccaaaatcgggccgagccaggcgtggtataccgagaacctgcgttactactacctcatcctgcccaccgtcgacggttcgctgtcgcggcgcttcggctttttgatcaccgcgctatgcctgttcaccgcggtgttcatcatgttgcggcgcaagcgaattcccagcgtggcccgcggaccggcgtggcggctgatgggcgtcatcttcggcaccatgttcttcctgatgttcacgcccaccaagtgggtgcaccacttcgggctgttcgccgccgtaggggcggcgatggccgcgctgacgacggtgttggtatccccatcggtgctgcgctggtcgcgcaaccggatggcgttcctggcggcgttattcttcctgctggcgttgtgttgggccaccaccaacggctggtggtatgtctccagctacggtgtgccgttcaacagcgcgatgccgaagatcgacgggatcacagtcagcacaatctttttcgccctgtttgcgatcgccgccggctatgcggcctggctgcacttcgcgccccgcggcgccggcgaagggcggctgatccgcgcgctgacgacagccccggtaccgatcgtggccggtttcatggcggcggtgttcgtcgcgtccatggtggccgggatcgtgcgacagtacccgacctactccaacggctggtccaacgtgcgggcgtttgtcggcggctgcggactggccgacgacgtactcgtcgagcctgataccaatgcgggtttcatgaagccgctggacggcgattcgggttcttggggccccttgggcccgctgggtggagtcaacccggtcggcttcacgcccaacggcgtaccggaacacacggtggccgaggcgatcgtgatgaaacccaaccagcccggcaccgactacgactgggatgcgccgaccaagctgacgagtcctggcatcaatggttctacggtgccgctgccctatgggctcgatcccgcccgggtaccgttggcaggcacctacaccaccggcgcacagcaacagagcacactcgtctcggcgtggtatctcctgcctaagccggacgacgggcatccgctggtcgtggtgaccgccgcgggcaagatcgccggcaacagcgtgctgcacgggtacacccccgggcagactgtggtgctcgaatacgccatgccgggacccggagcgctggtacccgccgggcggatggtgcccgacgacctatacggagagcagcccaaggcgtggcgcaacctgcgcttcgcccgagcaaagatgcccgccgatgccgtcgcggtccgggtggtggccgaggatctgtcgctgacaccggaggactggatcgcggtgaccccgccgcgggtaccggacctgcgctcactgcaggaatatgtgggctcgacgcagccggtgctgctggactgggcggtcggtttggccttcccgtgccagcagccgatgctgcacgccaatggcatcgccgaaatcccgaagttccgcatcacaccggactactcggctaagaagctggacaccgacacgtgggaagacggcactaacggcggcctgctcgggatcaccgacctgttgctgcgggcccacgtcatggccacctacctgtcccgcgactgggcccgcgattggggttccctgcgcaagttcgacaccctggtcgatgcccctcccgcccagctcgagttgggcaccgcgacccgcagcggcctgtggtcaccgggcaagatccgaattggtccatag

SEQ ID NO: 2106 - DNA, 31 bp, Artificial Sequence
  Synthetic DNA Sequence
gcgagcagagcacgccctcctcgccgctcgc

SEQ ID NO: 2107 - DNA, 32 bp, Artificial Sequence
  Synthetic DNA Sequence
gcgagctccccatctctggttggcacgctcgc

SEQ ID NO: 2108 - DNA, 41 bp, Artificial Sequence
  Synthetic DNA Sequence
gcgggcaacttcrtcaagaaggttggttacaacccgcccgc

SEQ ID NO: 2109 - DNA, 38 bp, Artificial Sequence
  Synthetic DNA Sequence
gcgggcccaatctctggttggaayggtgacaagcccgc

SEQ ID NO: 2110 - DNA, 41 bp, Artificial Sequence
  Synthetic DNA Sequence
gcgggcccttaacgatttcagcgaatctggattcagcccgc

SEQ ID NO: 2111 - DNA, 41 bp, Artificial Sequence
  Synthetic DNA Sequence
gcgggcatgattgaagccaccaccaacgcttcctggcccgc

SEQ ID NO: 2112 - DNA, 43 bp, Artificial Sequence
  Synthetic DNA Sequence
gcgggcttgatgaagttttgggtttccttgacaatttgcccgc

SEQ ID NO: 2113 - DNA, 41 bp, Artificial Sequence
  Synthetic DNA Sequence
gcgggcacaagggttggactaaggaaaccaaggcagcccgc

SEQ ID NO: 2114 - DNA, 41 bp, Artificial Sequence
  Synthetic DNA Sequence
gcgggcatcgatgctattgaaccacctgtcagaccgcccgc

SEQ ID NO: 2115 - DNA, 39 bp, Artificial Sequence
  Synthetic DNA Sequence
gcgggcttgatgatttcctcgaatctagattgggcccgc

SEQ ID NO: 2116 - DNA, 39 bp, Artificial Sequence
  Synthetic DNA Sequence
gcgggcggtaagtccaccggtaagaccttgttggcccgc

SEQ ID NO: 2117 - DNA, 36 bp, Artificial Sequence
  Synthetic DNA Sequence
gcgggcgacgccattgagccaccttcgagagcccgc

SEQ ID NO: 2118 - DNA, 42 bp, Artificial Sequence
  Synthetic DNA Sequence
gcgggctccttgacaatttcttcgtatctgttcttggcccgc

SEQ ID NO: 2119 - DNA, 40 bp, Artificial Sequence
  Synthetic DNA Sequence
gcgggcttacaaccctaaggctgttccattcgttgcccgc

SEQ ID NO: 2120 - DNA, 41 bp, Artificial Sequence
  Synthetic DNA Sequence
gcgggcagaaaccaaggctggtaaggttaccggtagcccgc

SEQ ID NO: 2121 - DNA, 31 bp, Artificial Sequence
  Synthetic DNA Sequence
  modified_base (8): i
cgaccgcnagccgcacaccaagttccggtcg

SEQ ID NO: 2122 - DNA, 35 bp, Artificial Sequence
  Synthetic DNA Sequence
ccgagcgaatgtaggagtccagggtctctgctcgg

SEQ ID NO: 2123 - DNA, 19 bp, Artificial Sequence
  Synthetic DNA Sequence
tctaccactgaagcattac

SEQ ID NO: 2124 - DNA, 20 bp, Artificial Sequence
  Synthetic DNA Sequence
taggtactgtaggtttattg

SEQ ID NO: 2125 - DNA, 37 bp, Artificial Sequence
  Synthetic DNA Sequence
cacgcggattttgaatctcttcctctagtagcgcgtg

SEQ ID NO: 2126 - DNA, 18 bp, Artificial Sequence
  Synthetic DNA Sequence
atatcagagactgatgag

SEQ ID NO: 2127 - DNA, 22 bp, Artificial Sequence
  Synthetic DNA Sequence
tagcatattcagagaatattgt

SEQ ID NO: 2128 - DNA, 37 bp, Artificial Sequence
  Synthetic DNA Sequence
caacgctggagaatctatatttgtagaaactgcgttg

SEQ ID NO: 2129 - DNA, 7733 bp, Clostridium difficile
  strain VPI 10463
atgtctttaatatctaaagaagagttaataaaactcgcatatagcattagaccaagagaaaatgagtataaaactatactaactaatttagacgaatataataagttaactacaaacaataatgaaaataaatatttgcaattaaaaaaactaaatgaatcaattgatgtttttatgaataaatataaaacttcaagcagaaatagagcactctctaatctaaaaaaagatatattaaaagaagtaattcttattaaaaattccaatacaagccctgtagaaaaaaatttacattttgtatggataggtggagaagtcagtgatattgctcttgaatacataaaacaatgggctgatattaatgcagaatataatattaaactgtggtatgatagtgaagcattcttagtaaatacactaaaaaaggctatagttgaatcttctaccactgaagcattacagctactagaggaagagattcaaaatcctcaatttgataatatgaaattttacaaaaaaaggatggaatttatatatgatagacaaaaaaggtttataaattattataaatctcaaatcaataaacctacagtacctacaatagatgatattataaagtctcatctagtatctgaatataatagagatgaaactgtattagaatcatatagaacaaattctttgagaaaaataaatagtaatcatgggatagatatcagggctaatagtttgtttacagaacaagagttattaaatatttatagtcaggagttgttaaatcgtggaaatttagctgcagcatctgacatagtaagattattagccctaaaaaattttggcggagtatatttagatgttgatatgcttccaggtattcactctgatttatttaaaacaatatctagacctagctctattggactagaccgttgggaaatgataaaattagaggctattatgaagtataaaaaatatataaataattatacatcagaaaactttgataaacttgatcaacaattaaaagataattttaaactcattatagaaagtaaaagtgaaaaatctgagatattttctaaattagaaaatttaaatgtatctgatcttgaaattaaaatagctttcgctttaggcagtgttataaatcaagccttgatatcaaaacaaggttcatatcttactaacctagtaatagaacaagtaaaaaatagatatcaatttttaaaccaacaccttaacccagccatagagtctgataataacttcacagatactactaaaatttttcatgattcattatttaattcagctaccgcagaaaactctatgtttttaacaaaaatagcaccatacttacaagtaggttttatgccagaagctcgctccacaataagtttaagtggtccaggagcttatgcgtcagcttactatgatttcataaatttacaagaaaatactatagaaaaaactttaaaagcatcagatttaatagaatttaaattcccagaaaataatctatctcaattgacagaacaagaaataaatagtctatggagctttgatcaagcaagtgcaaaatatcaatttgagaaatatgtaagagattatactggtggatctctttctgaagacaatggggtagactttaataaaaatactgccctcgacaaaaactatttattaaataataaaattccatcaaacaatgtagaagaagctggaagtaaaaattatgttcattatatcatacagttacaaggagatgatataagttatgaagcaacatgcaatttattttctaaaaatcctaaaaatagtattattatacaacgaaatatgaatgaaagtgcaaaaagctactttttaagtgatgatggagaatctattttagaattaaataaatataggatacctgaaagattaaaaaataaggaaaaagtaaaagtaacctttattggacatggtaaagatgaattcaacacaagcgaatttgctagattaagtgtagattcactttccaatgagataagttcatttttagataccataaaattagatatatcacctaaaaatgtagaagtaaacttacttggatgtaatatgtttagttatgattttaatgttgaagaaacttatcctgggaagttgctattaagtattatggacaaaattacttccactttacctgatgtaaataaaaattctattactataggagcaaatcaatatgaagtaagaattaatagtgagggaagaaaagaacttctggctcactcaggtaaatggataaataaagaagaagctattatgagcgatttatctagtaaagaatacattttttttgattctatagataataagctaaaagcaaagtccaagaatattccaggattagcatcaatatcagaagatataaaaacattattacttgatgcaagtgttagtcctgatacaaaatttattttaaataatcttaagcttaatattgaatcttctattggggattacatttattatgaaaaattagagcctgttaaaaatataattcacaattctatagatgatttaatagatgagttcaatctacttgaaaatgtatctgatgaattatatgaattaaaaaaattaaataatctagatgagaagtatttaatatcttttgaagatatctcaaaaaataattcaacttactctgtaagatttattaacaaaagtaatggtgagtcagtttatgtagaaacagaaaaagaaattttttcaaaatatagcgaacatattacaaaagaaataagtactataaagaatagtataattacagatgttaatggtaatttattggataatatacagttagatcatacttctcaagttaatacattaaacgcagcattctttattcaatcattaatagattatagtagcaataaagatgtactgaatgatttaagtacctcagttaaggttcaactttatgctcaactatttagtacaggtttaaatactatatatgactctatccaattagtaaatttaatatcaaatgcagtaaatgatactataaatgtactacctacaataacagaggggatacctattgtatctactatattagacggaataaacttaggtgcagcaattaaggaattactagacgaacatgacccattactaaaaaaagaattagaagctaaggtgggtgttttagcaataaatatgtcattatctatagctgcaactgtagcttcaattgttggaataggtgctgaagttactattttcttattacctatagctggtatatctgcaggaataccttcattagttaataatgaattaatattgcatgataaggcaacttcagtggtaaactattttaatcatttgtctgaatctaaaaaatatggccctcttaaaacagaagatgataaaattttagttcctattgatgatttagtaatatcagaaatagattttaataataattcgataaaactaggaacatgtaatatattagcaatggaggggggatcaggacacacagtgactggtaatatagatcactttttctcatctccatctataagttctcatattccttcattatcaatttattctgcaataggtatagaaacagaaaatctagatttttcaaaaaaaataatgatgttacctaatgctccttcaagagtgttttggtgggaaactggagcagttccaggtttaagatcattggaaaatgacggaactagattacttgattcaataagagatttatacccaggtaaattttactggagattctatgcttttttcgattatgcaataactacattaaaaccagtttatgaagacactaatattaaaattaaactagataaagatactagaaacttcataatgccaactataactactaacgaaattagaaacaaattatcttattcatttgatggagcaggaggaacttactctttattattatcttcatatccaatatcaacgaatataaatttatctaaagatgatttatggatatttaatattgataatgaagtaagagaaatatctatagaaaatggtactattaaaaaaggaaagttaataaaagatgttttaagtaaaattgatataaataaaaataaacttattataggcaatcaaacaatagatttttcaggcgatatagataataaagatagatatatattcttgacttgtgagttagatgataaaattagtttaataatagaaataaatcttgttgcaaaatcttatagtttgttattgtctggggataaaaattatttgatatccaatttatctaatactattgagaaaatcaatactttaggcctagatagtaaaaatatagcgtacaattacactgatgaatctaataataaatattttggagctatatctaaaacaagtcaaaaaagcataatacattataaaaaagacagtaaaaatatattagaattttataatgacagtacattagaatttaacagtaaagattttattgctgaagatataaatgtatttatgaaagatgatattaatactataacaggaaaatactatgttgataataatactgataaaagtatagatttctctatttctttagttagtaaaaatcaagtaaaagtaaatggattatatttaaatgaatccgtatactcatcttaccttgattttgtgaaaaattcagatggacaccataatacttctaattttatgaatttatttttggacaatataagtttctggaaattgtttgggtttgaaaatataaattttgtaatcgataaatactttacccttgttggtaaaactaatcttggatatgtagaatttatttgtgacaataataaaaatatagatatatattttggtgaatggaaaacatcgtcatctaaaagcactatatttagcggaaatggtagaaatgttgtagtagagcctatatataatcctgatacgggtgaagatatatctacttcactagatttttcctatgaacctctctatggaatagatagatatataaataaagtattgatagcacctgatttatatacaagtttaataaatattaataccaattattattcaaatgagtactaccctgagattatagttcttaacccaaatacattccacaaaaaagtaaatataaatttagatagttcttcttttgagtataaatggtctacagaaggaagtgactttattttagttagatacttagaagaaagtaataaaaaaatattacaaaaaataagaatcaaaggtatcttatctaatactcaatcatttaataaaatgagtatagattttaaagatattaaaaaactatcattaggatatataatgagtaattttaaatcatttaattctgaaaatgaattagatagagatcatttaggatttaaaataatagataataaaacttattactatgatgaagatagtaaattagttaaaggattaagcaagtaattgacaataataagtattatttcaatcctgacactgctatcatctcaaaaggttggcagactgttaatggtagtagatactactttgatactgataccgctattgcctttaatggttataaaactattgatggtaaacacttttattttgatagtgattgtgtagtgaaaataggtgtgtttagtacctctaatggatttgaatattttgcacctgctaatacttataataataacatagaaggtcaggctatagtttatcaaagtaaattcttaactttgaatggtaaaaaatattactttgataataactcaaaagcagttaccggattgcaaactattgatagtaaaaaatattactttaatactaacactgctgaagcagctactggatggcaaactattgatggtaaaaaatattactttaatactaacactgctgaagcagctactggatggcaaactattgatggtaaaaaatattactttaatactaacactgctatagcttcaactggttatacaattattaatggtaaacatttttattttaatactgatggtattatgcagataggagtgtttaaaggacctaatggatttgaatattttgcacctgctaatacggatgctaacaacatagaaggtcaagctatactttaccaaaatgaattcttaactttgaatggtaaaaaatattactttggtagtgactcaaaagcagttactggatggagaattattaacaataagaaatattactttaatcctaataatgctattgctgcaattcatctatgcactataaataatgacaagtattactttagttatgatggaattcttcaaaatggatatattactattgaaagaaataatttctattttgatgctaataatgaatctaaaatggtaacaggagtatttaaaggacctaatggatttgagtattttgcacctgctaatactcacaataataacatagaaggtcaggctatagtttaccagaacaaattcttaactttgaatggcaaaaaatattattttgataatgactcaaaagcagttactggatggcaaaccattgatggtaaaaaatattactttaatcttaacactgctgaagcagctactggatggcaaactattgatggtaaaaaatattactttaatcttaacactgctgaagcagctactggatggcaaactattgatggtaaaaaatattactttaatactaacactttcatagcctcaactggttatacaagtattaatggtaaacatttttattttaatactgatggtattatgcagataggagtgtttaaaggacctaatggatttgaatactttgcacctgctaatacggatgctaacaacatagaaggtcaagctatactttaccaaaataaattcttaactttgaatggtaaaaaatattactttggtagtgactcaaaagcagttaccggactgcgaactattgatggtaaaaaatattactttaatactaacactgctgttgcagttactggatggcaaactattaatggtaaaaaatactactttaatactaacacttctatagcttcaactggttatacaattattagtggtaaacatttttattttaatactgatggtattatgcagataggagtgtttaaaggacctgatggatttgaatactttgcacctgctaatacagatgctaacaatatagaaggtcaagctatacgttatcaaaatagattcctatatttacatgacaatatatattattttggtaataattcaaaagcggctactggttgggtaactattgatggtaatagatattacttcgagcctaatacagctatgggtgcgaatggttataaaactattgataataaaaatttttactttagaaatggtttacctcagataggagtgtttaaagggtctaatggatttgaatactttgcacctgctaatacggatgctaacaatatagaaggtcaagctatacgttatcaaaatagattcctacatttacttggaaaaatatattactttggtaataattcaaaagcagttactggatggcaaactattaatggtaaagtatattactttatgcctgatactgctatggctgcagctggtggacttttcgagattgatggtgttatatatttctttggtgttgatggagtaaaagcccctgggatatatggctaa

SEQ ID NO: 2130 - DNA, 7101 bp, Clostridium difficile
  strain VPI 10463
atgagtttagttaatagaaaacagttagaaaaaatggcaaatgtaagatttcgtactcaagaagatgaatatgttgcaatattggatgctttagaagaatatcataatatgtcagagaatactgtagtcgaaaaatatttaaaattaaaagatataaatagtttaacagatatttatatagatacatataaaaaatctggtagaaataaagccttaaaaaaatttaaggaatatctagttacagaagtattagagctaaagaataataatttaactccagttgagaaaaatttacattttgtttggattggaggtcaaataaatgacactgctattaattatataaatcaatggaaagatgtaaatagtgattataatgttaatgttttttatgatagtaatgcatttttgataaacacattgaaaaaaactgtagtagaatcagcaataaatgatacacttgaatcatttagagaaaacttaaatgaccctagatttgactataataaattcttcagaaaacgtatggaaataatttatgataaacagaaaaatttcataaactactataaagctcaaagagaagaaaatcctgaacttataattgatgatattgtaaagacatatctttcaaatgagtattcaaaggagatagatgaacttaatacctatattgaagaatccttaaataaaattacacagaatagtggaaatgatgttagaaactttgaagaatttaaaaatggagagtcattcaacttatatgaacaagagttggtagaaaggtggaatttagctgctgcttctgacatattaagaatatctgcattaaaagaaattggtggtatgtatttagatgttgatatgttaccaggaatacaaccagacttatttgagtctatagagaaacctagttcagtaacagtggatttttgggaaatgacaaagttagaagctataatgaaatacaaagaatatataccagaatatacctcagaacattttgacatgttagacgaagaagttcaaagtagttttgaatctgttctagcttctaagtcagataaatcagaaatattctcatcacttggtgatatggaggcatcaccactagaagttaaaattgcatttaatagtaagggtattataaatcaagggctaatttctgtgaaagactcatattgtagcaatttaatagtaaaacaaatcgagaatagatataaaatattgaataatagtttaaatccagctattagcgaggataatgattttaatactacaacgaatacctttattgatagtataatggctgaagctaatgcagataatggtagatttatgatggaactaggaaagtatttaagagttggtttcttcccagatgttaaaactactattaacttaagtggccctgaagcatatgcggcagcttatcaagatttattaatgtttaaagaaggcagtatgaatatccatttgatagaagctgatttaagaaactttgaaatctctaaaactaatatttctcaatcaactgaacaagaaatggctagcttatggtcatttgacgatgcaagagctaaagctcaatttgaagaatataaaaggaattattttgaaggttctcttggtgaagatgataatcttgatttttctcaaaatatagtagttgacaaggagtatcttttagaaaaaatatcttcattagcaagaagttcagagagaggatatatacactatattgttcagttacaaggagataaaattagttatgaagcagcatgtaacttatttgcaaagactccttatgatagtgtactgtttcagaaaaatatagaagattcagaaattgcatattattataatcctggagatggtgaaatacaagaaatagacaagtataaaattccaagtataatttctgatagacctaagattaaattaacatttattggtcatggtaaagatgaatttaatactgatatatttgcaggttttgatgtagattcattatccacagaaatagaagcagcaatagatttagctaaagaggatatttctcctaagtcaatagaaataaatttattaggatgtaatatgtttagctactctatcaacgtagaggagacttatcctggaaaattattacttaaagttaaagataaaatatcagaattaatgccatctataagtcaagactctattatagtaagtgcaaatcaatatgaagttagaataaatagtgaaggaagaagagaattattggatcattctggtgaatggataaataaagaagaaagtattataaaggatatttcatcaaaagaatatatatcatttaatcctaaagaaaataaaattacagtaaaatctaaaaatttacctgagctatctacattattacaagaaattagaaataattctaattcaagtgatattgaactagaagaaaaagtaatgttaacagaatgtgagataaatgttatttcaaatatagatacgcaaattgttgaggaaaggattgaagaagctaagaatttaacttctgactctattaattatataaaagatgaatttaaactaatagaatctatttctgatgcactatgtgacttaaaacaacagaatgaattagaagattctcattttatatcttttgaggacatatcagagactgatgagggatttagtataagatttattaataaagaaactggagaatctatatttgtagaaactgaaaaaacaatattctctgaatatgctaatcatataactgaagagatttctaagataaaaggtactatatttgatactgtaaatggtaagttagtaaaaaaagtaaatttagatactacacacgaagtaaatactttaaatgctgcattttttatacaatcattaatagaatataatagttctaaagaatctcttagtaatttaagtgtagcaatgaaagtccaagtttacgctcaattatttagtactggtttaaatactattacagatgcagccaaagttgttgaattagtatcaactgcattagatgaaactatagacttacttcctacattatctgaaggattacctataattgcaactattatagatggtgtaagtttaggtgcagcaatcaaagagctaagtgaaacgagtgacccattattaagacaagaaatagaagctaagataggtataatggcagtaaatttaacaacagctacaactgcaatcattacttcatctttggggatagctagtggatttagtatacttttagttcctttagcaggaatttcagcaggtataccaagcttagtaaacaatgaacttgtacttcgagataaggcaacaaaggttgtagattattttaaacatgtttcattagttgaaactgaaggagtatttactttattagatgataaaataatgatgccacaagatgatttagtgatatcagaaatagattttaataataattcaatagttttaggtaaatgtgaaatctggagaatggaaggtggttcaggtcatactgtaactgatgatatagatcacttcttttcagcaccatcaataacatatagagagccacacttatctatatatgacgtattggaagtacaaaaagaagaacttgatttgtcaaaagatttaatggtattacctaatgctccaaatagagtatttgcttgggaaacaggatggacaccaggtttaagaagcttagaaaatgatggcacaaaactgttagaccgtataagagataactatgaaggtgagttttattggagatattttgcttttatagctgatgctttaataacaacattaaaaccaagatatgaagatactaatataagaataaatttagatagtaatactagaagttttatagttccaataataactacagaatatataagagaaaaattatcatattctttctatggttcaggaggaacttatgcattgtctctttctcaatataatatgggtataaatatagaattaagtgaaagtgatgtttggattatagatgttgataatgttgtgagagatgtaactatagaatctgataaaattaaaaaaggtgatttaatagaaggtattttatctacactaagtattgaagagaataaaattatcttaaatagccatgagattaatttttctggtgaggtaaatggaagtaatggatttgtttctttaacattttcaattttagaaggaataaatgcaattatagaagttgatttattatctaaatcatataaattacttatttctggcgaattaaaaatattgatgttaaattcaaatcatattcaacagaaaatagattatataggattcaatagcgaattacagaaaaatataccatatagctttgtagatagtgaaggaaaagagaatggttttattaatggttcaacaaaagaaggtttatttgtatctgaattacctgatgtagttcttataagtaaggtttatatggatgatagtaagccttcatttggatattatagtaataatttgaaagatgtcaaagttataactaaagataatgttaatatattaacaggttattatcttaaggatgatataaaaatctctctttctttgactctacaagatgaaaaaactataaagttaaatagtgtgcatttagatgaaagtggagtagctgagattttgaagttcatgaatagaaaaggtaatacaaatacttcagattctttaatgagctttttagaaagtatgaatataaaaagtattttcgttaatttcttacaatctaatattaagtttatattagatgctaattttataataagtggtactacttctattggccaatttgagtttatttgtgatgaaaatgataatatacaaccatatttcattaagtttaatacactagaaactaattatactttatatgtaggaaatagacaaaatatgatagtggaaccaaattatgatttagatgattctggagatatatcttcaactgttatcaatttctctcaaaagtatctttatggaatagacagttgtgttaataaagttgtaatttcaccaaatatttatacagatgaaataaatataacgcctgtatatgaaacaaataatacttatccagaagttattgtattagatgcaaattatataaatgaaaaaataaatgttaatatcaatgatctatctatacgatatgtatggagtaatgatggtaatgattttattcttatgtcaactagtgaagaaaataaggtgtcacaagttaaaataagattcgttaatgtttttaaagataagactttggcaaataagctatcttttaactttagtgataaacaagatgtacctgtaagtgaaataatcttatcatttacaccttcatattatgaggatggattgattggctatgatttgggtctagtttctttatataatgagaaattttatattaataactttggaatgatggtatctggattaatatatattaatgattcattatattattttaaaccaccagtaaataatttgataactggatttgtgactgtaggcgatgataaatactactttaatccaattaatggtggagctgcttcaattggagagacaataattgatgacaaaaattattatttcaaccaaagtggagtgttacaaacaggtgtatttagtacagaagatggatttaaatattttgccccagctaatacacttgatgaaaacctagaaggagaagcaattgattttactggaaaattaattattgacgaaaatatttattattttgatgataattatagaggagctgtagaatggaaagaattagatggtgaaatgcactattttagcccagaaacaggtaaagcttttaaaggtctaaatcaaataggtgattataaatactatttcaattctgatggagttatgcaaaaaggatttgttagtataaatgataataaacactattttgatgattctggtgttatgaaagtaggttacactgaaatagatggcaagcatttctactttgctgaaaacggagaaatgcaaataggagtatttaatacagaagatggatttaaatattttgctcatcataatgaagatttaggaaatgaagaaggtgaagaaatctcatattctggtatattaaatttcaataataaaatttactattttgatgattcatttacagctgtagttggatggaaagatttagaggatggttcaaagtattattttgatgaagatacagcagaagcatatataggtttgtcattaataaatgatggtcaatattattttaatgatgatggaattatgcaagttggatttgtcactataaatgataaagtcttctacttctctgactctggaattatagaatctggagtacaaaacatagatgacaattatttctatatagatgataatggtatagttcaaattggtgtatttgatacttcagatggatataaatattttgcacctgctaatactgtaaatgataatatttacggacaagcagttgaatatagtggtttagttagagttggggaagatgtatattattttggagaaacatatacaattgagactggatggatatatgatatggaaaatgaaagtgataaatattatttcaatccagaaactaaaaaagcatgcaaaggtattaatttaattgatgatataaaatattattttgatgagaagggcataatgagaacgggtcttatatcatttgaaaataataattattactttaatgagaatggtgaaatgcaatttggttatataaatatagaagataagatgttctattttggtgaagatggtgtcatgcagattggagtatttaatacaccagatggatttaaatactttgcacatcaaaatactttggatgagaattttgagggagaatcaataaactatactggttggttagatttagatgaaaagagatattattttacagatgaatatattgcagcaactggttcagttattattgatggtgaggagtattattttgatcctgatacagctcaattagtgattagtgaatag

SEQ ID NO: 2131 - DNA, 25 bp, Artificial Sequence
  Synthetic DNA Sequence
aagcmattgttgtaaattttgaaag

SEQ ID NO: 2132 - DNA, 23 bp, Artificial Sequence
  Synthetic DNA Sequence
tcatatccatagcaatagttcta

SEQ ID NO: 2133 - DNA, 42 bp, Artificial Sequence
  Synthetic DNA Sequence
ccacgcacawaaacttgttttagaagtagcagcwcagcgtgg

SEQ ID NO: 2134 - DNA, 17 bp, Artificial Sequence
  Synthetic DNA Sequence
cgcgtgaagcttctgtg

SEQ ID NO: 2135 - DNA, 20 bp, Artificial Sequence
  Synthetic DNA Sequence
tctcgccgttattcagtttc

SEQ ID NO: 2136 - DNA, 44 bp, Artificial Sequence
  Synthetic DNA Sequence
ccaacgcgtcctcaatcatttctaacttctatggccggcgttgg

SEQ ID NO: 2137 - DNA, 889 bp, Pseudomonas putida
atgatcaccggtgctgcccagatggacggcgcgatcctggtttgctcggccgccgatggtccgatgccrcaaacccgtgagcacatcctgctgtcccgtcaggtaggcgttccgtacatcgtggtcttcctgaacaaggccgacctggtagacgacgctgagctgctggaactggtcgagatggaagttcgcgacctgctgtccacctacgacttcccaggcgacgacactccgatcatcatcggttccgctcgtatggccctggaaggcaaagacgacaacgaaatgggcactaccgctgtcaagaagctggtagaaactctggatgcctacatccctgagccagttcgtgccatcgaccagccgttcctgatgccgatcgaagacgtgttctcgatctcgggtcgtggtaccgttgttaccggtcgtatcgagcgtggcatcgttcgcgttcaggatccgctggaaatcgttggtctgcgtgacaccaccaccaccacctgcaccggtgttgagatgttccgcaagctgctggacgaaggtcgtgctggcgagaactgcggcgttctgctgcgtggtaccaagcgtgacgacgttgagcgtggccaggttctggtcaagccaggttcggtcaagccgcacaccaagttcaccgcagaagtctacgtcctgtcgaaggaagaaggcggccgtcacactccgttcttcaaaggctaccgtccacagttctacttccgtaccactgacgtgaccggtaactgcgaactgccggaaggcgttgaaatggtaatgccaggtgacaacattcagatgactgttaccctgatcaagaccatcgcaatggaagacggtctgcgcttcgctatccgtgaaggcggtcgtaccgtcg

SEQ ID NO: 2138 - DNA, 900 bp, Pseudomonas aeruginosa
  strain PAO-1
aacatgatcaccggtgctgcccagatggacggcgcgatcctggtttgctcggctgccgacggccccatgccgcagacccgcgagcacatcctgctgtcccgccaggtaggcgttccctacatcgtcgtgttcctgaacaaggccgacatggtcgacgacgccgagctgctggaactggtcgagatggaagttcgcgatctgctgaacacctacgacttcccgggcgacgacactccgatcatcatcggttccgcgctgatggcgctggaaggcaaggatgacaacggcatcggcgtaagcgccgtgcagaagctggtagagaccctggactcctacattccggagccggttcgtgccatcgaccagccgttcctgatgccgatcgaagacgtgttctcgatctccggccgcggtaccgtggtaaccggtcgtgtagagcgcggcatcatcaaggtccaggaagaagtggaaatcgtcggcatcaaggcgaccaccaagactacctgcaccggcgttgaaatgttccgcaagctgctcgacgaaggtcgtgctggtgagaacgttggtatcctgctgcgtggcaccaagcgtgaagacgtagagcgtggccaggttctggccaagccgggcaccatcaagccgcacaccaagttcgagtgcgaagtgtacgtgctgtccaaggaagaaggtggtcgtcacaccccgttcttcaagggctaccgtccgcagttctacttccgtaccaccgacgtgaccggtaactgcgaactgccggaaggcgtagagatggtaatgccgggcgacaacatcaagatggttgtcaccctgatcgctccgatcgccatggaagatggcctgcgcttcgcgatccgcgaaggcggccgtaccgttggcgccggc

SEQ ID NO: 2139 - DNA, 1398 bp, Campylobacter jejuni
  NCTC 11168
atgcaaggatttatttcacaggtattaggtccggttgttgatgtagattttaacgactatttgcctcaaattaatgaagcaattgttgtaaattttgaaagcgaaggaaaaaaacataaacttgttttagaagtagcagctcatttaggagataatagagttagaactattgctatggatatgacagatggtttggtaaggggcttaaaagctgaggctttaggtgctcccattagtgttcctgttggtgagaaagttttaggaagaattttcaatgttactggagatttgatcgatgaaggtgaagaaatttctttcgataaaaaatgggcaattcatagagatccaccagcttttgaagatcaaagcacaaaaagtgagatttttgaaacagggattaaagttgtagatttacttgctccttatgcaaaaggtggtaaagtaggtctttttggtggtgcaggtgttggtaaaactgttattattatggagcttattcacaatgttgcatttaagcatagcggctattctgtatttgcaggtgtgggtgagagaactcgtgaaggaaatgacctttataatgaaatgaaagaaagtaatgttttagacaaagttgctctatgttatggacaaatgaatgaaccaccaggggcaagaaatcgtattgctttaacaggtttaacaatggctgagtattttagagatgaaatgggtcttgatgtgcttatgtttattgataatatctttagattttcacaatcaggttctgaaatgtcagcacttttaggaagaattccatcagctgtgggttatcaaccaaccttagcaagtgaaatgggtaaattccaagaaagaattacttcaactaaaaaaggctcaatcacttcagttcaagctgtttacgttccagctgatgacttaacagacccagctccagcaactgtttttgctcacttagatgctacaacggttttaaatagagctattgctgaaaagggtatttatcctgcagttgacccacttgactcaacttcaagaatgcttgacccaaatatcattggagaagaacattataaagttgctcgtggtgttcaatcagtgcttcaaaaatacaaagatttacaagatatcatcgccattttaggtatggatgagcttagcgaagaggataaacttgtagttgaaagagcaagaaagattgaaaaattcttatcacaaccatttttcgttgcagaagttttcacaggtagcccaggaaaatatataagccttgaagatacaatagcaggatttaagggaattttagaaggtaaatatgatcatttaccagaaaatgctttctatatggttggaaatatagatgaagctattgcaaaagcggataaattaaaaggttaa

SEQ ID NO: 2140 - DNA, 2157 bp, Streptococcus pneumoniae
  strain 670
atgaacaaaccaacgattctgcgcctaatcaagtatctgagcattagcttcttaagcttggttatcgcagccattgtcttaggcggaggagtttttttctactacgttagcaaggctcctagcctatccgagagtaaactagttgcaacaacttctagtaaaatctacgacaataaaaatcaactcattgctgacttgggttctgaacgccgcgtcaatgcccaagctaatgatattcccacagatttggttaaggcaatcgtttctatcgaagaccatcgcttcttcgaccacagggggattgattccatccgtatcctgggagctttcttgcgcaatctgcaaagtaattccctccaaggtggatcaactctcacccaacagttgattaagttgacttacttttcaacctcgacttccgaccagactatttctcgtaaggctcaggaagcttggttagcgattcagttagaacaaaaagcaaccaaacaggaaatcttgacctactatataaataaggtctacatgtctaatggcaactatggaatgcagacagcagctcaaaactactatggtaaagacctcaataatttaagtttacctcagttagccttgctggctggaatgcctcaggcaccaaaccaatatgacccctattcacatccagaagcagcccaagaccgccgaaacttggtcttatctgaaatgaaaaatcaaggttacatctctgctgaacagtatgagaaagcagtcaatacaccaattactgatggactacaaagtctcaaatcagcaagtaattaccctgcttacatggataattacctcaaggaggtcatcaatcaagtagaacaagaaactggctataaccttctaactactgggatggatgtttacacaaatgtagaccaagaagctcaaaaacatctgtgggatatctacaactccgatcaatacgtctcttaccctgacgatgatttgcaagtcgcatctacggtcgtagatgtttcaaatggtaaagtcatcgcccaacttggagctcgtcaccaagcaagtaacgtttcatttggtaccaaccaagctgtggaaaccaatcgtgactggggttctgctatgaaaccaatcaccgattatgcacctgccatagaatacggtgtttatgattccactgcaactatggttaatgatattccttataactatccgggaacaagcacacctgtctacaactgggatagagcatatttcggtaatattactctgcaatatgctcttcaacaatcacgaaatgtcacagccgttgagactttgaataaggtcggtctagatagagctaaaaccttccttaatggtcttggtatcgactatccaagcatgcattatgcaaacgccatttcaagtaatacaacagaatctaataaacaatacggagcaagtagtgaaaaaatggctgctgcttatgctgcctttgccaacggtggaatttaccacaaacccatgtatatcaataaggtcgtcttcagtgacggtagtaaaaaagaattttcagatgtaggtacacgagctatgaaagaaacaactgcttacatgatgaccgaaatgatgaaaactgtcttggcatacggaactggtcgtggagcctatctcccatggttagcgcaagctggtaagacaggtacttctaactacacagatgatgaaattgaaaaacacatcaagaacactggctatgtagctccagatgaaatgtttgttggttatactcgtaagtattctatggctgtatggacaggttattcgaatcgtttaactcctatcgttggagatggtttcctagttgcagctaaagtttatcgctcaatgataacgtatctatcagaagatactcatccagaagactggacgatgccagacggacttttcagaaacggggaatttgtattcaaaaatggagctcgttctacgtggagctcacctgctccacaacaacccccatcaactgaaagttcaagctcatcatcagatagttcaacttcacagtctagctcaaccactccaagcacaaataatagtacgactaccgatcctaacaataatacgcaacaatcaaatacaacccctgatcaacaaaatcagaatcctcaaccagcacaacca

SEQ ID NO: 2141 - DNA, 18 bp, Artificial Sequence
  Synthetic DNA Sequence
caccagtcacagaaaagc

SEQ ID NO: 2142 - DNA, 20 bp, Artificial Sequence
  Synthetic DNA Sequence
gccttaatttcggatagtgc

SEQ ID NO: 2143 - DNA, 25 bp, Artificial Sequence
  Synthetic DNA Sequence
gagaaagagcccaattatctaatgt

SEQ ID NO: 2144 - DNA, 3075 bp, Staphylococcus aureus
  strain J2870
ttgacaaagaaatatttaaacacccagaatgaaatatcagcattttggaatactcaaaagatatttaaaaaatcaattgacaatagaaaaggacaggaaagttttgttttttatgacggccccccaactgcaaatggccttcctcatgctggccatgttcttggaagagtaatcaaggatttagttgcaagattaaaaactatgcaaggtttttatgtagaaagaaaagcaggatgggatacccatggcttaccagttgaattagaggttgaaaaaaaaattggaattaaaggaaaacaagacattgaaaagtatggaatagaaaattttataaatgaatgtaaaaaaagtgtatttaattatgaaaaagaatggcgggatttttctaaagatttaggatactgggttgacatggactccccctatataactcttgagaataattatattgaaagtgtatggaatatattatctacattccataaaaaaggactattatataagggacataaggtgactccttattgtacacatgatcaaaccgctttaagttctcatgaagtagcgcaaggctataaaaacgttaaagatttatcagctgttgttaaatttcaacttacaaatagtaaagatacttatttcttaagttggactaccactccctggactttgcctgcaaatgtagcattagctataaataaagatcttaattattcaaaaattcgggtagaaaatgagtattatatcttagctacagatctaattaattctataataactgaaaaatacgaaattattgataccttttcaggaagtaatttaattaatttaaaatacattcctccttttgaaagcgacggtttagttaatgcatattacgttgttgatggagaatttgttactaactcagaaggaactggtattgttcatatagcaccagctcatggggaagatgactaccaattggttttagagcgtgatttggatttcttaaatgttataacaagagaaggagtatataatgataggttccctgaattagttggtaataaagctaaaaatagtgatatagaaatcataaaattattatccaaaaaacaacttttatataaaaaacaaaaatatgagcataattatcctcattgttggagatgtggtaatcctttgatatattatgcgatggaaggttggtttattaaaacaactaattttaagaatgaaattattaacaataataataatatagagtggtttccttctcatattaaggaagggagaatgggaaatttcttagaaaatatggttgattggaacattggtagaaatagatattggggaacaccattaaatgtatggatttgcaatgattgtaatcacgaatacgcaccaagtagtattaaggatttacaaaataattccatcaataaaattgatgaagatattgagttgcatagaccttatgttgataatatcactcttagttgccctaagtgtaatgggaaaatgtctcgagtagaagaagtaatcgatgtttggtttgatagcggctctatgccgtttgctcagcatcattatccttttgataaccagaaaatttttaatcaacactttccagctgattttattgcagaaggagttgatcaaacgagaggctggttttacagtttactagtaatttctactattctaaaaggaaaatcttcttataaacgtgctttatctttaggacatattctagacagtaatggtaaaaaaatgtctaaaagtaaaggaaacgttattaatccaactgaattaattaataagtacggagccgattctttaagatgggccttaatttcggatagtgctccatggaataacaaaagattctcagaaaatatagtagctcagaccaaatcgaaatttatagatacgcttgataatatttataaattttataatatgtataataaaatagatcactataatcctaataatgaaattacaaaaagtagaaatacattagataattgggctctttctcgcttaaacaccttaataaaagaaagtaatatttatgtaaataattacgatttcacttccgcagccagattaattaacgaatataccaatacaataagtaattggtatatcggagattcgagaggacgattttgggaacaaggaatttctaacgataaaaaagatgcgtacaatacgctttatgaaattttaacaactttatcaagactagtggctccatttgttccatttatatctgaaaaaatccattataatttgactggaaaaagtgtgcatttacaagattatccacaatataaagaaagttttattaatcaagcattggaagatgaaatgcataccgttataaaaattgtagaattatctagacaggctcgcaaaaatgcagatttaaaaattaagcaacctttatcgaaaatggtgattaaacctaatagtcaattaaacttaagttttttacctaattactattcaataataaaagacgaattaaatataaaaaacattgaattaactgataatattaatgactatattacctatgagcttaaattgaatttttcttctgtgggaccaaaactagggaacaaaacgaaaaatattcaaacattgatagactccctatcagagtatgataaaaaaagtttaattgagtctaataacttcaaaagtttatcttctgatgctgagttaactaaggatgattttataattaaaaccttacctaaggatagttatcaactcagtgaagataatgactgcgttatattattagataaaaatttatctcctgaattaattcgcgaaggacatgctagagagctcattagattaattcaacaattaagaaaaaagaaaaatttaccaataaatcaacgtattgatatttatatcggtgtaactggggaattattagaatcaataaaaaccaataaaaatatgtttaaagaaaatttcgtgattaaaaatatacacttaaatgttatagatgaatatgaaaatactattcattttaataataaagaaataaaaatttccttattatattaa

SEQ ID NO: 2145 - DNA, 22 bp, Artificial Sequence
  Synthetic DNA Sequence
gcaagatgtggcgtgttacggt

SEQ ID NO: 2146 - DNA, 23 bp, Artificial Sequence
  Synthetic DNA Sequence
ggggcgaagaagttgtccatatt

SEQ ID NO: 2147 - DNA, 660 bp, Escherichia coli
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaa

SEQ ID NO: 2148 - DNA, 22 bp, Artificial Sequence
  Synthetic DNA Sequence
cagattaaatgcggattcagcc

SEQ ID NO: 2149 - DNA, 23 bp, Artificial Sequence
  Synthetic DNA Sequence
atcaggtaaatcatcagcggata

SEQ ID NO: 2150 - DNA, 642 bp, Escherichia coli
  strain K12
atgaattttacccggattgacctgaatacctggaatcgcagggaacactttgccctttatcgtcagcagattaaatgcggattcagcctgaccaccaaactcgatattaccgctttgcgtaccgcactggcggagacaggttataagttttatccgctgatgatttacctgatctcccgggctgttaatcagtttccggagttccggatggcactgaaagacaatgaacttatttactgggaccagtcagacccggtctttactgtctttcataaagaaaccgaaacattctctgcactgtcctgccgttattttccggatctcagtgagtttatggcaggttataatgcggtaacggcagaatatcagcatgataccagattgtttccgcagggaaatttaccggagaatcacctgaatatatcatcattaccgtgggtgagttttgacggatttaacctgaacatcaccggaaatgatgattattttgccccggtttttacgatggcaaagtttcagcaggaaggtgaccgcgtattattacctgtttctgtacaggttcatcatgcagtatgtgatggctttcatgcagcacggtttattaatacacttcagctgatgtgtgataacatactgaaataa

SEQ ID NO: 2151 - DNA, 23 bp, Artificial Sequence
  Synthetic DNA Sequence
atatttcagcattaccttgggtt

SEQ ID NO: 2152 - DNA, 23 bp, Artificial Sequence
  Synthetic DNA Sequence
tacacaactcttgtagccgatta

SEQ ID NO: 2153 - DNA, 642 bp, Shigella flexneri
atgaactatacaaaatttgatgtaaaaaattgggttcgccgtgagcattttgagttttatcggcatcgtttaccatgtggttttagcttaacaagcaaaattgatatcacgacgttaaaaaagtcattggatgattcagcgtataagttttatccggtaatgatctatctgattgctcaggccgtgaatcaatttgatgagttgagaatggcgataaaagatgatgaattgatcgtatgggattcagtcgacccacaattcaccgtattccatcaagaaacagagacattttcagcactgagttgcccatactcatccgatattgatcaatttatggtgaattatttatcggtaatggaacgttataaaagtgataccaagttatttcctcaaggggtaacaccagaaaatcatttaaatatttcagcattaccttgggttaattttgatagctttaatttaaatgttgctaattttaccgattattttgcacccattataacaatggcaaaatatcagcaagaaggggatagactgttattgccgctctcagtacaggttcatcatgcagtttgtgatggcttccatgttgcacgctttattaatcggctacaagagttgtgtaacagtaaattaaaataa

SEQ ID NO: 2154 - DNA, 20 bp, Artificial Sequence
  Synthetic DNA Sequence
cgccattcagagtttaggac

SEQ ID NO: 2155 - DNA, 23 bp, Artificial Sequence
  Synthetic DNA Sequence
ttccataccgttgcgtatcactt

SEQ ID NO: 2156 - DNA, 624 bp, Clostridium perfringens
  strain CP590
atggtatttgaaaaaattgataaaaatagttggaacagaaaagagtattttgaccactactttgcaagtgtaccttgtacatacagcatgaccgttaaagtggatatcacacaaataaaggaaaagggaatgaaactatatcctgcaatgctttattatattgcaatgattgtaaaccgccattcagagtttaggacggcaatcaatcaagatggtgaattggggatatatgatgagatgataccaagctatacaatatttcacaatgatactgaaacattttccagcctttggactgagtgtaagtctgactttaaatcatttttagcagattatgaaagtgatacgcaacggtatggaaacaatcatagaatggaaggaaagccaaatgctccggaaaacatttttaatgtatctatgataccgtggtcaaccttcgatggctttaatctgaatttgcagaaaggatatgattatttgattcctatttttactatggggaaatattataaagaagataacaaaattatacttcctttggcaattcaagttcatcacgcagtatgtgacggatttcacatttgccgttttgtaaacgaattgcaggaattgataaatagttaa

SEQ ID NO: 2157 - DNA, 27 bp, Artificial Sequence
  Synthetic DNA Sequence
ccacagaaattgatattagtgttttat

SEQ ID NO: 2158 - DNA, 21 bp, Artificial Sequence
  Synthetic DNA Sequence
tcgctattgtaaccagttcta

SEQ ID NO: 2159 - DNA, 651 bp, Staphylococcus aureus
atgaactttaataaaattgatttagacaattggaagagaaaagagatatttaatcattatttgaaccaacaaacgacttttagtataaccacagaaattgatattagtgttttataccgaaacataaaacaagaaggatataaattttaccctgcatttattttcttagtgacaagggtgataaactcaaatacagcttttagaactggttacaatagcgacggagagttaggttattgggataagttagagccactttatacaatttttgatggtgtatctaaaacattctctggtatttggactcctgtaaagaatgacttcaaagagttttatgatttatacctttctgatgtagagaaatataatggttcggggaaattgtttcccaaaacacctatacctgaaaatgctttttctctttctattattccatggacttcatttactgggtttaacttaaatatcaataataatagtaattaccttctacccattattacagcaggaaaattcattaataaaggtaattcaatatatttaccgctatctttacaggtacatcattctgtttgtgatggttatcatgcaggattgtttatgaactctattcaggaattgtcagataggcctaatgactggcttttataa

SEQ ID NO: 2160 - DNA, 23 bp, Artificial Sequence
  Synthetic DNA Sequence
ttttgaacactattttaaccagc

SEQ ID NO: 2161 - DNA, 23 bp, Artificial Sequence
  Synthetic DNA Sequence
gatttaacttatcccaataacct

SEQ ID NO: 2162 - DNA, 648 bp, Staphylococcus aureus
atgacttttaatattatcaaattagaaaattgggatagaaaagaatattttgaacactattttaaccagcaaactacgtatagcattactaaagaaattgatattactttgtttaaagatatgataaaaaagaaaggatatgaaatttatccttctttgatttatgcaattatggaagttgtaaataaaaataaagtgtttagaacaggaattaatagtgagaataaattaggttattgggataagttaaatcctttgtatacagtttttaataagcaaactgaaaaatttactaacatttggactgaatctgataacaacttcacttctttttataataattataaaaatgacttgcttgaatataaagataaagaagaaatgtttcctaaaaaaccgatacctgaaaacaccataccgatttcaatgattccttggattgattttagttcatttaatttaaacattggtaacaatagcaactttttattgcctattattacgataggtaaattttatagtgagaataataaaatttatataccagttgctttgcagcttcatcatgctgtatgtgatggttaccatgcttcattatttatgaatgaatttcaagatataattcataaggtagatgattggatttag

SEQ ID NO: 2163 - DNA, 24 bp, Artificial Sequence
  Synthetic DNA Sequence
accttcatcctaccgatgtgggtt

SEQ ID NO: 2164 - DNA, 23 bp, Artificial Sequence
  Synthetic DNA Sequence
caacgacaccagcactgccattg

SEQ ID NO: 2165 - DNA, 1215 bp, Salmonella typhimurium
  strain H3380
atgaccaccacacgccccgcgtgggcctatacgctgccggcagcactgctgctgatggctcctttcgacatcctcgcttcactggcgatggatatttatctccctgtcgttccagcgatgcccggcatcctgaacacgacgcccgctatgatccaactcacgttgagcctctatatggtgatgctcggcgtgggccaagtgatttttggtccgctctcagacagaatcgggcgacggccaattctacttgcgggcgcaacggctttcgtcattgcgtctctgggagcagcttggtcttcaactgcaccggcctttgtcgctttccgtctacttcaagcagtgggcgcgtcggccatgctggtggcgacgttcgcgacggttcgcgacgtttatgccaaccgtcctgagggtgtcgtcatctacggccttttcagttcgatgctggcgttcgtgcctgcgctcggccctatcgccggagcattgatcggcgagttcttgggatggcaggcgatattcattactttggctatactggcgatgctcgcactcctaaatgcgggtttcaggtggcacgaaacccgccctctggatcaagtcaagacgcgccgatctgtcttgccgatcttcgcgagtccggctttttgggtttacactgtcggctttagcgccggtatgggcaccttcttcgtcttcttctcgacggctccccgtgtgctcataggccaagcggaatattccgagatcggattcagctttgccttcgccactgtcgcgcttgtaatgatcgtgacaacccgtttcgcgaagtcctttgtcgtcagatggggcatcgcaggatgcgtggcgcgtgggatggcgttgcttgtttgcggagcggtcctgttggggatcggcgaactttacggctcgccgtcattcctcaccttcatcctaccgatgtgggttgtcgcggtcggtattgtcttcacggtgtccgttaccgcgaacggcgctttggcagagttcgacgacatcgcgggatcagcggtcgcgttctacttctgcatccaaagcctgatagtcagtatcgtcgggacattggcggtgacgctgttaaacggcgatacagcgtggcccgtgatttgttacgccacggcaatggcagtgctggtgtcgttggggctggcgctccttcgatcccgtgatgctgccaccgagaagtcgccagtcgtctag

SEQ ID NO: 2166 - DNA, 18 bp, Artificial Sequence
  Synthetic DNA Sequence
gacaaaccattcctgctg

SEQ ID NO: 2167 - DNA, 18 bp, Artificial Sequence
  Synthetic DNA Sequence
cagcagctgggcggcggt

SEQ ID NO: 2168 - DNA, 23 bp, Artificial Sequence
  Synthetic DNA Sequence
catcaaagttggtgaagaagttg

SEQ ID NO: 2169 - DNA, 18 bp, Artificial Sequence
  Synthetic DNA Sequence
cccgtttgcgaaaggtgg

SEQ ID NO: 2170 - DNA, 19 bp, Artificial Sequence
  Synthetic DNA Sequence
acgtgacgttgacaaacca

SEQ ID NO: 2171 - DNA, 20 bp, Artificial Sequence
  Synthetic DNA Sequence
tcgttggattaactgaagaa

SEQ ID NO: 2172 - DNA, 20 bp, Artificial Sequence
  Synthetic DNA Sequence
gtgttgaaatgttccgtaaa

SEQ ID NO: 2173 - DNA, 24 bp, Artificial Sequence
  Synthetic DNA Sequence
aagaaaaaatcttcgaactggcta

SEQ ID NO: 2174 - DNA, 15 bp, Artificial Sequence
  Synthetic DNA Sequence
tctacacggccggtg

SEQ ID NO: 2175 - DNA, 16 bp, Artificial Sequence
  Synthetic DNA Sequence
ccgccataccccgttt

SEQ ID NO: 2176 - DNA, 24 bp, Artificial Sequence
  Synthetic DNA Sequence
cggcattaccatttccacaccttt

SEQ ID NO: 2177 - DNA, 49 bp, Artificial Sequence
  Synthetic DNA Sequence
ggcacggacaaaccattcctgctgcctatcgaagacgtgttcccgtgcc

SEQ ID NO: 2178 - DNA, 38 bp, Artificial Sequence
  Synthetic DNA Sequence
ggcacgacaaaccattcctgctgcctatcgaacgtgcc

SEQ ID NO: 2179 - DNA, 39 bp, Artificial Sequence
  Synthetic DNA Sequence
ggcagctctacttccgtaccactgacgtaaccggctgcc

SEQ ID NO: 2180 - DNA, 15 bp, Artificial Sequence
  Synthetic DNA Sequence
ttcgccggcgtgggc

SEQ ID NO: 2181 - DNA, 15 bp, Artificial Sequence
  Synthetic DNA Sequence
agcgccacgcgcagg

SEQ ID NO: 2182 - DNA, 42 bp, Artificial Sequence
  Synthetic DNA Sequence
gcgcgccaacgacttctaccacgaaatggaagagtcgcgcgc

SEQ ID NO: 2183 - DNA, 817 bp, Alcaligenes faecalis subsp. faecalis; identical to SEQ ID NO: 1572
  ref <308>: DATABASE ACCESSION NUMBER: ATCC 8750

SEQ ID NO: 2184 - DNA, 1652 bp, Campylobacter coli
  ref <308>: DATABASE ACCESSION NUMBER: ATCC 43479
tacaattgaagttgaaagatctatgcgtgttcttgatggtgctgttgcggtattttgttcagtgggtggggtgcagcctcaaagtgaaacagtttggagacaagcaaataaatatggtgttccaagaatagtatttgtaaataaaatggatagaatcggtgcaaatttctacaatgtagaagatcaaattcgcaaccgtttaaaagctaatccagttccacttcaaattccaatcggtgctgaggataattttaaaggcgtaatcgatcttgtaactatgaaagctttagtttgggaagatgatactaagccaacggattatgtagaaaaagaaattccagctgaacttaaagaaaaggcagaagaatatcgcacaaaaatgatagaagcagtttctgaaacttcagatgagttgatggaaaaatatttaggtggagaagaattaagccttgaagagattaaaacagggattaaagcaggatgtttaagtctttctatcgttcctatgctttgcggtacagcgtttaaaaataaaggggttcaacctttgcttgatgctgttgtggcttatttaccagctcctgatgaagttgctaatatcaaaggggaatatgaagacggcacagaagtttctgtaaaatcaactgatgatggcgaatttgcaggacttgcatttaaaattatgacagatccatttgtaggacaacttactttcgtgcgtgtttatcgtggatgtttagaaagcggttcttatgcttataactcaaccaaagataaaaaagaaagaattggtcgtttgttaaaaatgcactctaataaaagagaagaaattaaagttctttacgcaggagaaatcggtgcagttgtaggacttaaagatactttaacaggggatactcttgcaagtgaaaaagataaagtaattcttgaaagaatggatttcccagacccagttatttctgttgcagtagamccaaaaactaaagcagatcaagaaaaaatgtctattgcactaaataaattagctcaagaagatccaagctttagagtttctacggatgaagaaagtggtcaaactatcatttcaggtatgggtgaattacaccttgaaattattgttgatcgtatgcttcgtgaatttaaagtggaagctgaagtgggacaacctcaagttgcttatcgtgaaactatcagaaaaactgttgagcaagaatacaaatacgctaagcaatcaggcggtcgtggtcagtatggacatgtattcttacgccttgagccacttgagccaggaagtggatacgagtttgttaacgacatcaaaggtggggtaattccaaaagaatatattcctgcagtagataagggtgttcaagaagcattgcaaaatggtgttttagcaggttatccagtagaagatgttaaagtaactgtttatgatggaagttatcacgaggtggattcatctgagatggcatttaaacttgctgcttctatgggatttaaagagggtgctagaaaagcaggtgctgtgatcttagagcctatgatgaaagttgaagtagaaactcctgaagattacatgggcgatgttattggcgatcttaataagcgtcgtggtcaagtaaatagcatggatgaaagaggtggtaata

SEQ ID NO: 2185 - DNA, 820 bp, Succinivibrio dextrinosolvens; identical to SEQ ID NO: 1574
  ref <308>: DATABASE ACCESSION NUMBER: ATCC 19716

SEQ ID NO: 2186 - DNA, 44 bp, Artificial Sequence
  Synthetic DNA Sequence
acgcgctcaaagcagaagtatacgtattatcaaaagacgcgcgt

SEQ ID NO: 2187 - DNA, 1612 bp, Campylobacter jejuni subsp. jejuni
  ref <308>: DATABASE ACCESSION NUMBER: ATCC 33292
cagtgggtggggtgcagcctcaaagtgaaacagtttggagacaagcaaataaatatggtgttccaagaatagtatttgtaaacaaaatggatagaatcggtgcaaatttctacaatgtagaagatcaaattcgcaaccgtttaaaagctaatccagttccacttcaaattccaatcggtgctgaggataattttaaaggcgtaatcgatcttgtaactatgaaagctttagtttgggaagatgatactaagccaacggattatgtagaaaaagaaattccagctgaacttaaagaaaaggcagaagaatatcgcacaaaaatgatagaagcagtttctgaaacttcagatgagttgatggaaaaatatttaggcggagaagaattaagccttgaagagattaaaacagggattaaagcaggatgtttaagtctttctatcgttcctatgctttgcggtacagcgtttaaaaataaaggggttcaacctttacttgatgctgttgtggcttatttaccagctcctgatgaagtggcaaatatcaagggtgaatatgaagatggcacagaagtttctgtaaaatcaactgatgatggcgagtttgcaggacttgcatttaaaattatgacagatccatttgtaggacaacttactttcgtgcgtgtttatcgcggttgtttagaaagtggttcttatgcttataactcaactaaagataaaaaagaaagaattggtcgtttgttaaaaatgcactctaaccaaagagaagagattaaagtgctttacgcaggcgaaattggtgctgttgtaggacttaaagatactttaacaggggatactcttgtaagtgaaaaagataaggtaatccttgaaagaatggattttccagatccagttatttctgttgcagttgagccaaaaactaaagcagatcaagaaaaaatgtctattgctttaaataaattagcacaagaagatccaagttttagagtttctacagatgaagaaagtggccaaactatcatttcaggtatgggtgagttacaccttgaaattatcgttgatagaatgcttcgtgaatttaaagttgaagctgaagtaggtcaaccacaagttgcttatcgcgaaactattagaaaaactgttgaacaagaatacaaatacgctaaacaatcaggtggtcgtggtcagtatggacatgtattcttacgccttgaaccacttgagccaggtagtggatatgaatttgttaatgatatcaaaggtggagtaattccaaaagaatacattcctgcagttgataaaggtgttcaagaagcattacaaaatggtgttttagcaggttatcctgtggaagatgttaaagtaactgtttatgatggaagttatcacgaggtggattcatctgagatggcgtttaaacttgctgcttctatgggctttaaagaaggtgctagaaaagcaggtgctgtgatcttagagcctatgatgaaagttgaagtagaaactcctgaagattacatgggtgatgttattggagatcttaacaaacgccgtggtcaagtaaatagcatggatgagcgtggtggaaataaaatcatcacagcattttg

SEQ ID NO: 2188 - DNA, 1667 bp, Campylobacter jejuni subsp. jejuni
  ref <308>: DATABASE ACCESSION NUMBER: ATCC 33560
acaattgaagttgaaagatctatgcgtgttcttgatggtgctgttgcggtattttgttcagtgggtggggtgcagcctcaaagtgaaacagtttggagacaagcaaataaatatggtgttccaagaatagtatttgtaaataaaatggatagaatcggtgcaaatttctacaatgtagaagatcaaattcgcaaccgtttaaaagctaatccagttccacttcaaattccaattggtgctgaggataattttaaaggcgtaatcgatcttgtaactatgaaagctttagtttgggaagatgatactaagccaacggattatgtagaaaaagaaattccagctgaacttaaagaaaaggcagaagaatatcgcacaaaaatgatagaagcagtttctgaaacttcagatgagttgatggaaaaatatttaggcggagaagaattaagccttgaagagattaaaacagggattaaagcaggatgtttaagtctttctatcgttcctatgctttgcggtacagcgtttaaaaataaaggggttcaacctttgcttgatgctgttgtggcttatttaccagctcctgatgaagtggcaaatatcaagggtgaatatgaagatggcacagaagtttctgtaaaatcaactgatgatggcgagtttgcaggacttgcatttaaaatcatgacagatccatttgtaggacaacttactttcgtgcgtgtttatcgcggttgtttagaaagcggttcttatgcgtataactcaactaaagataaaaaagaaagaattggtcgtttgttaaaaatgcactctaacaaaagagaagagattaaagtgctttacgcaggcgaaattggtgctgttgtaggacttaaagatactttaacaggggatactcttgcaagtgaaaaagataaggtaatccttgaaagaatggattttccagatccagttatttctgttgcagttgagccaaaaactaaagctgatcaagaaaaaatgtctattgctttaaataaattagcacaagaagatccaagttttagagtttctacagatgaagaaagtggtcaaactatcatttcaggtatgggtgagttacaccttgaaattatcgttgatagaatgcttcgtgaatttaaagttgaagctgaagtaggtcaaccacaagttgcttatcgcgaaactattagaaaaactgttgaacaagaatacaaatacgctaaacaatcaggtggtcgtggtcagtatggacatgtattcttacgccttgaaccacttgagccaggtagtggatatgaatttgttaatgatatcaaaggtggggtaattccaaaagaatacattcctgcagttgataaaggtgttcaagaagcattacaaaatggtgttttagcaggttatcctgtggaagatgttaaagtaactgtttatgatggaagttatcacgaggtggattcatctgagatggcgtttaaacttgctgcttctatgggctttaaagaaggtgctagaaaagcaggcgctgtgatcttagagcctatgatgaaagttgaagtagaaactcctgaagattatatgggtgatgttattggagatcttaacaaacgccgtggtcaagtaaatagcatggatgagcgtggtggaaataaaatcatcacagcatt

SEQ ID NO: 2189 - DNA, 1255 bp, Leishmania guyanensis; identical to SEQ ID NO: 859
  ref <308>: DATABASE ACCESSION NUMBER: ATCC 50126

SEQ ID NO: 2190 - DNA, 1248 bp, Trypanosoma brucei subsp. brucei
  strain EATRO795
gcccttgacgttgttgacaaacttggccgtgatgagcctcttactcttgagatcgtgcagcatcttgacgcccacacgggccgctgtatcgcgatgcaaacgacggatctcctcaaactgaaggcaaaggtcgtttcgacaggtggcaacatttccgttcctgtcggccgggaaacactaggtcgtatcttcaacgtgcttggagacgctattgaccagcgcggccccgttggtgagaaactgcgcatgcccatccatgccgtggctcccaagcttgcggaccaggccgctgaggatgcggtgctcacaactggtattaaggtgattgatctcattctcccttactgcaaaggtggaaaaattggcctctttgggggtgcgggtgtgggcaaaaccgtcattattatggagctcattaacaacgttgccaagggtcacggtggtttctctgtcttcgctggtgttggtgagcgtacccgtgagggaacggatttgtatcttgagatgatgcagtctaaggttattgaccttaagggtgagtccaaatgtgtgttggtgtacggtcagatgaacgagcccccaggtgcccgtgcgcgtgttgcgcagtcggctctgacgatggctgagtacttccgtgatgtggagggccaagatgtgcttctttttatcgacaatatttttcgtttcactcaggctaactccgaggtgtcggcgcttctgggtcgtattcccgccgctgttggctaccagcctaccctcgctgaggatctagggcagttgcaggagcgtattacctcaacaacgaaaggctccattacttctgtgcaggccgtatacgtgccggccgatgacattaccgatccagctccagcaacaaccttctcacatctggacgccacaactgtgttggaccgtgctgttgccgagtctggtatctaccccgctgttaacccactggaatgcgcctcgcgtatcatggaccccgacgttatcagtgtggatcactacaatgttgcacaagatgtggtacagatgctcaccaagtacagggaattacaggatatcattgctgtccttggtatcgacgagctaagcgaggaggacaaacttatcgtggaccgtgcgcgtaagttggtgaagttcctctcccagccattccaagttgctgaggtcttcacaggaatgactggccattacgtgcagttggatgacaccatcgattccttttctggtctcctcatgggtacg

SEQ ID NO: 2191 - DNA, 440 bp, Aspergillus nidulans
  strain WSA-176
gagctgattgtaagtcatcgaccacttgatatatgaatacatctaacagtagtagaacaacatcgccaaggctcacggtggttactccgtcttcactggtgtcggtgagcgtactcgtgagggtaacgatctgtaccacgaaatgcaggagactggtgtcattcagctcgacggcgaatccaaggtgtctcttgtgttcggtcagatgaacgagcccccaggtgctcgtgcccgtgtcgcccttactggtctgaccatcgccgaatacttccgtgacgaggagggtcaggacgtgctgctcttcattgacaacattttccgtttcacccaggccggttccgaggtgtctgcccttcttggtcgtatcccctctgccgtcggttaccagcccactctggccgtcgacatgggtggtatgcaggaacgtattaccaccacca

SEQ ID NO: 2192 - DNA, 1262 bp, Leishmania panamensis
  ref <308>: DATABASE ACCESSION NUMBER: ATCC 50158
gctgacggcgctggacgtgacggaggacctcggccgcgatgagccgctgacgctggagatcgtgcagcacttggatgcgaacaccggccgctgcattgcgatgcagacgacggacctgctgaagctgaagtcgaaggttgtgtcgaccggcggcaacatctccgtgccggtgggccgcgagacgctgggccgcatcttcaacgtgctgggcgacgcgattgaccaccgcggccccgtgtgcgagaagatgcgcatggcgatccacgccgaggcgccgaagctggcggaccaggctgcggaggacacgatcctgacgaccggcatcaaggtgatcgacctgattctgccctactgcaagggcggcaagatcggcctgttcggcggtgccggtgtgggcaagactgtgatcatcatggagctgatcaacaacgtcgcgaaggggcacggcggcttctccgtgttcgccggcgttggcgagcgcacgcgcgagggcacggacctgtacctggagatgatgcagtcaaaggtgattgacctgaagggcgagtcgaagtgcgtgcttgtgtacgggcagatgaacgagcccccgggtgcgcgcgcgcgcgttgcgcagtctgcgctgacgatggccgagtacttccgcgacgtggagggccagaacgtgctgctgttcatcgacaacatcttccgcttcacgcaggcgaactccgaggtgtctgcgctgctgggccgcatcccggccgccgtgggttaccagccgacgcttgcggaggatcttggcatgctgcaggagcgcattacgtcgacgacgaagggatcgattacgtctgtgcaggctgtgtacgtgcctgcggatgatatcacggaccccgcgcccgcgacgacgttctcgcacctggacgcgacgactgtgctggaccgcgcggtggcggagtcgggcatctaccctgccgtgaacccgctggagtgcgcgtcgcgcatcatggaccccgatgtgatcgacgtggaccattacaacgttgcacaggatatcgtccagatgctgaccaagtacaaggagctgcaggacatcattgcggtgcttggcatcgacgagctgagcgaggaggacaaggtcgtggtggaccgcgcgcgcaaggtgacgcggttcctgtcgcagccgttccaggttgcggaggtgttcaccggcatgacgggccactacgtgcagctgagcgacacggtggagtcgttctctggcctgctgatggggtcgtacgacc

SEQ ID NO: 2193 - DNA, 912 bp, Aspergillus nidulans
  strain WSA-176
ttccgatggtcaaatgtacgattgatattccttccagccagtcaggataacagctgataccagttgcaaataggccccagactcgtgagcacttgttgcttgcccgtcaggttggtgtccagaagatcgttgtcttcgtcaacaaggttgacgctgtcgatgaccctgagatgttggagcttgttgagctcgagatgcgtgagctcctcaacacttacggtttcgagggagaggagacccctatcatcttcggttccgccctgtgcgctctcgaaggccgccgcgaggacattggtactcagcgtattgactccctcctcgaggccgttgacacttggatccctaccccccagcgtgacttggacaagcccttcctgatgtccattgaggaagttttctccattggtggtcgtggtaccgtcgcctctggtcgtgtcgagcgtggtctcctcaagaaggataccgaagttgaaattcacggtgctgatggtattctgaagaccaaggtcaccgacattgagaccttcaagaagagctgcgatgagtctcgtgctggtgacaactccggtcttctcctccgtggtatccgtcgtgaggatgttcgtcgtggtatggtcatcgctgcccctggctccatcaaggcctccaagaagttcatggtctccatgtacgtcttgactgaggctgaaggtggccgcaagaacggcttcggtgccaactaccgcccccaggctttcatccgcactgctggtaagtttcgaactatttgattcattgatcacgtccctaactgttactttagacgaggcttgcgaccttcatttccctgatgaggccgacaaggaccgccacgtcatgcccggtgacaacgtcgaaatggtcctcaacctcaacaaccccgttgctgctgag

SEQ ID NO: 2194 - DNA, 887 bp, Aureobasidium pullulans
  strain WSA-234
tcatcgtcgtcgccgcttctgacggtcagatgccccagaccagagagcacttgcttctcgcccgtcaggtcggtatccagaagattgtcgtcttcgtcaacaaggtcgacgccatcgaggacaaggagatgcttgagctcgtcgagatggagatgcgtgagctcctcagcagctacggcttcgagggtgacgagacccccatcgtcatgggttccgctctttgtgcccttgagaaccgccagcccgagattggaaccacccagatcgacaacctgatgaacgctgtcgacgagtggatccccactccccagagagatcttgagaagcccttcctcatgtccgttgaggatgtcttctctatccccggtcgtggtactgtcgtttctggccgtgttgagcgtggtaccctgaagaaggattccgaaatcgagcttgtcggcaagaacaaggtccccatcaagaccaaggtcaccgacatcgagaccttcaagaagtcttgcgacgagtcccgcgctggtgacaactccggtcttctgctccgtggtatcaagcgtgaggatgtcaaccgtggtatggttgtcgtcaagcccggtaccgtcacctcgcacaagaagttcctcgtctccatgtacgtcctgaccaaggaggagggtggtcgtcacactggtttccacggaaactaccgtccccagatcttcatccgtaccgctggtaagtcctgactttgaactgctgaccaattttcgcatctctaacatgttttacagacgaggctgccgctattgactggcccgaaggcaccgaggacgctgactccaagatggtcatgcccggtgacaacgtcgagatggtctgctctcttcacagacctcttgccgttgaacagg

SEQ ID NO: 2195 - DNA, 984 bp, Emmonsia parva
  ref <308>: DATABASE ACCESSION NUMBER: ATCC 10784
tgacggccaaatgtaggactcttgcgcgggactgactgattggggggaatccattttttcttttttctttttctttttgagtacatgattatactaatatttggataacgtaccaggcctcaaacacgtgaacatttactccttgcccgacaagtcggtgtccagaagatcgtcgttttcgtaaacaaggtcgatgttctcgaagataaggagatgttggagcttgtcgagttggaaatgagagagctcttgaacacctacggattcgagggtgaggaaacgcccatcatcttcggttctgccctttgtgccatggagggccgcgagcctgagctgggcgagaagagaattgatgaattgctcgacgctgttgatagctggatccctacgccgcaacgtgatacggaaaaacccttcctaatgtccattgaggaagtgttctccatctccggtcgtggaaccgttgcctccggccgtgttgagcgtggtgtcctcaagaaggattccgaagtcgagcttgttggcggcggcgtcgccccaatcaggaccaaggtaaccgatatcgaaaccttcaagaagtcctgcgacgagtccagggctggagacaactctggccttttgttgcgtggtgtcaagcgtgaggatatccgccgtggtatggtcgttgtcgttcctggcagcgtcaaggcccacgacaagttcttggtgtccatgtatgttctgaccgaagccgagggtggtcgccgaactggattcggccaaaactatcgtcctcaaatgtttatccgcacagctggtacgtaacgtataatgcctctcctcttcatatataccaccccccccaccactgactccctgactcttcgattacagacgaggccgccgatctcagcttccctgacgcagcagacgaaaccaaactggttatgcccggtgacaacgtcgagatgatcctcaagacacaccgccccatagctgccgaag

SEQ ID NO: 2196 - DNA, 806 bp, Exserohilum rostratum
  strain WSA-215
gccgcctctgacggccaaatgccccagacccgtgagcacttgctgcttgctcgccaggtcggtgttcagaagattgttgtttttgtcaacaaggtcgatgccgtcgaggacaaggagatgttggagctcgttgagatggagatgcgtgagttgctcagcagctatggcttcgagggcgatgagactcccattgtcatgggctccgctctctgcgccatcgagggccgtgagcccgaaattggtgtcaaccgtattgatgagctgctcgaggctgtcgacacctggatccccacccctcagcgtgataccgacaagcccttcctcatggctgttgaggacgtcttctccattgctggccgtggtaccgtcgtttctggccgtgtcgagcgaggtgtcttgaagcgcgatgccgaagtcgagctggttggcaagggcactgcgcccatcaagaccaaggttaccgacattgaaaccttcaagaagtcgtgtgaagagtctcgcgccggtgacaactcgggtctcctcctccgtggtgtcaagcgtgacgacgtccgccgtggcatggtcgtttctgttcctggacaagtcaaggcccacaagaagttcctcgtctccatgtatgtgttgagcaaagaggaaggtggccgccacacgggcttcggcgagaactacaggccacaaatgttcatccgtactgctgacgagtcatgcgcgctgcactggccagaaggtaccccagatgctcacgacaagcttgttatgcctggtgataacgttgagatggtttgtgagcttcacgtgccaca

SEQ ID NO: 2197 - DNA, 799 bp, Fusarium moniliforme
  strain WSA-213
acccgtgaacacttgctcctcgctcgtcaggttggtgttcagcgaattgtcgtctttgtcaacaaggtcgatgccattgatgaccccgagatgcttgagctcgtcgagatggagatgcgcgagcttcttaacacctatggcttcgaaggcgacgacactcccgtcatcatgggctcggctctcatgtctctccagaaccagcgccctgagattggcaccgagaagattgatgagcttcttgctgccgtcgacgagtggatcccaacccccgagcgtgaccttgacaagcccttccttatgtccgtcgaggatgtcttctccattgctggccgtggtaccgtcgtgtctggccgtgtggagcgtggtgttctgaagcgtgaccaggagatcgagcttgttggaaagggtcaggaggttatcaagaccaaggttaccgacatcgagaccttcaagaagtcttgtgagcagtcccaggctggtgacaactctggtctcctcatccgaggtgttcgccgtgaggatgtccgccgtggtatggtcgtctgcgctcctggcaccgtgaagtctcacacccagttcctcgcttccctctatgtcctctccaaggaggagggtggccgacacaccggtttccaggagcactaccgaccccagctctacctccgaaccgcagatgagtccattgacctgactttccctgagggtactgaggatgcctccagcaagatggtcatgcctggcgacaacaccgagatggttgtcaccatgggtcaccccaatgccatcgaggttggtcagc

SEQ ID NO: 2198 - DNA, 819 bp, Fusarium solani
  ref <308>: DATABASE ACCESSION NUMBER: ATCC 32793
ctctgacggtcagatgccccagacccgtgagcacttgctgcttgcccgtcaggtcggtgtccagaagattgtcgtcttcgtcaacaaggtcgatgccattgacgaccctgagatgcttgagctcgtcgagatggagatgcgtgagctcctcaacacctacggcttcgagggtgacgagacccctgtcatcatgggctctgctctcatgtccctccagaaccagcgccccgagatcggtagccagaagattgacgagctccttgccgccgttgacgagtggatccctacccccgagcgtgaccttgacaagcccttcctcatgtccgttgaggatgtcttctccattgccggccgtggtaccgtcgtctctggccgtgtcgagcgtggtgtcctgaagcgcgaccaggagattgagctcgtcggcaagggtaacgaggtcatcaagaccaaggtcaccgacattgagaccttcaagaagtcttgcgagcagtcccaggctggtgacaactctggtctcctcatccgaggtgtccgccgtgaggatgtccgccgtggtatggtcgtctgcgcccccggcactgtcaagtcccacactcagttcctttcttccctctacgtcctcaccaaggaggagggtggccgacacactggcttccaggagcactaccgaccccagctctacctccgaactgctgatgagtccatcgacctgaccttccccgagggtaccgaggacgccagcagcaagatggtcatgcccggtgacaacaccgagatggtcatcaccatgggccaccccaacgccattgaggtcggtca

SEQ ID NO: 2199 - DNA, 1025 bp, Histoplasma capsulatum
  strain WSA-377
tgctgacggccaaatgtaagacgccgcgagggagtgctgaaggttttatgctttttaggccctttgtttctgagagcatgatgatactaatactcggaaacgtatctattaggcctcaaacacgtgagcatttgctccttgcccgacaggtcggtgtccaaaagatcgtcgttttcgtgaacaaagtcgacgcccttgaggacaaggagatgttggagcttgtcgagttagaaatgagagagctcttaaacacctacggatttgagggtgaagagacacccatcatctttggttctgccctttgcgccatggaaggccgtgagcctgagttgggagaaaagaaaattgatgaattgctggaggctgttgatacttggatcccaacaccacaacgtgataccgaaaaacctttcttgatgtccgttgaggaagtattctctatctccggtcgtggaaccgttgcctccggtcgtgttgagcgcggtgtcctcaagaaggattcagaagtcgagctaattgggggcggctccacccccatcaggacgaaggtaactgatatcgaaactttcaagaaatcctgtgacgagtctagagctggggacaactccggtcttttattgcgtggtatcaagcgtgaagatatccgccgtggtatggtagttgccgttcctggcagcgtcaaggcccacgacaagttcttggtgtcgatgtatgtcctgaccgaagctgagggtggtcgccgaaccggattcggccagaactatcgtcctcaaatgttcatccgcacagctggtatgtcaaaatggggccccttttcataatcctttctttttttccttttcctctctctatctctctctctgtttcttttcaactcgcctgattcacgaaattaactaacccctttgattatagacgaagccgcccatctcagcttccctagtggagcagatgaaagcaaactcgttatgcctggtgacaacgtcgagatgatcctccagacacaccgccccgtggctgctgag

SEQ ID NO: 2200 - DNA, 667 bp, Kocuria kristinae
  ref <308>: DATABASE ACCESSION NUMBER: ATCC 27570
agcacgtgctgctcgcccgccaggtcggcgtgccgaccctgctggtcgccctgaacaaggccgacatggtcgaggacgaggagctgctggacctcgtcgagatggaggtccgcgagctgctgtcctcccaggagttcgacggcgacaacgcccccgtcatccgcgtctccgcgctgaaggcgctggagggcgacgagaagtgggtcaagtccatcgaggagctcatggaggccgtggacgagtacatcccggaccccgtgcgcgacaaggacaagccgttcctgatgcccatcgaggacgtcttcaccatcaccgggcgcggcaccgtggtgaccggtcgcgccgagcgcgggaccctggccctgaactccgaggtcgagatcgtcggcatccgcccgatccagaagaccacggtcaccgggatcgagatgttccacaagcagctcgacgaggcctgggccggcgagaactgcggtctgctgctgcgcggcctgaagcgcgacgacgtcgagcgcggccaggtcgtggtgaagccgggttccatcaccccgcacaccaacttcgaggcgaacgtctacatcctgtccaaggacgagggtgggcgtcacaacccgttctactcgaactaccgtccgcagttctacttccggaccaccgacgtcaccgg

SEQ ID NO: 2201 - DNA, 778 bp, Vibrio mimicus
  ref <308>: DATABASE ACCESSION NUMBER: ATCC 33653
tgctgcaacagatggtccaatgccacaaactcgtgagcacatcctgctgggtcgccaagtaggtattccttacatcatcgtattcatgaacaaatgtgacatggttgacgatgaagagcttctagagctggttgagatggaagttcgtgagcttctgtctgagtacgatttcccaggtgatgacctgccagtaatccaaggttcagcactaggcgcgctaaacggcgaagcacagtgggaagcgaagattgttgaactagcagaagcactagattcatacattccagagccagagcgtgcagtagacatggcattcctgatgccaatcgaagacgtattctcaatccaaggtcgtggtacagtagtaactggccgtatcgagcgcggcatcctgaaagtgggtgacgaagttgcgatcgttggtatcaaagacacagtaaaaactacctgtacaggtgtagaaatgttccgtaagctgcttgacgaaggtcgtgcaggtgagaacgttggtgcactgctacgtggtactaagcgtgaagaagtagagcgtggtcaagtactggcgaagccaggttcaatcaccccacacactaagttcgaatcagaagtatacgtactgtcaaaagacgaaggtggccgtcatactccattcttcaaaggttaccgtccacagttctacttccgtacaactgacgtaacaggcagcatcgagcttccagaaggcgtagaaatggtaatgccaggcgacaacatcaagatggttgtagacctgattgca

SEQ ID NO: 2202 - DNA, 412 bp, Citrobacter freundii
  ref <308>: DATABASE ACCESSION NUMBER: ATCC 8090
aacgctgaccctgcaggttattgccgctgcgcagcgtgaaggtaaaacctgtgcatttatcgatgcagaacacgcactggacccggtctatgcccgtaagcttggcgttgatatcgataacctgctgtgttctcagccggataccggtgaacaagcgctggaaatctgtgatgcactggcgcgctccggtgcggttgacgttatcgttgtcgactccgttgccgcattgacgccgaaggcagaaatcgaaggcgagattggcgactctcacatgggccttgcggcgcgtatgatgagccaggcgatgcgtaagctggccggtaacctgaagcagtccaacacgctgctgattttcatcaaccagatccgtatgaagattggcgttatgttcggtaacccggaaaccaccacc

SEQ ID NO: 2203 - DNA, 337 bp, Clostridium botulinum
  strain 20:1.2
tttagatccatcttatgctagaaatttaggtgttgatatagataacctaatagtttctcaaccagatacaggagaacaggctttagagataacagaagctttagtaagatcaggagcagtagatgttatagttgtagactctgtagcagctttagttcctagggcagaaatagaaggagaaatgggagactcacatgtaggtcttcaagcaagacttatgtctcaagccctaagaaaattagcaggatctataaataaatctaagtgtgtagctatatttataaaccaattaagagaaaaggttggtataatgtttggaaatccagaaacaactcct

SEQ ID NO: 2204 - DNA, 379 bp, Francisella tularensis
  ref <308>: DATABASE ACCESSION NUMBER: ATCC 29684
aaagcaaggcggtactgcagcatttgttgatgctgagcatgcactagatccaaaatatgcaaagcttttaggtgttgatgttgataatctgatcgtgtcacagccggatacgggtgagcaagctttagagattgctgatatgttggtacgttctggaggagttgatattgtagtaattgactctgttgctgcacttacgccaaaggcagagattgagggtgacatgggcgactcgcacatgggcttacaagcaagattaatgtcacaagcactaagaaaactaacggcaaatatcaagcgctcaaatactctagtgatattcattaaccaaattcgtatgaagatcggggttatgtttggtaaccctgaaactacaact

SEQ ID NO: 2205 - DNA, 337 bp, Peptostreptococcus anaerobius
  ref <308>: DATABASE ACCESSION NUMBER: ATCC 27337
acttgacccagtatatgcaagggctcttggagtggatatagacaacctagtcatatctcagccagatacaggagaacaggccctagatatagcagagtcccttataagatcaggagctgtagatatactagtaatagactcagtagctgccctagtacctaaggcagaaatagaaggtgacatgggagattctcacgtaggtctacaggctagacttatgtcacaggcacttagaaaattgactggatctataaagaagtcaaactgtgttgttatatttatcaaccagttgagagaaaaagtaggggttatgttcggtaatccagagacaacaaca

SEQ ID NO: 2206 - DNA, 337 bp, Peptostreptococcus asaccharolyticus
  strain LSPQ 2639
tcttgatgctggatatgcaaaaaaccttggagtagatgtagaaaatttaattatttctcaacctgatacaggtgagcaagccttagaaataactgaagctcttgtaagatctaacgctgttgatttaattattatagactcagttgccgcacttgtaccaaaagcagaaatcgatggtgacatgggagctgcacaaataggtcttcaagcaagacttatgtctcaagctcttagaaaattaactggggcaatcaacaagtcaaaatgtaccgttgtatttattaaccaacttagagaaaaagttggtatcatgtttggtaacccagaaactacaaca

SEQ ID NO: 2207 - DNA, 408 bp, Providencia stuartii
  ref <308>: DATABASE ACCESSION NUMBER: ATCC 33672
ctcacgttgcaagttattgcagcagcacaacgtagcggaaaaacctgtgcatttatcgacgctgaacatgcgctagatccaatctatgcgaaaaaactgggtgttgatatcgataaccttctatgttctcaacctgatactggtgagcaagcattagagatttgtgatgcactgacgcgttcaggcgctgttgatgtcattatcgttgactccgtggccgcattaacaccaaaagctgaaattgaaggtgaaatcggtgactcacacatgggcttagcggctcgtatgatgagccaagcgatgcgtaaattagcgggtaacttaaagaactcgaatacacttttaatcttcattaaccaaatccgtatgaagattggcgttatgtttggtaacccagaaaccactaca

SEQ ID NO: 2208 - DNA, 403 bp, Salmonella choleraesuis subsp. choleraesuis
  ref <308>: DATABASE ACCESSION NUMBER: ATCC 9150
gctgcaggtgattgccgctgcgcagcgtgaaggtaaaacctgtgcgtttatcgatgcggaacacgcgcttgaccctgtttacgcacgcaagctgggcgtcgatatcgataacctgctttgttctcagccggataccggcgagcaggcgctggaaatctgtgacgcgctggcgcgttcaggcgcggtggacgtcattgtggtcgactccgtagcggcgctaacgccgaaagcggaaatcgaaggcgaaattggcgactctcacatgggcctcgcggcgcgtatgatgagccaggcgatgcgtaagctggcggggaacctaaaacagtccaacacgctgttgattttcatcaaccagatccgtatgaagattggcgtgatgttcggtaacccggaaaccaccacc

SEQ ID NO: 2209 - DNA, 412 bp, Salmonella choleraesuis subsp. choleraesuis
  ref <308>: DATABASE ACCESSION NUMBER: ATCC 14028
gaccctgacgctgcaggtgattgccgctgcgcagcgtgaaggtaaaacctgtgcgtttatcgatgcggaacacgcgcttgaccctgtttacgcacgcaagctgggcgtcgatatcgataacctgctctgctctcagccggataccggcgagcaggcgctggaaatctgtgacgcgctggcgcgttcaggcgcggtggacgtcattgtggtcgactccgtagcggcgctaacgccgaaagcggaaatcgaaggcgaaatcggcgactctcacatgggcctcgcggcgcgtatgatgagccaggcgatgcgtaagctggcggggaacctgaaacagtccaacacgctgttgattttcatcaaccagatccgtatgaagattggcgtgatgttcggtaacccggaaaccaccacc

SEQ ID NO: 2210 - DNA, 337 bp, Staphylococcus saprophyticus
  ref <308>: DATABASE ACCESSION NUMBER: ATCC 15305
attagatcctgtttacgcagaagctttaggcgtagatatacaaaatttatatttatctcaacctgatcatggggaacaaggtttagaaattgccgaagcatttgttagaagtggcgctgttgatatcgttgtggtcgattcagttgctgcgcttacacctaaagctgaaattgaaggtgaaatgggagatacgcacgttggtttgcaagcacgtcttatgtcccaagccttgagaaagctttccggtgcaatttcaaaatcaaatacaacagcagtatttatcaaccaaatccgtgaaaaagttggtgtgatgttcggtaatcctgaagttacacca

SEQ ID NO: 2211 - DNA, 412 bp, Yersinia pseudotuberculosis
  ref <308>: DATABASE ACCESSION NUMBER: ATCC 29833
gacactgacattacaggttatcgccgccgcacagcgtgaaggcaaaacgtgtgcatttatcgatgccgaacatgcccttgacccaatctatgccaagaaattgggtgtagatattgataacctactgtgttctcagccagatactggcgagcaggcactggaaatttgtgatgcgctgactcgctctggtgcggttgacgttatcatcgttgactccgtagcggcattgacaccaaaagctgaaattgaaggtgaaattggcgattctcatatgggccttgccgcgcgtatgatgagccaggctatgcgtaagctggcgggtaacctgaagaatgcgaataccttactgatttttatcaaccaaatccgcatgaaaattggcgtgatgtttggtaacccagaaaccactacc

SEQ ID NO: 2212 - DNA, 404 bp, Zoogloae ramigera
  ref <308>: DATABASE ACCESSION NUMBER: ATCC 25935
cacgctcaccttgcaaaccatcgcggaaatgcaaaaactgggcggcacctgcgcgtttatcgacgccgagcacgcactggacgtcacgtacgcgcaaaagctgggcgtcaacctgagcgatctgctgatctcgcaaccggacaccggcgaacaagcgctggaaatctgcgacgccctggtgcgttccggttcggtggacatggtcgtgatcgactcggtcgccgcgctgaccccgcgcgccgagatcgaaggcgacatgggcgattcgctgccaggtttgcaggcacgtttgatgtcgcaagcactgcgcaagcttaccggttcgatcaaccgcaccaacaccctggtcatcttcatcaaccagatccgcatgaaaatcggcgtcatgttcggcagcccggaaa

SEQ ID NO: 2213 - DNA, 42 bp, Artificial Sequence
  Synthetic DNA Sequence
cgtgccattgacatgatttccgaagaagacgctgaaggcacg

SEQ ID NO: 2214 - DNA, 125 bp, Abiotrophia adiacens
  ref <308>: DATABASE ACCESSION NUMBER: ATCC 49175
caactacattacgttctgcaacacaaggtcgtggtactttcagtatgacatttgaccactatgaagatgttcctaagagcattgcagaagaaatcatcaagaaaaatggcggtaacggagaataa

SEQ ID NO: 2215 - DNA, 140 bp, Acinetobacter baumannii ATCC 19606
cgactcaaatgcgttctatgtctcaaggtcgtgcgacatactcaatggaatttgctaaatatgctgaaactccacgtaacgtggctgaaggcatcatcgctaaattccaagctggcggtaaaaaaggtgacgacgagtaa

SEQ ID NO: 2216 - DNA, 119 bp, Actinomyces meyeri
  ref <308>: DATABASE ACCESSION NUMBER: ATCC 35568
ccggtgacctgcgttctaagacgcagggtcgcgctgtctactccatggagttcgacagctacgccgaggttccgcgcgcggtcgcggatgagatcgtcggcaagtctcggggcaactga

SEQ ID NO: 2217 - DNA, 113 bp, Clostridium difficile
  ref <308>: DATABASE ACCESSION NUMBER: ATCC 9689
cgaccgacgttcgctccatgtcccagggtcgcgcaagctactctatggaattcaaaaaatacaacacagctccggcgcacatcgctgaaactgtatccaaaaaacaaggctga

SEQ ID NO: 2218 - DNA, 119 bp, Corynebacterium diphtheriae
  ref <308>: DATABASE ACCESSION NUMBER: ATCC 27010
gcgacctgcgttcccgtacccagggccgtgcaaactacaccatgatcttcgactcctacgctgaggttcctaccaacgtggcagctgagatcgtggcagagcgcaacggcactgcctaa

SEQ ID NO: 2219 - DNA, 115 bp, Enterobacter cloacae
  ref <308>: DATABASE ACCESSION NUMBER: ATCC 13047
aactcagctgcgttctctgaccaaaggtcgtgcatcatacaccatggaattcctgaagtatgatgatgcgcctaacaacgttgctcaggccgttattgaagcccgtggtaagtaa

SEQ ID NO: 2220 - DNA, 115 bp, Klebsiella pneumoniae subsp. pneumoniae
  ref <308>: DATABASE ACCESSION NUMBER: ATCC 13883
aactcagctgcgttctctgaccaaaggtcgtgcatcatacaccatggaattcctgaagtatgatgatgcgccgaacaacgttgctcaggccgttattgaagcccgtggtaaataa

SEQ ID NO: 2221 - DNA, 113 bp, Listeria monocytogenes
  ref <308>: DATABASE ACCESSION NUMBER: ATCC 15313
caactcaccttcgttcaggtacgcaaggtcgtggtgtatacactatgcaatttgaccactatgaagaagttcctaaatctattgctgaagaaatcattaaagctaatggtgga

SEQ ID NO: 2222 - DNA, 118 bp, Mycobacterium avium
  ref <308>: DATABASE ACCESSION NUMBER: ATCC 25291
cggcgacctgcggtccaagacccaaggccgggcgaactactccatggtcttcgactcctacgccgaagtgccggccaacgtgtcgaaggagatcatcgcgaaggcgacgggtcagtga

SEQ ID NO: 2223 - DNA, 119 bp, Mycobacterium gordonae
  strain M-Gor-1
ccggcgacctgcggtccaagacgcaaggccgggcgaactactccatggtgttcgactcgtacgccgaagttccggcgaacgtgtcgaaggagatcatcgcgaaggcgacgggcgaatag

SEQ ID NO: 2224 - DNA, 118 bp, Mycobacterium kansasii
  strain Mkan-1
cggcgacctgcggtccaagactcaaggccgggcgaactactcgatggtgttcgattcctacgccgaagtgccggctcaggtgtcgaaggagatcatcgcgaaggcgactggcgagtga

SEQ ID NO: 2225 - DNA, 118 bp, Mycobacterium terrae
  strain Mter-1
cggagacttgcggtcgaagacccagggccgggcgaactactccatggtgttcgactcctacgccgaagtgccggcgcaggtggcgaaggagattatcgcgaaggcaacgggcgagtaa

SEQ ID NO: 2226 - DNA, 115 bp, Neisseria polysaccharea
  ref <308>: DATABASE ACCESSION NUMBER: ATCC 43768
gaccgacctgcgttctgcaacccaaggccgcgctacttactctatggagttcaagaaatattctgaagctcctgcccacatagctgctgctgtaactgaagcccgtaaaggctaa

SEQ ID NO: 2227 - DNA, 118 bp, Staphylococcus epidermidis
  ref <308>: DATABASE ACCESSION NUMBER: ATCC 14990
aacttcattacgttctaacacgcaaggtcgcggtacttacacaatgtactttgaccactatgcagaagttcctaaatcaattgctgaagaaatcatcaagaaaaataaaggtgaataa

SEQ ID NO: 2228 - DNA, 118 bp, Staphylococcus haemolyticus
  ref <308>: DATABASE ACCESSION NUMBER: ATCC 29970
aacttcattacgttctaacactcaaggtcgcggtacttacactatgtacttcgatcactatgcagaagttccaaaatcaattgctgatgatatcatcaaaaaaaataaaggtgaataa

SEQ ID NO: 2229 - DNA, 1630 bp, Succinivibrio dextrinosolvens
  ref <308>: DATABASE ACCESSION NUMBER: ATCC 19716
cgttcaatgcgtgttctagacggtgcagttatggtttactgtgctgtgggtggtgttcagcctcagtctgaaaccgtttggagacaggctcagaagtacaaggttcctcgtattgctttcgttaataagatggaccgtactggtgctaatttcctacgtgttgtagagcagattaagacccgtctaaagggtaaccctgttcctctaatgttacctatcggtaaagaggacagctttgttggtgtagttgacctaatcaagcgtaaggctatcgactgggatgaggcatctcagggtatgaagtttgagtacgttgacattccagcagatatggttgaggaagttgaagagtggcgtgcaaagcttgtagaagcagctgcagaagctaacgacgagctgatggataaattcttcggtggtgaagagctgaccgaggaagagatcaaggctgctctacgtgagcgtactcttcgcaacgaaattattcctatgtgctgcggttcagcatttaagaacaagggtgttcaggcaatgcttgacgctgttgttgagtatcttccatctccagcagatgttcctgctgttgagggtaagaccctaaccggtgaagctgatactcgtaaggctgacgataaagagccattctctgctttagcatttaagctagcaaatgacccattcgtaggtaacttaacattcttacgttgctactcaggctttattaagtctggtgacactgtaatgaactcagataagcagaagcgtgagcgtttcggccgtctagttcagatgcacgctaatgctcgtaatgaggttagcgaggtttatgcaggtgacatcgttgctgctattggtctgaaggaaaccgttaccggtgataccttatgtgacccagagcatccaatcattcttgagtcaatcgactttgcagagccagttatctctgtagcagttgagcctaagaccaaggacgatcaggagaagatggctcttgctttacagcgtttagcaaaagaagatccttcattccgcgttcgtacagacgaagagtctggccagaccattatttctggtatgggtgagcttcacctagacatcattgttgaccgtctacgccgtgagttcaaggttgagtgtaatcagggtaagccacaggttgcataccgtgagaccattaagagcaaggttgaacagcaaggtaagtttgctcgtcagtctggtggtcgtggtcagtacggtgactgctggttacgtatggaacctcttgagccaggtaagggctacgaattcgtgaatgagattgttggtggtgtaattcctaaggaatatatccctgcaattgataagggctgtcaggagcagatcgctaacggtgttctagctggtttcccagttgttgacatcaagatcactgtattcgatggttcttaccacgaagttgactcttcagaaatggcattcaagattgctgcttctatggcattcaaagagggcttcaagaaggcaaatcctgttcttctagagcctttaatgaaggtagaagttgatactcctgaagactacatgggtgacgttattggtgacttaaaccgtcgtcgtgctatcgttgaaggcatggaagatggtccta

SEQ ID NO: 2230 - DNA, 1662 bp, Tetragenococcus halophilus
  ref <308>: DATABASE ACCESSION NUMBER: ATCC 33315
ttgaagtgcaacgttcattgcgtgtgctagacggttcagttactgtcttggactcacaatcaggtgttgaaccacaaactgaaacagtttggcgtcaagcaacagaatatcaagtacctcgtattgtattctgtaataaaatggataaggttggcgcagatttcttatattctgtccgatcattgcatgatcgtttagaagctaatgcacaacctatccaattgccaattggtgctgaagataactttgaaggtatcatcgaccttgtgaagatgaaagctgaattttataaagatgatttagggactactttcgaagaaactgaaatcccagatgaatataaagaaacagctcaagaatggcataataatttggtagaatctgtagctgattttgatgaagatatcatgatgaaatacttggaaggtgaagaaattacacctgaagagttacaagcaggtattcgtaaagcaacattatctgttgaattttacccagtattatgtggttctgcatttaaaaacaaaggtgttcaaatgatgttggatgcagtaattgattacttgccttctccaaccgacgttcccccaattaaagggatcgatccgaaaacagatgaagaaactgaacatcctgctgatgatagtgagcctttttcatcacttgcttttaaagttatgtcagacccttatgttggccgcttaactttcttccgtgtttattcaggtgtgttggatacaggttcttatgtattgaatgctactaagggttcacgtgaacgaattggtcgtattttgcaaatgcatgccaattctcgttctgagatcgataaggtttattcaggtgacattgcagctgctgtaggcttgaagaacactacaacaggggataccctttgtgatgagaaaaatccagttattttggaaactatcaacttccctgaaccagtaattcaagttgctgttgaacctaagtcaaaagctgaccaagataaaatgagcgtagcactacaaaaacttgcagaagaagacccatcttttaaagtggaaaccaacgctgaaactggcgaaactgtaattgctggtatgggtgaacttcaattagacgttcttattgaccgtatgaagactgaatttaaagtggatgccaatattggtgcaccacaagtttcttatcgtgaaactttccgttcatcaactaaagctgaagggaaatttatccgccaatctggtggtagaggtcaatacggtcacgtatgggttgaatttactccaaacgaagaaggagcaggattcgaatttaaaaactccattgttggtggggttgtccctcgtgactatatacctgcagtacaaaaaggactggaagacgccatggaaaatggtgtgttagctggttatccattagttgacgtaaaggcagaactgtttgatggttcttaccatgacgtcgactctaatgaaacagccttccgtattgcggcttcaatgtctctacgtgaagctgcgaaaaaggcagatccagttattcttgaaccgatgatgaaagtaacaattagtatccctgaagaatatctaggtgatattatgggacatgttacagctcgtcgtggtcgtgttgaaggaatggatgctcacggtaatgcacaaactgtaaatgcgt

SEQ ID NO: 2231 - DNA, 1652 bp, Veillonella parvula
  ref <308>: DATABASE ACCESSION NUMBER: ATCC 10790
aagtagaacgttctctacgtgtacttgacggttctgttgcggtgttcagtgctaaaggtggcgttgaacctcaatccgaaacagtatggcgtcaggcttctaactacggcgtacctcgtatcgcttatgtaaataagatggatactgtaggtgctgacttcttcaacgtagttgacatgatgaaagctcgtttgggtgcaaattccgtagctatccaagtaccaatcggtgctgaagatactttcgaaggcatcattgacttgatgactatgaaagcggaaatttataaatccgatgacggtaaagaatatgaaatcactgatatccctgctgaatatcaagaagtagcagaagctcgtcgcgaaatgatgatcgatgctatcgctgaaacagatgatgatatcatgatgaaatatttggaaggcgaagaaatttctgtggaagaattgaaagcggcattgcgtaaagctgttattgctaaccaattattcccagttctttgtggttcttcctataaaaataaaggtgttcaaatgttattggatgctgttatcgattacatgccagctccaatcgacatcccacctattaaaggtgttgttcctggtactgaagaagaaacaactcgtccttcttccgatgaagagccattctctgcattggcattcaaaatcatggctgacccttatgttggtaaattagcgttcttccgtgtgtactccggtacattggaatctggctcctacgttttcaactccactaaaggtaaaaaagaacgtatcggtcgtattcttcaaatgcacgctaactcccgtaaagaaatcgaacgcgtatattctggtgacatcgctgcggcggttggcttaaaggatactactacaggcgacacattgtgtgatgaaaaatctcctgtaatccttgagtccatggaattccctgaaccagttatctccgttgctgttgaacctaaaacaaaagctgaccaagaaaaaatgggtacagctcttgctcgtttggcagaagaagatcctactttcaaagttcgtactgatgaagaaacaggtcaaactattatctctggtatgggcgaacttcacttggatatcatcgttgaccgtatgaaccgtgaattcaaagtagattgtaacgtaggtaaacctcaagtagcataccgcgaaactatccgtaaagctgttaaggctgaaggtaaattcgtacgtcaatctggtggtcgtggtcaatatggtcactgctggttggaattgattcctcaagaaccaggtgctggcttcgagtttgaaaacaaggttgtaggtggtgcgattcctcgtgaatacatcggacctgttgaaagcggtgttaaagaagctatggaatccggtgttatcgctgggtaccctatggttgatgttaaagttatcgtatttgatggttcttaccatgacgttgactccaacgaaatggccttcaaaattgctggttctatgggcttcaaagaaggtgctcgcaaagcagaccctgcattgcttgaaccatatatggctgtagaagtagacgttcctgaagaatacatgggcgacgttatcggtgacttgaactctcgtcgtggtcgcatggacggcatggaagctcgtaatggttcccaacatatc

SEQ ID NO: 2232 - DNA, 1624 bp, Yersinia pseudotuberculosis
  ref <308>: DATABASE ACCESSION NUMBER: ATCC 29833
agtagagcgttccatgcgtgttcttgacggcgcggtaatggtttactgtgcagttggtggtgttcagccacagtctgaaaccgtatggcgtcaggctaataaatataaagttccacgtattgcgttcgttaacaaaatggaccgtatgggtgcgaacttcctgcgcgtagttggtcaactgaaatctcgccttggtgcgaacccagttccactgcagttggcaattggcgcagaagaaaaattcaccggtattatcgatctggtgaaaatgaaagcgatcaactggaacgaagctgatcagggcgtgaccttcgaatatgaagaaatccctgctgatatggctgaactggctgctgaatggcaccagaatctggttgaatctgcggcagaagcgtctgacgagctgatggacaaatacttgggtggcgaagagctgaccgaagaagaaatcaagaaagctttacgtcaacgtgttctgaaaagcgaaattattcttgttacctgtggttctgcgtttaaaaacaaaggcgtacaggcaatgctggatgcggttattgagtacctgcctgcaccaactgacgttgaatcaatcaacggcatcttggatgatggcaaagatactccggctgttcgtcattctgacgacaaagagccgttctctgctctggcgttcaaaatcgctaccgacccattcgtgggtaacctgacgttcttccgcgtgtactctggtattgttaattccggtgataccgttctgaactcagtgaaatcgcaacgtgaacgcttaggtcgtatcgtacagatgcacgctaacaagcgtgaagagatcaaagaagttcacgccggtgatatcgcagccgctatcggtctgaaagatgtgactacgggtgacactttgtgtgacccgaataatccgatcatcttggaacgtatggagttcccagagccggtaatctctgttgctgttgaaccaaaaaccaaagctgaccaagaaaaaatgggtatggctctggggcgtttggcgaaagaagatccatcattccgcgtttggactgacgaagaatctggtcagactatcatcgctggtatgggtgagttgcatttggatatcctggttgaccgtatgcgccgcgaatttaacgtggaagcaaacgtcggtaaacctcaggttgcgtaccgtgaaactatccgcgaaaccgttaaggatgtggaaggtaagcacgctaagcagtcaggcggtcgtggtcagtatggtcatgttgttatcgacatgtctccattgccaccgggtggtgttgggtatgaattcgtcaacgaaatcgttggtggttctattcctaaagaattcattccggccgttgataaaggtattcaagaacagctgaaatctggccctctggcaggttacccagttgttgacgttaaagtgcgtctgcactacggttcttaccatgacgttgactcctcagaattggcatttaaattagctggttctatcgcctttaaagaaggtttcaaacgagctaaaccagttctgcttgagccaatcatgaaggttgaagtcgaaacccctgaagattacatgggtgacgtaatgggcgacctgaaccgtcgtcgcggtatc

SEQ ID NO: 2233 - DNA, 1636 bp, Zoogloae ramigera
  ref <308>: DATABASE ACCESSION NUMBER: ATCC 25935
gaacgctcgatgcgcgtgcttgacggtgcttgcatggtttactgcgcagtgggcggtgttcagccacagtcggaaaccgtgtggcgtcaggctaacaagtacaaagtgccacgtctggccttcgtcaacaagatggaccgtaccggcgccaacttcttcaaggtgtacgagcagatgcgtgctcgcctgaaggccaacccggtcctgatccagatccctatcggcgctgaagacaacttcaaaggcgtgatcgatctggtcaagatgaaggctatcctgtgggacgaagcgtcgcaaggcatgaaattcgactacgtcgatattcctgcagagctggctgattcggccgccgagtggcgcgaaaagatggttgaagctgctgctgaagccaccgaagagctgatgaacaagtacctggaagaaggcgacctgaccgaagccgagatcaagcaggcgctgcgtacccgtaccatcgcttcggaaatcgttccgatgatgtgcggtaccgccttcaagaacaagggcgtacaggccatgctggacgcggtcatcgaatacctgccatcgccactggacatcgacgatgtcggcggtacggacgaagacgaccagccaaccacccgtcgcgcagctgacgacgagaaattctcggcgctggccttcaagatcatgaccgacccgttcgtcggtcaattggccttcttccgcgtgtactcgggcgccgtcaattcgggcgacaccgtgtacaactcggtcaaaggtcgtaaagagcgtctgggccgtattctgcagatgcacgcgaatcagcgcgaagagatcaaagaagtgcgcgccggcgacatcgccgctgcggttggcctgaaagacgtgaccacgggcgaaaccctgtgcgatccgaccgccatcatcacgctggaaaaaatgatcttccctgagcctgtgattcaacaggcagtcgagccaaaaaccaaggccgaccaggaaaaaatgggcctggcactgaaccgcctggcacaggaagatccttcgttccgcgtgaagaccgatgaagaatcgggccagaccatcatcggtggwatgggcgagctgcacctggaaattatcgttgaccgcatgaagcgcgaattcggcgtggaagcaaccgtcggcaagccacaagtggcttaccgcgaaacgatccgtaaaacctgcgaagaatcggaaggcaagttcgtcaagcaatccggtggtcgtggtcaatacggtcacgttgtgctgaagatcgagccgcaagaaccaggcaagggcttcgagttcgttgacgccatcaagggcggtaccgttcctcgcgagtacatccctgcggtggaaaaaggcgtgcgcggcaccctgaacaccggcgtgctggctggttacccggtcgtggacgtcaaggtcacgctgttcttcggttcgtaccacgatgtggactcgaacgaaaacgcgttccagatggccgcttcgatggcattcaaagaaggctgccgcaaagcatcgccagtcattctggagccaatgatggctgtggaagtggaaacgccggaagactacgccggtaccgtgatgggcgacctgtcgtcccgccgcggtatggtgcagggcatggacgaaatcccag

SEQ ID NO: 2234 - DNA, 1656 bp, Aeromonas hydrophila
  ref <308>: DATABASE ACCESSION NUMBER: ATCC 7966
ggcacgaacgatcttgccggacgggccatcttccataccttcgatcaggccacgacgacggttcaggtcaccgatcacgtcgcccatatagtcttccggagtctcgacttctactttcatgatcggttcgagcagaaccgggttggccttcatgaagccagccttaaaggccatggaagcagcgatcttgaacgccagttcggaagagtcgacatcgtggtaggaaccgaagtgcagacgcacgcccagatccataaccggataacctgccagcgggccggacttcagttgctcgcggatacccttgtcaacacccgggatgaactcaccaggaatgacgccgcccttgatgtcgttgacgaattcgtaggctttgccttcttccagcgggtacatgtcgatcacaacgtgaccgtactgaccacgaccaccggactgcttggcgtgcttaccttcgatatccttgacggtgttacgaatggtttcacggtaggcaacctgcggcttacctacgttcgcttctaccttgaactcgcgacgcatacggtcaacgatgatgtccaggtgcagctcacccataccggcgatgatggtttggccagactcttcgtcagtccatacgcggaaggacgggtcttcctgagccagacggcccagagccaggcccatcttctcttggtcagccttggttttcggctcaactgcgatggagattaccggttccgggaattccatacgctcgaggatgatcggcgctttttcgtcacacagggtgtcaccggtggtcacgtctttcagaccaatggcggcagcgatgtcgcctgcgcgaacttctttgatctcttcacgcttgttggcgtgcatctgaacgatacggccaaaacgctcgcgcttctctttaacggagttcagcacggagtcaccggagttaaccacaccggagtaaacgcggaagaaggtcaggttgcctacgaacgggtcggtagcaatcttgaatgccagagcagcaaacggctcgtcatcagaagcatgacgctcgtctttggtctcgccatccagcttcagaccgtcgatggctgctacgtcggtcggcgccggcagatagtcaaccacggcatccagcatggcctgtacgcccttgttcttgaacgcggagccacaggtaaccaggatgatttcgttgttcagaacacgctgacgaagagctttcttgatctcttcctcggtcagttcttcaccacccaggtatttttccatcaggtcttcagacgcttcagcagcggcttcaaccagggtcatgcgcatttcttgcgctttttccagcagctcagccgggacgtcttcgtaatcgaaggatacgccctggtcagcttcgctccagttgatggctttcatcttgaccaggtcgataacgcccttgaagttctcttctgaaccgatgttcagttgcagcggaaccgggttacctttcagacgggtcttgatgtgctcaacgcagcgcaggaagttggcaccggtacggtccatcttgttgacgaacgcgatacggggaaccttgtacttgttagcctgacgccatacggtttcagactgtggctgtacgccachtacggcacagtacaccatcacggcgccgtccagaacacgcatggaacg

SEQ ID NO: 2235 - DNA, 155 bp, Abiotrophia adiacens
  ref <308>: DATABASE ACCESSION NUMBER: ATCC 49175
tctcctccccatttgataactaccaaatgaacgctatcgactggttatgtcagtcataaccagttgatttttaagagagttctttggtataattacaatcggtagatactgttatagaatctaacaaaactcaattaataggaggaatcatttaa

SEQ ID NO: 2236 - DNA, 94 bp, Acinetobacter baumannii
  ref <308>: DATABASE ACCESSION NUMBER: ATCC 19606
tctttcgattactataagccctaactaattcttagttaaaaaccaagtgctcatggagcgaccctccatgagtagttaataaaggaagatcatc

SEQ ID NO: 2237 - DNA, 150 bp, Actinomyces meyeri
  ref <308>: DATABASE ACCESSION NUMBER: ATCC 35568
gtcccaccgggggtgagtgggggccgggcaatcggcccctgcgagccgcctcacacaccagtaatcccagtaggtctcatgccccatgggtgttaaagtgacacctagccgtaggctgagaatttctacccgagtccaggaggacgaaaa

SEQ ID NO: 2238 - DNA, 30 bp, Clostridium difficile
  ref <308>: DATABASE ACCESSION NUMBER: ATCC 9689
ttcagtcctttaggcaaggagttaattgtc

SEQ ID NO: 2239 - DNA, 317 bp, Corynebacterium diphtheriae
  ref <308>: DATABASE ACCESSION NUMBER: ATCC 27010
caactagcctctcgcttatctccctatgcaaaatttctagtcagttacagggcatagggggagcgtaggcgggggtagcggcttgctgagcacttcctctacatcaaagggaatgttgagccggccgttaccctgtacgatcccatctggtttcttcggtggtttgataaataccccgttgtgaccctaggatcatgtaactggcacaatgtaaatagctgtactgccaggctgccgaattagcagtcagaaatgtacagcactgtcaactcgtggctgcgaaatcgtagccaccacgaagtccaggaggacacaca

SEQ ID NO: 2240 - DNA, 69 bp, Enterobacter cloacae
  ref <308>: DATABASE ACCESSION NUMBER: ATCC 13047
tccacaggattaaaacctaagtcccgtgctctctcctgaggggagagcactatagtaaggaatatagcc

SEQ ID NO: 2241 - DNA, 69 bp, Klebsiella pneumoniae subsp. pneumoniae
  ref <308>: DATABASE ACCESSION NUMBER: ATCC 13883
tccacaggattaaaacctaagtcccgtgctctctccgaaggggagagcactatagtaaggaatatagcc

SEQ ID NO: 2242 - DNA, 126 bp, Listeria monocytogenes
  ref <308>: DATABASE ACCESSION NUMBER: ATCC 15313
aacaacaaagaagattaattgatttttttcgcaacatcaagtataactttagttagaagtattacttagtttaaatttaagctaagtaaaaaataattatcgaattatcgaggaggatattttaaa

SEQ ID NO: 2243 - DNA, 170 bp, Mycobacterium avium
  ref <308>: DATABASE ACCESSION NUMBER: ATCC 25291
gtgtcaactcactggctcggagccgagcaatcggctcagcgaaggcgacgggtcagtagctactggcagcggagtaatcttgccgggtcattggaatgccttgggcgcggcacaactgaaaacaccaacactgctttaacaagcaccaactagtccaggaggacacagaa

SEQ ID NO: 2244 - DNA, 103 bp, Mycobacterium gordonae
  strain M-Gor-1
ggccggcaagcctgcgagtaagctgacgcggttagcaccgcggcaaaaccaagaaaaatcaacactgcttttttaagcaccaacagtccaggaggacaacaaa

SEQ ID NO: 2245 - DNA, 101 bp, Mycobacterium kansasii
  strain Mkan-1
gccgagcgttgcgcgtaagctagctcggttaccacggcggcaaaactagaaaaacatcaacactgcttttataagcaccaacagtccaggaggacacagaa

SEQ ID NO: 2246 - DNA, 91 bp, Mycobacterium terrae
  strain Mter-1
ccagcttcccgcccgtgccgctacggtggcacaaacccaaaaagatcaatcctgctgtaacccagcaccaacaagtccaggaggacaagaa

SEQ ID NO: 2247 - DNA, 87 bp, Neisseria polysaccharea
  ref <308>: DATABASE ACCESSION NUMBER: ATCC 43768
tcaggcaaataggccgtctgaaaggctgaaatgatttttcagacggcattgttctttaatcgatctttaatgtaaaggaattagctc

SEQ ID NO: 2248 - DNA, 218 bp, Staphylococcus epidermidis
  ref <308>: DATABASE ACCESSION NUMBER: ATCC 14990
tataacttgttaagactagctatgctaggttaaaatacaggttgagcttatttataagctgacatttttatgatttgatttttaggggtaaatgcattataaaagaattataaattcttttatgctacactcaatcaattttcttctcatgatggtgagaaactatcatgagagataaatttgaaataacttttattaagaataggagagatttaata

SEQ ID NO: 2249 - DNA, 204 bp, Staphylococcus haemolyticus
  ref <308>: DATABASE ACCESSION NUMBER: ATCC 29970
ttaaacttgttttagctagaatttctaggtaaaatacagcgtaagcttattaattaagctaacatctttatgaattgattttttactgaaaatgcattataaatgaattatgaattctaacaatcattatgtctcatgatggtgagaaactatcatgagagataatattgaaataacttttactagaataggagagatttaata

SEQ ID NO: 2250 - DNA, 38 bp, Artificial Sequence
  Synthetic DNA Sequence
ccgtcggatggtgtcgtataccgcggagtcgccgacgg

SEQ ID NO: 2251 - DNA, 38 bp, Artificial Sequence
  Synthetic DNA Sequence
cggagccgttctcgctgcgttacatgctggtggctccg

SEQ ID NO: 2252 - DNA, 18 bp, Artificial Sequence
  Synthetic DNA Sequence
ccacatacagtgtctctc

SEQ ID NO: 2253 - DNA, 19 bp, Artificial Sequence
  Synthetic DNA Sequence
cattacccaaccgaaagta

SEQ ID NO: 2254 - DNA, 19 bp, Artificial Sequence
  Synthetic DNA Sequence
acctgaacagagagaaatg

SEQ ID NO: 2255 - DNA, 273 bp, Abiotrophia adiacens
  ref <308>: DATABASE ACCESSION NUMBER: ATCC 49175
atggcaaaagaaaaatttgaccgttcaaaaccacacgttaacattggtacaatcggccacgttgaccacggtaaaacaacattaactgctgctatcacaactgttttagctaagaaaggtttcgcgcaagctcaagattacggttcaatcgataaagctccagaagaacgcgaacgtggtatcacaatcaacacttctcacgttgagtacgaaacagacactcgtcactatgctcacgttgactgcccaggacacgcggactacgttaaaaac

SEQ ID NO: 2256 - DNA, 273 bp, Acinetobacter baumannii
  ref <308>: DATABASE ACCESSION NUMBER: ATCC 19606
atggctaaagccaagtttgaacgtaataaaccacacgtaaacgtgggtacaatcggtcacgttgaccatggtaaaacaactttaactgctgcgattgcaacaatttgtgcaaaaacttacggcggtgaagcgaaagattactcacaaatcgactcagcacctgaagaaaaagcacgtggtattacaattaatacatcacacgtagaatacgattctccaactcgtcactacgcacacgttgactgcccaggccacgccgactacgttaaaaac

SEQ ID NO: 2257 - DNA, 279 bp, Actinomyces meyeri
  ref <308>: DATABASE ACCESSION NUMBER: ATCC 35568
gtggcgaaggccaagtttgagcgcaccaagccgcacgtcaacatcggcacgattggtcacgttgaccacggcaagacgacgctgacggcagctatcaccaaggtgctgcatgacaagtaccccgaactgaacgagttcacccccttcgatcaggtcgacaacgctcccgaggagcgcgatcgtggcatcacgatcaacgtctctcacgttgagtaccagaccgaggcgcgtcactacgcgcacgttgacgctcccggccacgccgactacgtcaagaac

SEQ ID NO: 2258 - DNA, 273 bp, Clostridium difficile
  ref <308>: DATABASE ACCESSION NUMBER: ATCC 9689
gtggctaaagaaaaatttgatcgttccctaccgcacgtcaacgttggcactatcggtcacgttgaccatggtaaaaccactctgactgctgctctgactcgcgtttgctccgaagtattcggttccgcaatcgttgatttcgataaaatcgacagcgcaccagaagaaaaagctcgtggtatcaccatcaacaccgcgcacgttgaatacaactcgctgatccgtcactacgctcacgttgactgcccaggtcacgctgactatgtgaagaac

SEQ ID NO: 2259 - DNA, 279 bp, Corynebacterium diphtheriae
  ref <308>: DATABASE ACCESSION NUMBER: ATCC 27010
gtggcaaaggctaagttcgagcgtaccaagccgcacgtcaacatcggcaccatcggtcacgttgaccacggtaagaccaccaccaccgctgctatcaccaaggttttggcagacgcttacccagagctgaacgaagctttcgctttcgatgccatcgataaggcaccggaagagaaagagcgtggtattaccatcaacatctcccacgtggagtaccagaccgagaagcgccactacgcacacgttgacgctccaggtcacgctgactacatcaagaac

SEQ ID NO: 2260 - DNA, 273 bp, Enterobacter cloacae
  ref <308>: DATABASE ACCESSION NUMBER: ATCC 13047
gtgtctaaagaaaaatttgaacgtacaaaaccgcacgtcaacgttggtactatcggccacgttgaccatggtaaaactaccctgactgctgcaatcactaccgttctggctaaaacctacggtggttctgctcgtgcattcgaccagatcgataacgcaccagaagaaaaagctcgtggtatcaccatcaacacctctcacgttgaatatgacaccccgactcgccactacgcacacgtagactgcccaggtcacgccgactatgttaaaaac

SEQ ID NO: 2261 - DNA, 273 bp, Klebsiella pneumoniae subsp. pneumoniae
  ref <308>: DATABASE ACCESSION NUMBER: ATCC 13883
gtgtctaaagaaaaatttgaacgtacaaaaccgcacgtcaacgttggtactatcggccacgttgaccatggtaaaactaccctgactgctgccatcactaccgttctggctaaaacctacggtggttccgctcgcgcattcgaccagatcgataacgcgccggaagaaaaagctcgtggtatcaccatcaacacctctcacgttgaatatgacaccccgactcgccactacgcgcacgtagactgcccgggccacgccgactatgttaaaaac

SEQ ID NO: 2262 - DNA, 273 bp, Listeria monocytogenes
  ref <308>: DATABASE ACCESSION NUMBER: ATCC 15313
atggcaaaagaaaaatttgaccgctctaaaccccatgttaacattggtactattggacacgttgaccatggtaaaacaactttaactgctgcaattacaactgtacttgctaaaaaaggctatgctgatgcacaagcttatgaccaaattgatggtgctccagaagaaagagaacgtggaatcacaatctctactgctcacgttgagtaccaaactgacagccgtcactatgcacacgttgactgcccaggacatgccgattacgttaaaaac

SEQ ID NO: 2263 - DNA, 279 bp, Mycobacterium avium
  ref <308>: DATABASE ACCESSION NUMBER: ATCC 25291
gtggcgaaggcgaagttcgagcggacgaagccgcacgtcaacatcgggaccatcggtcacgttgaccacggcaagaccacgctgaccgcggctatcaccaaggttctgcacgacaagtacccggacctgaacgagtcccgcgcgttcgaccagatcgacaacgcgcccgaggagcgtcagcgcggtatcaccatcaacatctcccacgtggagtaccagaccgacaagcggcactacgctcacgtcgacgccccgggtcacgccgactacatcaagaac

SEQ ID NO: 2264 - DNA, 279 bp, Mycobacterium gordonae
  strain M-Gor-1
gtggcgaaggcgaagttccagcggaccaagccgcacgtcaacatcgggaccatcggtcacgttgaccacggcaagaccactctgaccgcggctatcaccaaggtcctgcacgacaagtacccggacctgaacgagtccaaggcgttcgaccagatcgacaacgcgcctgaggagcgtcagcgcggtatcacgatcaacatcgcgcacgtggaataccagaccgagaagcgtcactacgcgcacgtcgacgcccccggccacgccgactacatcaagaac

SEQ ID NO: 2265 - DNA, 279 bp, Mycobacterium kansasii
  strain Mkan-1
gtggcgaaggcgaagttccagcggaccaagccccacgtcaacatcgggaccatcggtcacgttgaccacggcaagaccaccctgaccgcggctatcaccaaggtcctgcatgacaagttcccggacctgaacgagtcgaaggcgttcgaccagatcgacaacgctcctgaggagcgccagcgcggtatcacgatcaacatcgcgcacgtggagtaccagaccgagaagcggcactatgcacacgtcgacgcgccgggccacgccgactacatcaagaac

SEQ ID NO: 2266 - DNA, 279 bp, Mycobacterium terrae
  strain Mter-1
gtggcgaaggcgaagttcgagcggacgaagccgcacgtcaacatcgggaccatcggtcacgttgaccacggcaagaccacgctgaccgcggctatcaccaaggttctgcacgacaagtacccggacctcaacgagtcgcgtgcgttcgaccagatcgacaacgctcccgaagagcgtcagcgcggtatcaccatcaacatctcccacgtggagtaccagaccgagaagcggcactacgcccacgtcgacgctcctggtcacgctgactacatcaagaac

SEQ ID NO: 2267 - DNA, 273 bp, Neisseria polysaccharea
  ref <308>: DATABASE ACCESSION NUMBER: ATCC 43768
atggctaaggaaaaattcgaacgtagcaaaccgcacgtaaacgttggcaccatcggtcacgttgaccatggtaaaaccactctgactgctgctttgactactattttggctaaaaaattcggcggtgctgcaaaagcttacgaccaaatcgacaacgcacccgaagaaaaagcacgcggtattaccattaacacctcgcacgtagaatacgaaaccgaaacccgccactacgcacacgtagactgcccgggtcacgccgactacgttaaaaac

SEQ ID NO: 2268 - DNA, 273 bp, Staphylococcus epidermidis
  ref <308>: DATABASE ACCESSION NUMBER: ATCC 14990
atggcaaaagaaaaatttgatcgctcaaaagaacatgccaatattggtactatcggtcacgttgaccatggtaaaacaactttaacagctgctatcgcaactgtattagctaaaaatggtgacactgttgcacaatcatacgatatgattgacaacgctccagaagaaaaagaacgtggtattacaatcaatactgcacatatcgaataccaaactgacaaacgtcactatgctcacgttgactgcccaggacacgctgactatgttaaaaac

SEQ ID NO: 2269 - DNA, 273 bp, Staphylococcus haemolyticus
  ref <308>: DATABASE ACCESSION NUMBER: ATCC 29970
atggcaaaagaaaaatttgatcgctcaaaagaacatgccaatattggtactatcggtcacgttgaccatggtaaaactactttaacagctgctatcgcaactgtattagctaaaaatggtgacactgtagcacaatcatatgacatgattgacaacgctccagaagaaaaagaacgtggtatcacaatcaatactgcacacatcgagtatcaaactgacaaacgtcactatgctcacgttgactgcccaggacacgctgactatgttaaaaac

SEQ ID NO: 2270 - DNA, 812 bp, Aeromonas hydrophila
  ref <308>: DATABASE ACCESSION NUMBER: ATCC 7966
cgatcctggtagtagcagcgactgacggcccgatgccgcagactcgtgagcacatcctgctgggtcgtcaggtaggcgttccgtacatcatcgtgttcatgaacaagtgtgacatggtagatgacgaagagctgctggaactggtcgagatggaagttcgcgaactgctgtccgagtacgacttcccgggtgatgacctgccggtagtccgtggttcygcactgaaagcgctggaaggcgaagctcagtgggaagagaagatcctggaactggctggccacctggacacctacattccggagccggagcgtgccatcgacctgccgttcctgatgcctatcgaagacgtattctccatcgctggccgyggtaccgtagtgaccggtcgtgtagagcgcggtatcgtcaaagttggtgaagaagtggaaatcgtkggtatcaaagataccaccaagaccacctgtaccggcgttgaaatgttccgcaaactgctggacgaaggtcgtgcaggcgagaacatcggtgcactgctgcgtggcgtgaagcgtgaagacgtagagcgtggtcaggtactggccaagccgggcaccatcaagccgcacaccaagttygaatctgaagtgtacgtgctgtccaaagaagaaggtggtcgtcataccccgttcttcaaaggctaccgtccgcagttctacttccgtactaccgacgtgaccggtaccatcgaactgccggaaggcgtagagatggtaatgccgggcgacaacatcaagatggttgttaccctgattgcgccgatcgcgatggacgacggc

SEQ ID NO: 2271 - DNA, 799 bp, Bilophila wadsworthia
  ref <308>: DATABASE ACCESSION NUMBER: ATCC 49260
cgacggtcccatgccccagacccgtgagcacatcctgctcgcccgtcaggtcggcgtgcctcacctcgtcgtgttcatgaacaagtgtgacctcgtcgacgaccccgaactgctcgaactcgtcgaaatggaagtccgcgaactgctgagctcctacggctaccccggcgatgaaatcccggttgtccgcggttccgctctgaaggctctggaatccgatagcgctgattcccctgacgcccagtgcgtgctcgaactgctcgccgcttgcgacagctacttcccggatccggtccgcgaaaccgacaagcccttcctgatgcccatcgaagacgtgttctccatctccggccgcggtaccgtggtcaccggtcgtgtggaacgtggcatcatcaaggtcggcgaagaagtcgaaatcgtgggtatccgtcccaccgtgaagacgacctgcaccggcgtcgaaatgttccgcaagctgctcgatcagggccaggccggcgacaacatcggcgctctgctccgcggcacgaagcgtgacgaagtggaacgcggccaggttctcgccgctcccaagagcatcacgccccacaagaagttcaaggctgaagtgtacgttctgtccaaggaagaaggcggccgccataccccgttcttcaccggctatcgtcctcagttctacttccgtaccaccgacatcaccggtatcatcgctcttgaagaaggcgttgaaatggttatgcccggcgataacgctacctttaatgtcgagctcattcaccccatcgccatggaaaagggc

SEQ ID NO: 2272 - DNA, 786 bp, Brevundimonas diminuta
  ref <308>: DATABASE ACCESSION NUMBER: ATCC 11568
gatcctggtgtgctcggccgctgacggcccgatgccgcagacccgcgagcacatcctgctgtcgcgtcaggtcggcgttccggcgctggtggtgttcctgaacaaggtcgacatggtcgacgacgaggarctgctggagctggtcgagatggaagtgcgcgagctgctgagctcgtaccagttcccgggcgacgacatcccggtggtcaagggctcggccctggccgcggtggaggatcgcgacccgcacatcggcgccgagcgcgttctggagctgatggcggcggtcgacagctacatcccgcagccggaacgtccgatcgacatgccgttcctgatgccggtggaagacgtgttctcgatctcgggccgcggcaccgtggtgacgggtcgcgtcgagcgcggcgtcgtcaaggtcggtgaagaagtcgaaatcgtcggcatccgtccggttcagaagacgacctgcacgggcgtcgaaatgttccgcaagctgctggaycagggtcargccggcgacaacgtgggcgtgctgctgcgcggcaccaagcgtgaagacgtcgagcgcggccaggtgctgtgcaagccgggttcgatcaccccgcacaccaagttcgtggctgaagcctacatcctgaacaaggaagaaggcggccgtcacacgccgttcttcacgaactaccgtccgcagttctacttccgcacgacggacgtgaccggcatcgtgcgcctgaaggaaggcgtcgagatgatcatgccgggcgacaacgccgagctggacgtcga

SEQ ID NO: 2273 - DNA, 560 bp, Streptococcus mitis
  strain LSPQ 2583
gctattatggctggattactatccaatacgctatccaagaatcccgtaacgtacctgccgtcaaatcgctggaagcagtcggattagataattcattgaaattcctcaatggccttggtatcaattatcctgagatgcattattctaatgcgatttcaagtaatacaagcgaatctggtaaccaatacggagcaagtagcgaaaaaatggctgccgcttacgctgcctttgctaatggcggtacatattacaaaccgcaatacgtcaaccgagttgtctttagcgacggtacagaaaaagtcttttcaaatggcggatcaaaagccatgaaagagacgacagcctacatgatgacagacatgatgaagaccgttcttcagtctggaactggtaccaatgctgcaatcccaggagtttatcaagcaggtaaaactggtacttccaactatgcagatgatgagctagagaagttgacaaaaccttattacagttctagcattgtcacaccagacgaactatttgttggctatactccacaatactctatggctgtttggaca

SEQ ID NO: 2274 - DNA, 551 bp, Streptococcus mitis
  ref <308>: DATABASE ACCESSION NUMBER: ATCC 49456
gctactttggaaacattactgtccaatatgctcttcaacaatcacgtaatgtcacagccgttgaaactttgaataaggtcggtctagataaggctaaagccttccttaatgggcttggtattgattatccaagcatgcattatgcaaacgccatttcaagtaatacaactgaatccaacaaaaaatacggtgcaagtagtgaaaaaatggctgctgcctacgctgcttttgctaatggtggtatttaccacaagccaatgtacatcaataaaatcgtctttagcgacggtagtgagaaagaattttctgatgccggcacacgagctatgaaagaaactactgcctatatgatgactgaaatgatgaaaacagtcctagtatacggtaccggacgtggagcctacctaccatggcttccacaagcaggtaagacaggtacttctaactatactgacgacgaaattgaaaagtatatcaagaacactggctacgtagccccagatgaaatgtttgtagggtatactcgtaaatatgcaatggctgtttggaca

SEQ ID NO: 2275 - DNA, 560 bp, Streptococcus mitis
  ref <308>: DATABASE ACCESSION NUMBER: ATCC 903
gctattatggctggattactatccaatacgctatccaagaatcccgtaacgtaccagccgtcaaatcgctggaagcagtcggattagataattcattgaagttcctcaatggccttggtattaattaccctgaaatgcattattctaatgcgatttcaagtaatacaagcgaatctggtaaccaatacggagcaagtagcgaaaaaatggctgccgcttacgctgcctttgctaatggcggtacatattacaaaccgcaatacgtcaaccgagttgtctttagcgacggtacagaaaaagtcttttcaaatggcggatcaaaagccatgaaagaaacgacagcctacatgatgacagacatgatgaagaccgttcttcaatctggaactggtaccaatgctgcaattccaggagtctatcaagcaggtaaaaccggcacttccaactatgcagatgatgaactagagaagttgacaaaaccttattacagttctagcattgtcacaccagacgagctgtttgttggctacactccacagtactctatggctgtttggaca

SEQ ID NO: 2276 - DNA, 550 bp, Streptococcus oralis
  ref <308>: DATABASE ACCESSION NUMBER: ATCC 35037
ttattttggaaatatcaccatccaatatgcgctccaacaatcacggaacgttacagccgtagaaaccttgaacaaagtcggtttggatagagccaagaccttcctgaatggaatcggtattgactatccagatatgcactatgccaacgcgatttcaagtaatacgactgagtcaaacaaaaagtacggagcaagtagtgagaaaatggctgctgcttacgctgcttttgctaacggtggtatctaccataaaccaatgtatatcaacaaaatcgtctttagcgatggtagctcaaaagaatacgctgatcctggtactcgtgccatgaaagagacgaccgcctatatgatgacagaaatgatgaagactgtcttggcatacggaacgggtcgtggtgcttatctcccttggctacctcaagctggtaagactggtacatcaaactatacagatgatgaaattgaaaactacatcaaaaatactggttatgtagccccagacgaaatgtttgttggttatactcgcaaatattcaatggctgtwtggaca

SEQ ID NO: 2277 - DNA, 356 bp, Escherichia coli
  ref <308>: DATABASE ACCESSION NUMBER: ATCC 35401
gctcctatctggattatgcgatgtcggtcattgttggccgtgcgctgccagatgtccgagatggcctgaagccggtacaccgtcgcgtactttacgccatgaacgtactaggcaatgactggaacaaagcctataaaaaatctgcccgtgtcgttggtgacgtaatcggtaaataccatccccatggtgactcggcggtctatgacacgatcgtccgcatggcgcagccattctcgctgcgttatatgctggtagacggtcagggtaacttcggttctatcgacggcgactctgcggcggcaatgcgttatacggaaatccgtctggcgaaaattgcccatgaactgatggccgat

SEQ ID NO: 2278 - DNA, 347 bp, Escherichia coli
  ref <308>: DATABASE ACCESSION NUMBER: ATCC 23511
ctcttatctggattatgcgatgtcggtcattgttggccgcgcgctgccggatgtccgagatggcctgaagccggtacaccgtcgcgtactttacgccatgaacgtattgggcaatgactggaacaaagcctacaaaaaatcagcccgtgtcgttggtgacgtgatcggtaaataccacccgcacggcgactccgcggtatatgacaccatcgttcgtatggcccagccgttctcgctgcgctacatgctggtggatggccaggggaacttcggttcaatcgacggcgactccgccgcggcaatgcgttatacggaaatccgtctggcgaaaattgctcacgaactga

SEQ ID NO: 2279 - DNA, 362 bp, Escherichia coli
  ref <308>: DATABASE ACCESSION NUMBER: ATCC 43886
agagctcctatctggattatgcgatgtcggtcattgttggccgtgcgctgccagatgtccgagatggcctgaagccggtacaccgtcgcgtactttacgccatgaacgtactaggcaatgactggaacaaagcctataaaaaatctgcccgtgtcgttggtgacgtaatcggtaaataccatccccatggtgactcggcggtctatgacacgatcgtccgcatggcgcagccattctcgctgcgttatatgctggtagacggtcagggtaacttcggttctatcgacggcgactctgcggcggcaatgcgttatacggaaatccgtctggcgaaaattgcccatgaactgatggccgatctc

SEQ ID NO: 2280 - DNA, 358 bp, Escherichia coli
  ref <308>: DATABASE ACCESSION NUMBER: ATCC 25922
ctcctatctggattatgcgatgtcggtcattgttggccgtgcgctgccagatgtccgagatggcctgaagccggtacaccgtcgcgtactttacgccatgaacgtactaggcaatgactggaacaaagcctataaaaaatctgcccgtgtcgttggtgacgtaatcggtaaataccatccccatggtgactcggcggtttatgacacgatcgtccgtatggcgcagccattctcgctgcgttacatgctggtagacggtcagggtaacttcggttccatcgacggcgactctgcggcggcaatgcgttatacggaaatccgtctggcgaaaattgcccatgaactgatggccgatctc

SEQ ID NO: 2281 - DNA, 30 bp, Artificial Sequence
  Synthetic DNA Sequence
cccccagctgggcggcggtatcgatggggg

SEQ ID NO: 2282 - DNA, 18 bp, Artificial Sequence
  Synthetic DNA Sequence
  modified_base (7): i
agrrgcnmaratgtatga

SEQ ID NO: 2283 - DNA, 22 bp, Artificial Sequence
  Synthetic DNA Sequence
  modified_base (3): i
  modified_base (13): i
atntatgayggknttcagaggc

SEQ ID NO: 2284 - DNA, 21 bp, Artificial Sequence
  Synthetic DNA Sequence
  modified_base (11): i
tctgwgtracnggytckgaga

SEQ ID NO: 2285 - DNA, 19 bp, Artificial Sequence
  Synthetic DNA Sequence
  modified_base (5): i
cmccnccwggtggwgawac

SEQ ID NO: 2286 - DNA, 20 bp, Artificial Sequence
  Synthetic DNA Sequence
agttgctgtattaggaaatg

SEQ ID NO: 2287 - DNA, 20 bp, Artificial Sequence
  Synthetic DNA Sequence
tcgaagttgctgtattagga

SEQ ID NO: 2288 - DNA, 1240 bp, Enterococcus faecium
  strain BM4339
tagaagctggctcgtttttttataaataagttattcgtttatttttgttttgtgctaaaatatgagagtaaatcactgaacgatttagaatacaggaggacaatcttttgaagattactttactatatggcggacgcagcgcagagcagagcatgaagtgtccattctttccgcattttcagttttaaatgccatttattataattattaccaagttcaactcgtatttattacaaaagaaggacaatgggtcaaaggtccattactaacagaaaaacctgccagcaaagatgtcttgcatctttcatgggacccaagtggacagacagaggaaggctttacaggaaaagtgatcaatccgggcgaaatcaaagaagaaggagccatcgtttttccagttttacatgggccaaacggggaagatggaacgatccaaggcttcttagagacattgaatatgccttatgtcggcgcaggcgtattgaccagtgcatgtgccatggataaaatcatgaccaagtatattttacaagctgctggtgtgccgcaagttccttatgtaccagtacttaagaatcaatggaaagaaaatcctaaaaaagtatttgatcaatgtgaaggttctttgctttatccgatgtttgtcaaaccggcgaatatgggttctagtgtcggcattacaaaagcagaaaaccgagaagagctgcaaaatgctttagcaacagcctatcagtatgattctcgagcaatcgttgaacaaggaattgaagcgcgcgaaatcgaagttgctgtattaggaaatgaagacgttcggacgactttgcctggtgaagtcgtaaaagacgtagcattctatgattatgaagcaaaatatatcaataataaaatcgaaatgcagattccagccgaagtgccagaagaagtttatcaaaaagcgcaagagtacgcgaagttagcttacacgatgttaggtggaagcggattgagccggtgcgatttctttttgacaaataaaaatgaattattcctgaatgaattaaactctatgccaggatttacggagttcagtatgtacccactcttatgggaaaatatgggcttgaaatacggtgatttgattgaagaactgatccagttaggaatgaatcgataccatcagcgtcaatctttttttgaaaaaaatgaataaagagaaataaagaagaggctggagtgattgcgtaaccgcgttcattctagc

SEQ ID NO: 2289 - DNA, 20 bp, Artificial Sequence
  Synthetic DNA Sequence
caccgaagaagatgaaaaaa

SEQ ID NO: 2290 - DNA, 18 bp, Artificial Sequence
  Synthetic DNA Sequence
tggcaccgaagaagatga

SEQ ID NO: 2291 - DNA, 19 bp, Artificial Sequence
  Synthetic DNA Sequence
attttggcaccgaagaaga

SEQ ID NO: 2292 - DNA, 19 bp, Artificial Sequence
  Synthetic DNA Sequence
gaatcggcaagacaatatg

SEQ ID NO: 2293 - DNA, 1032 bp, Enterococcus faecium
  strain BM4147
atgaatagaataaaagttgcaatactgtttgggggttgctcagaggagcatgacgtatcggtaaaatctgcaatagagatagccgctaacattaataaagaaaaatacgagccgttatacattggaattacgaaatctggtgtatggaaaatgtgcgaaaaaccttgcgcggaatgggaaaacgacaattgctattcagctgtactctcgccggataaaaaaatgcacggattacttgttaaaaagaaccatgaatatgaaatcaaccatgttgatgtagcattttcagctttgcatggcaagtcaggtgaagatggatccatacaaggtctgtttgaattgtccggtatcccttttgtaggctgcgatattcaaagctcagcaatttgtatggacaaatcgttgacatacatcgttgcgaaaaatgctgggatagctactcccgccttttgggttattaataaagatgataggccggtggcagctacgtttacctatcctgtttttgttaagccggcgcgttcaggctcatccttcggtgtgaaaaaagtcaatagcgcggacgaattggactacgcaattgaatcggcaagacaatatgacagcaaaatcttaattgagcaggctgtttcgggctgtgaggtcggttgtgcggtattgggaaacagtgccgcgttagttgttggcgaggtggaccaaatcaggctgcagtacggaatctttcgtattcatcaggaagtcgagccggaaaaaggctctgaaaacgcagttataaccgttcccgcagacctttcagcagaggagcgaggacggatacaggaaacggcaaaaaaaatatataaagcgctcggctgtagaggtctagcccgtgtggatatgtttttacaagataacggccgcattgtactgaacgaagtcaatactctgcccggtttcacgtcatacagtcgttatccccgtatgatggccgctgcaggtattgcacttcccgaactgattgaccgcttgatcgtattagcgttaaaggggtga

SEQ ID NO: 2294 - DNA, 20 bp, Artificial Sequence
  Synthetic DNA Sequence
aaacgaggatgatttgattg

SEQ ID NO: 2295 - DNA, 18 bp, Artificial Sequence
  Synthetic DNA Sequence
ttgagcaagcgatttcgg

SEQ ID NO: 2296 - DNA, 1029 bp, Enterococcus faecalis; identical to SEQ ID NO: 1713
  strain V583

SEQ ID NO: 2297 - DNA, 17 bp, Artificial Sequence
  Synthetic DNA Sequence
ttcaggagggggatcgc

SEQ ID NO: 2298 - DNA, 20 bp, Artificial Sequence
  Synthetic DNA Sequence
cttaacgctgcgatagaagc

SEQ ID NO: 2299 - DNA, 45 bp, Artificial Sequence
  Synthetic DNA Sequence
cccagcgctgtcatattgtcttgccgattcaattgcgtcgctggg

SEQ ID NO: 2300 - DNA, 41 bp, Artificial Sequence
  Synthetic DNA Sequence
cacccgaggatgatttgattgtcggcgaagtggatcgggtg

SEQ ID NO: 2301 - DNA, 41 bp, Artificial Sequence
  Synthetic DNA Sequence
ccggcgatgcctcttcacattgctccacctttcctcgccgg

SEQ ID NO: 2302 - DNA, 294 bp, Artificial Sequence
  Synthetic DNA Sequence
aatagcgcggacgaattggacaagtacaagaaggttggttacaacccaaagacagctgtgcatgaattgcagaaaatttattgcagcttcgccacaggaaaggtggagcaatgtgaagaggcatcatgccatctgctgtaggctatcaaccaatggtaagactcttctggaagcaattgagctatggtcatgccaggtgacaacatatgatgagtcatgccatgcgtaaatcaaagataatgttcagggaacatccggtaaagttactggtaaggtatcttccgcatccatcag

SEQ ID NO: 2303 - protein, 177 aa, S. aureus
REHILLSRNVGVPALVVFLNKVDMVDDEELLELVEMEVRDLLSEYDFPGDDVPVIAGSALKALEGDAQYEEKLELMEAVDTYIPTPERDSDKPFMMPVEDVFSITGRGTVATGRVERGQIKVGEEVEIIGLHDTSKTTVTGVEMFRKLLDYAEAGDNIGALLRGVAREDVQRGQVLA

SEQ ID NO: 2304 - protein, 177 aa, S. epidermidis
REHILLSRNVGVPALVVFLNKVDMVDDEELLELVEMEVRDLLSEYDFPGDDVPVIAGSALKALEGDAEYEQKLLLMQAVDTYIPTPERDSDKPFMMPVEDVFSITGRGTVATGRVERGQIKVGEEVEIIGMHETSKTTVTGVEMFRKLLDYAEAGDNIGALLRGVAREDVQRGQVLA

SEQ ID NO: 2305 - protein, 179 aa, E. durans
REHILLSRQVGVPYIVVFLNKVDMVDDEELLELVEMEVRDLLTEYEFPGDDVPVIAGSALKALEGDASYEEKILELMAAVDEYIPTPERDNDKPFMMPVEDVFSITGRGTVATGRVERGQVRVGDVVDIVGIAEETAQTTVTGVEMFRKLLDYAEAGDNIGALLRGVAREDIQRGQVLA

SEQ ID NO: 2306 - protein, 179 aa, E. hirae
REHILLSRQVGVPYIVVFLNKVDMVDDEELLELVEMEVRDLLTEYEFPGDDVPVVAGSALKALEGDASYEEKILELMAAVDEYIPTPERDNDKPFMMPVEDVFSITGRGTVATGRVERGQVRVGDVVDIVGIAEETAQTTVTGVEMFRKLLDYAEAGDNIGALLRGVAREDIQRGQVLA

SEQ ID NO: 2307 - protein, 179 aa, E. mundtii
REHILLSRQVGVPYIVVFLNKVDMVDDEELLELVEMEVRDLLTEYEFPGDDVPVIAGSALRALEGDASYEEKILELMAAVDEYIPTPERDNDKPFMMPVEDVFSITGRGTVATGRVERGQVRVGDVIDIVGIAEETAQTTVTGVEMFRKLLDYAEAGDNIGALLRGVSREDIQRGQVLA

SEQ ID NO: 2308 - protein, 179 aa, E. faecium
REHILLSRQVGVPYIVVFLNKVDMVDDEELLELVEMEVRDLLTEYEFPGDDVPVVAGSALKALEGDASYEEKILELMAAVDEYIPTPERDNDKPFMMPVEDVFSITGRGTVATGRVERGQVRVGDEVEVVGIAEETSKTTVTGVEMFRKLLDYAEAGDNIGALLRGVAREDIQRGQVLA

SEQ ID NO: 2309 - protein, 179 aa, E. cecorum
REHILLSRNVGVPYIVVFLNKVDMVDDEELLELVEMEVRDLLTEYDFPGDDVPVIAGSALKALEGDPSYEEKILELMAAVDEYIPTPERDNDKPFMMPVEDVFSITGRGTVATGRVERGQVRVGDEVEIVGIHDEISKTTVTGVEMFRKLLDYAEAGDNIGALLRGVAREDIQRGQVLA

SEQ ID NO: 2310 - protein, 178 aa, E. columbae
REHILLSRNVGVPYIVVFLNKVDMVDDEELLELVEMEVRDLLTEYDFPGDDVPVIAGSALKALEGDPAYEEKILELMAAVDEYIPTPERDNKPFMMPVEDVFSITGRGTVATGRVERGQVRVGDEVEIVGIADETSKTTVTGVEMFRKLLDYAEAGDNIGALLRGVAREDIQRGQVLA

SEQ ID NO: 2311 - protein, 180 aa, E. cassel falvus
REHILLSRNVGVPYIVVFLNKMDMVDDEELLELVEMEVRDLLSEYDDFPGDDVPVIAGSALKALEGDASYEEKIMELMAAVDEYVPTPERDTDKPFMMPVEDVFSITGRGTVATGRVERGQVRVGDEVEIVGIAEETAKTTVTGVEMFRKLLDYAEAGDNIGALLRGVAREDIQRGQVLA

SEQ ID NO: 2312 - protein, 179 aa, E. gallinarum
REHILLSRNVGVPYIVVFLNKMDMVDDEELLELVEMEVRDLLSEYDFPGDDVPVIAGSALKALEGDPSYEEKIMELMAAVDEYVPTPERDTDKPFMMPVEDVFSITGRGTVATGRVERGQVRVGDEVEIVGIADETAKTTVTGVEMFRKLLDYAEAGDNIGALLRGVAREDIQRGQVLA

SEQ ID NO: 2313 - protein, 179 aa, E. faecalis
REHILLSRNVGVPYIVVFLNKMDMVDDEELLELVEMEVRDLLSEYDFPGDDVPVIAGSALKALEGDESYEEKILELMAAVDEYIPTPERDTDKPFMMPVEDVFSITGRGTVATGRVERGEVRVGDEVEIVGIKDETSKTTVTGVEMFRKLLDYAEAGDNIGALLRGVAREDIERGQVLA

SEQ ID NO: 2314 - protein, 179 aa, E. avium
REHILLSRNVGVPYIVVFLNKMDMVDDEELLELVEMEVRDLLTEYDFPGDDTPVIAGSALKALEGDASYEEKILELMAAVDEYIPTPVRDTDKPFMMPVEDVFSITGRGTVATGRVERGQVRVGDEVEIVGIADETAKTTVTGVEMFRKLLDYAEAGDNIGALLRGVAREDIQRGQVLA

SEQ ID NO: 2315 - protein, 179 aa, E. raftinosus
REHILLSRNVGVPYIVVFLNKMDMVDDEELLELVEMEVRDLLTEYDFPGDDTPVIAGSALKALEGDASYEEKILELMAAVDEYIPTPVRDTDKPFMMPVEDVFSITGRGTVATGRVERGQVRVGDEVEIVGIAEETAKTTVTGVEMFRKLLDYAEAGDNIGALLRGVAREDIQRGQVLA

SEQ ID NO: 2316 - protein, 179 aa, E. dispar
REHILLSRNVGVPYIVVFLNKMDMVDDEELLELVEMEVRDLLSEYDFPGDDTPVIAGSALKALEGDASYEEKILELMAAVDEYIPTPVRDTDKPFMMPVEDVFSITGRGTVATGRVERGQVRVGDEVEIVGIAEETAKTTVTGVEMFRKLLDYAEAGDNIGALLRGVAREDIQRGQVLS

SEQ ID NO: 2317 - protein, 179 aa, E. malodoratus
REHILLSRNVGVPYIVVFLNKMDMVDDEELLELVEMEVRDLLSEYDFPGDDTPVIAGSALKALEGDASYEEKILELMAAVDEYIPTPVRDTDKPFMMPVEDVFSITGRGTVATGRVERGQVRVGDEVEIVGIAEATAKTTVTGVEMFRKLLDYAEAGDNIGALLRGVAREDIQRGQVLA

SEQ ID NO: 2318 - protein, 179 aa, E. pseudoavium
REHILLSRNVGVPYIVVFLNKMDMVDDEELLELVEMEVRDLLSEYDFPGDDTPVIAGSALKALEGDPSYEEKILELMAAVDEYIPTPVRDTDKPFMMPVEDVFSITGRGTVATGRVERGQVRVGDEVEIVGIAEETAKTTVTGVEMFRKLLDYAEAGDNIGALLRGVAREDIQRGQVLA

SEQ ID NO: 2319 - protein, 179 aa, E. surlfureus
REHILLSRNVGVPYIVVFLNKMDMVDDEELLELVEMEVRDLLSEYDFPGDDTPVVAGSALKALEGDASYEEKIMELMAAVDEYIPTPTRDTDKPFMMPVEDVFSITGRGTVATGRVERGQVRVGDVVDIVGIADETAQTTVTGVEMFRKLLDYAEAGDNIGALLRGVAREDIQRGQVLA

SEQ ID NO: 2320 - protein, 179 aa, E. saccharolyticus
REHILLSRNVGVPYIVVFLNKMDMVDDEELLELVEMEVRDLLSEYDFPGDDTPVIAGSALKALEGDPVYEEKIFELMAAVDEYIPTPERDTEKPFMMPVEDVFSITGRGTVATGRVERGQVRVGDVVEIVGIDEETAQTTVTGVEMFRKLLDYAEAGDNIGALLRGVAREDIQRGQVLA

SEQ ID NO: 2321 - protein, 178 aa, E. solitarius
REHILLSRNVGVPYIVVFLNKMDMVDDEELLELVEMEVRDLLSEYDFPGDDTPVISGSALKALEGDEEYEQKIMDLMDAVDDYIPTPERDHDKPFMMPIEDVFSITGRGTVATGRVERGTIKVGDEVDIGIHEDVKKTTVTGVEMFRKLLDYAEAGDNIGTLLRGVSRDDIERGQVLA

SEQ ID NO: 2322 - protein, 177 aa, E. monocytogenes
REHILLSRQVGVPYIVVFMNKCDMVDDEELLELVEMEIRDLLTEYEFPGDDIPVIKGSALKAQGEADWEAKIDELMEAVDSYIPTPERDTDKPFMMPVEDVFSITGRGTVATGRVERGQVKVGDEVEIGIEEESKKVVVTGVEMFRKLLDYAEAGDNIGALLRGVAREDIQRGQVLA

SEQ ID NO: 2323 - protein, 178 aa, E. casselflavus
REHILLSRQVGVKHLIVFLNKTDLVDDDELIDLVEMEVRELLTEYDFPGDDIPVIKGSALKALEGDPAEAAILTLMDTVDEYIPTPERDTDKPLLLPIEDVFSITGRGTVASGRIDRGMVKVGDEVEIVGIKPETQKAVVTGVEMFRKTMDFGEAGDNVGVLLRGITRDEIERGQVLA

SEQ ID NO: 2324 - protein, 178 aa, E. gallinarum
REHILLSRQVGVKHLIVFLNKIDLVDDEELIDLVEMEVRELLSEYNFPGDDIPVIKGSALKALEGDPDAEAAIMELMDTVDSYIPTPERDTDKPLLLPVEDVFSITGRGTVASGRIDRGTVRVGDEVEIVGIKPETQKAVVTGVEMFRKMDFGEAGDNVGVLLRGITRDEIERGQVLA

SEQ ID NO: 2325 - protein, 180 aa, E. durans
REHILLSRQVGVKYLIVFLNKIDLVDDEELIDLVEMEVRELLSEYGFPGDDTPVIKGSALKALQGDPDAEAAIMELTDTVDEYIPTPERDTDKPLLLPVEDVFSITGRGTVASGRIDRGAVRVGDEIEIVGIKPETQKAVVTGVEMFRKTLDYGEAGDNVGVLLRGIQREDIERGQVLIA

SEQ ID NO: 2326 - protein, 179 aa, E. faecium
REHILLSRQVGVKYLIVFLNKVDLVDDEELIDLVEMEVRELLSEYGFPGDDTPVIKGSALKALQGDPDAEAAIMELMDTVDEYIPTPERDTDKPLLLPVEDVFSITGRGTVASGRIDRGAVRVGDEVEIVGIKPETQKAVVTGVEMFRKTLDYGEAGDNVGVLLRGIQRDDIERGQVLA

SEQ ID NO: 2327 - protein, 179 aa, E. hirae
REHILLSRQVGVKYLIVFLNKTDLVDDEELIDLVEMEVRELLSEYGFPGDDTPVIKGSALKALQGDPDAEAAIMELMDTVDEYIPTPERDTDKPLLLPAEDVFSITGRGTVASGRIDRGAVRVGDEIEIVGIKPETQRAVVTGVEMFRKTLDYGEAGDNVGVLLRGIQREDIERGQVIA

SEQ ID NO: 2328 - protein, 178 aa, E. mundtii
REHILLSRQVGVKYLIVFLNKVDLVDDEELIDLVEMEVRELLNEYGFPGDDTPVIKGSALKALQGDPEAEAAINELMETVDDYIPTPERDTDKPLLLPVEDVFSITGRGTVASGRIDRGAVRVGDEIEIIGIKPETKKAVVTGVEMFRKLDYGEAGDNVGILLRGIQREDIERGQVIA

SEQ ID NO: 2329 - protein, 179 aa, E. avium
REHILLSRQVGVKHLIVFLNKVDLVDDEELIDLVEMEVRELLSEYGFPGDDIPVLKGSALKALEGDPEQEQVILDLMDTVDEYIPTPERDTDKPFLLPVEDVFSITGRGTVASGRIDRGEVKVGDEVEIIGIKPEIQKAVVTGLEMFRKTLDYGEAGDNVGVLLRGITRDEIERGQVLA

SEQ ID NO: 2330 - protein, 179 aa, E. pseudoavium
REHILLSRQVGVKHLIVFLNKVDLVDDEELIDLVEMEVRELLSEYGFPGDDIPVLKGSALKALEGDPEQEQVILDLMDTVDEYIPTPERDTDKPFLLPVEDVFSITGRGTVASGRIDRGEVKVGDEVEIIGIKPEVQKAVVTGLEMFRKTLDYGEAGDNVGVLLRGITRDEIERGQVLA

SEQ ID NO: 2331 - protein, 179 aa, E. malodoratus
REHILLSRQVGVKHLIVFLNKVDLVDDEELIDLVEMEVRELLSEYGFPGDDIPVLKGSALKALEGDPEQEQVILDLMDTVDEYIPTPERDNDKPFLLPVEDVFSITGRGTVASGRIDRGEVKVGDEIEIIGIKPEVQKAIVTGLEMFRKTLDYGEAGDNVGVLLRGITRDEIERGQVLA

SEQ ID NO: 2332 - protein, 179 aa, E. rafinosus
REHILLSRQVGVKYLIVFLNKVDLVDDEELIDLVEMEVRELLSEYGFPGDDIPVLKGSALKALEGDPEQEQVIMDLMDTVDEYIPTPERDTDKPFLLPVEDVFSITGRGTVASGRIDRGEVKVGDEVEIIGIKPEVQKAVVTGLEMFRKTLDYGEAGDNVGVLLRGITRDEIERGQVLA

SEQ ID NO: 2333 - protein, 178 aa, E. dispar
REHILLARQVGVKYLIVFLNKTDLVDDEELLELVEMEVRELLNEYNFPGDDIPVIRGSALKALEGDPEQEEVIMNLMDTVDEYIPTPERDNKPFLLPVEDVFTITGRGTVASGRIDRGKVNVGDEIEIIGIKPETQKAVVTGLEMFRKTLDYGEAGDNVGVLLRGITRDEVERGQVLA

SEQ ID NO: 2334 - protein, 178 aa, S. pneumoniae
REHILLSRGVGVKHLIVFMNKVDLVDDEELLELVEMEIRDLLSEYDFPGDLPVIQGSALKALEGDSKYEDIVMELMNTVDEYIPEPERDTDKPLLLPVEDVFSITGRGTVASGRIDRGIVKVNDEIEIVGIKEETQKAVVTGVEMFRKQLDEGLAGDNVGVLLRGVQRDEIERGQVIA

SEQ ID NO: 2335 - protein, 179 aa, S. suis
REHILLSRQVGVKHLIVFMNKVDLVDDEELLELVEMEIRDLLSEYDFPGDDLPVIQGSALKALEGDSKYEDIVMELMNTVDEYIPEPERDTDKPLLLPVEDVFSITGRGTVASGRIDRGTVRVNDEIEIVGLQEEKSKAVVTGVEMFRKQLDEGLAGDNVGVLLRGVQRDEIERGQVIS

SEQ ID NO: 2336 - protein, 179 aa, S. pyogenes
REHILLSRQVGVKHLIVFNMKVDLVDDEELLELVEMEIRDLLSEYDFPGDDLPVIQGSALKALEGDTKFEDIIMELMDTVDSYIPEPERDTDKPLLLPVEDVFSITGRGTVASGRIDRGTVRVNDEIEIVGIKEETKKAVVTGVEMFRKQLDEGLAGDNVGILLRGVQRDEIERGQVIA

SEQ ID NO: 2337 - protein, 179 aa, S. mutans
REHILLSRQVGVKYLIVFMNKVDLVDDEELLELVEMEIRDLLSEYDFPGDDIPVIQGSALKALEGDTGQEDIIMELMHTVDDYIPDPERDTDKPLLLPVEDVFSITGRGTVASGRIDRGTVKVNDEVEIVGIRDDIQKAVVTGVEMFRKQLDEGIAGDNVGVLLRGIQRDEIERGQVLA

SEQ ID NO: 2338 - protein, 178 aa, L. lacits
REHILLSRQVGVKYLIVFLNKADLVDDEELMELVEMEVRDLLSEYDFPGDDIPVIAGSALGALNGEPQWVAKVEELMDIVDEYIPTPERDTDKPLLPVEDVFSITGRGTVASGRIERGTVKVGDEVEIVGIKEETKKAVVTGIEMFRKTLTEGLAGDNVGALLRGIQRDEIERGQVIA

SEQ ID NO: 2339 - protein, 189 aa, T. aquaticus
REHILLARQVGVPYIVVFMNKVDMVDDPELLDLVEMEVRDLLNQYEFPGDEVPVIRGSALLALEEMHKNPKTKRGENEWVDKIWELLDAIDEYIPTPVRDVDKPFLMPVEDVFTITGRGTVATGRIERGKVKVGDEVEIVGLAPETRKTVVTGVEMHRKTLQEGIAGDNVGLLLRGVSREEVERGQVLA

SEQ ID NO: 2340 - protein, 178 aa, E. coli
REHILLGRQVGVPYIIVLFNKCDMVDDEELLELVEMEVRELLSQYDFPGDDTPIVRGSALKALEGDAEWEAKILELAGFLDSYIPEPERAIDKPFLLPIEDVFSISGRGTVVTGRVERGIIKVGEEVEIVGIKETQKSTCTGVEMFRKLLDEGRAGENVGVLLRGIKREEIERGQVLA

SEQ ID NO: 2341 - DNA, 35 bp, Artificial Sequence
  oligonucleotide
gagatcggtgaagaagagcgttgggcgattcaccg

SEQ ID NO: 2342 - DNA, 35 bp, Artificial Sequence
  oligonucleotide
gacatcggtgaagaagagcgttgggcgatccaccg

SEQ ID NO: 2343 - DNA, 50 bp, Artificial Sequence
  oligonucleotide
gagctgaaagaagaagatggcagcgcagtagagatcgcctctattcaccg

SEQ ID NO: 2344 - DNA, 50 bp, Artificial Sequence
  oligonucleotide
gacctgaaagaagaagacggcagcgctgtagaggtttcctctattcatcg

SEQ ID NO: 2345 - DNA, 50 bp, Artificial Sequence
  oligonucleotide
gacctgaagaacgaagatggtagcaatgttgaggtgaactctattcaccg

SEQ ID NO: 2346 - protein, 11 aa, Artificial Sequence
  oligonucleotide
IGEEERWAIHR

SEQ ID NO: 2347 - protein, 11 aa, Artificial Sequence
  oligonucleotide
IGEEERWAIHR

SEQ ID NO: 2348 - protein, 16 aa, Artificial Sequence
  oligonucleotide
LKEEDGSAVEIASIHR

SEQ ID NO: 2349 - protein, 16 aa, Artificial Sequence
  oligonucleotide
LKEEDGSAVEVSSIHR

SEQ ID NO: 2350 - protein, 16 aa, Artificial Sequence
  oligonucleotide
LKNEDGSNVEVNSIHR

SEQ ID NO: 2351 - DNA, 25 bp, Artificial Sequence
  oligonucleotide
tgcttaagattcactctgccatttt

SEQ ID NO: 2352 - DNA, 21 bp, Artificial Sequence
  oligonucleotide
taagtcgctgacggcttgttt

SEQ ID NO: 2353 - DNA, 20 bp, Artificial Sequence
  oligonucleotide
cctgcaccacaagtcatcat

SEQ ID NO: 2354 - DNA, 22 bp, Artificial Sequence
  oligonucleotide
aattcaccaacaatgtcaaagc

SEQ ID NO: 2355 - DNA, 22 bp, Artificial Sequence
  oligonucleotide
aatgataaccagtcaagcaagc

SEQ ID NO: 2356 - DNA, 21 bp, Artificial Sequence
  oligonucleotide
ggtgcatggtgatttgtaaaa

SEQ ID NO: 2357 - DNA, 22 bp, Artificial Sequence
  oligonucleotide
gtgtgcgttcacttttacaaat

SEQ ID NO: 2358 - DNA, 22 bp, Artificial Sequence
  oligonucleotide
ggtgttaagctgatgatgagag

SEQ ID NO: 2359 - DNA, 20 bp, Artificial Sequence
  oligonucleotide
tgaccatgcacacccttatt

SEQ ID NO: 2360 - DNA, 22 bp, Artificial Sequence
  oligonucleotide
tcattgggatgaaagtatcgtt

SEQ ID NO: 2361 - DNA, 25 bp, Artificial Sequence
  oligonucleotide
catagtctgattgctcaaagtcttg

SEQ ID NO: 2362 - DNA, 25 bp, Artificial Sequence
  oligonucleotide
gcgaatagtgaactacattctgttg

SEQ ID NO: 2363 - DNA, 25 bp, Artificial Sequence
  oligonucleotide
cacgctcttttgcaatttccattga

SEQ ID NO: 2364 - DNA, 25 bp, Artificial Sequence
  oligonucleotide
gaagcaaatattcaaaatgcaccag

SEQ ID NO: 2365 - DNA, 25 bp, Artificial Sequence
  oligonucleotide
aaagtcttttgcttcttcagattca

SEQ ID NO: 2366 - DNA, 25 bp, Artificial Sequence
  oligonucleotide
gtgttcacaggtatggatgctctta

SEQ ID NO: 2367 - DNA, 25 bp, Artificial Sequence
  oligonucleotide
gagcatccatacctgtgaacacaga

SEQ ID NO: 2368 - DNA, 25 bp, Artificial Sequence
  oligonucleotide
ttttccaattacaagagacatcagt

SEQ ID NO: 2369 - DNA, 25 bp, Artificial Sequence
  oligonucleotide
tttgaattcgcatgtactttgtttg

SEQ ID NO: 2370 - DNA, 25 bp, Artificial Sequence
  oligonucleotide
ccccgggttcgaaatcgataaaaag

SEQ ID NO: 2371 - DNA, 25 bp, Artificial Sequence
  oligonucleotide
caaaagagcgtggagaaaagtacca

SEQ ID NO: 2372 - DNA, 25 bp, Artificial Sequence
  oligonucleotide
caaaagagcgtggagaaaaatatca

SEQ ID NO: 2373 - DNA, 25 bp, Artificial Sequence
  oligonucleotide
caaaagagcgtggagagaagtatca

SEQ ID NO: 2374 - DNA, 25 bp, Artificial Sequence
  oligonucleotide
caaaagagcgtggtgaaaagtatca

SEQ ID NO: 2375 - DNA, 25 bp, Artificial Sequence
  oligonucleotide
caaaagagcgcggagaaaagtatca

SEQ ID NO: 2376 - DNA, 25 bp, Artificial Sequence
  oligonucleotide
caaaagaacgtggagaaaagtatca

SEQ ID NO: 2377 - DNA, 25 bp, Artificial Sequence
  oligonucleotide
caaaggagcgtggagaaaagtatca

SEQ ID NO: 2378 - DNA, 25 bp, Artificial Sequence
  oligonucleotide
ctaaagagcgtggagaaaagtatca

SEQ ID NO: 2379 - DNA, 25 bp, Artificial Sequence
  oligonucleotide
caaaagagcgtggagagaagtacca

SEQ ID NO: 2380 - DNA, 25 bp, Artificial Sequence
  oligonucleotide
caaaagagcgcggagagaagtatca

SEQ ID NO: 2381 - DNA, 25 bp, Artificial Sequence
  oligonucleotide
caaaggagcgcggagaaaagtatca

SEQ ID NO: 2382 - DNA, 25 bp, Artificial Sequence
  oligonucleotide
caaaggagcgtggtgaaaagtacca

SEQ ID NO: 2383 - DNA, 25 bp, Artificial Sequence
  oligonucleotide
caaaggagcgcggagagaagtacca

SEQ ID NO: 2384 - DNA, 30 bp, Artificial Sequence
  oligonucleotide
atatcatcaaaaagttggcgaaccttttca

SEQ ID NO: 2385 - DNA, 30 bp, Artificial Sequence
  oligonucleotide
aattgcaaaagagcgtggagaaaagtatca

SEQ ID NO: 2386 - DNA, 25 bp, Artificial Sequence
  oligonucleotide
atcaaaaagttggcgaaccttttca

SEQ ID NO: 2387 - DNA, 25 bp, Artificial Sequence
  oligonucleotide
caaaagagcgtggagaaaagtatca

SEQ ID NO: 2388 - DNA, 20 bp, Artificial Sequence
  oligonucleotide
aaagttggcgaaccttttca

SEQ ID NO: 2389 - DNA, 20 bp, Artificial Sequence
  oligonucleotide
gagcgtggagaaaagtatca

SEQ ID NO: 2390 - DNA, 17 bp, Artificial Sequence
  oligonucleotide
gttggcgaaccttttca

SEQ ID NO: 2391 - DNA, 17 bp, Artificial Sequence
  oligonucleotide
cgtggagaaaagtatca

SEQ ID NO: 2392 - DNA, 15 bp, Artificial Sequence
  oligonucleotide
tggcgaaccttttca

SEQ ID NO: 2393 - DNA, 15 bp, Artificial Sequence
  oligonucleotide
tggagaaaagtatca

SEQ ID NO: 2394 - DNA, 16 bp, Artificial Sequence
  oligonucleotide
cgagcgggtggtgttc

SEQ ID NO: 2395 - DNA, 16 bp, Artificial Sequence
  oligonucleotide
gtcgtcgtcggaggga

SEQ ID NO: 2396 - DNA, 13 bp, Artificial Sequence
  oligonucleotide
gcgggtggtgttc

SEQ ID NO: 2397 - DNA, 13 bp, Artificial Sequence
  oligonucleotide
gtcgtcggaggga

SEQ ID NO: 2398 - DNA, 87 bp, Artificial Sequence
  oligonucleotide
agtgcatcggcgccgttatcgacgtggtgttcggcggtgctggcgtgggcaagaccgtccaggccgtgtacgtccctgcggacgact

SEQ ID NO: 2399 - DNA, 87 bp, Artificial Sequence
  oligonucleotide
agtgcatcggcgccgtggtggatattctgttcggcggcgccggcgtgggcaagaccgtccaggccgtgtacgtgcctgccgacgact

SEQ ID NO: 2400 - DNA, 87 bp, Artificial Sequence
  oligonucleotide
aaatcatcggcgccgtgatcgacgtggtgttcggcggcgccggcgtgggcaagaccgtccaggccgtatacgttcccgcggacgacc

SEQ ID NO: 2401 - DNA, 87 bp, Artificial Sequence
  oligonucleotide
aggtaatcggcgccgtagttgacgtcgtgttcggtggtgcgggtgtaggtaaaaccgtacaggcagtatacgtacctgcggatgact

SEQ ID NO: 2402 - DNA, 87 bp, Artificial Sequence
  oligonucleotide
aaattatcggtgcggttgttgacgtggtgttcggcggtgccggtgtgggtaaaaccgtccaagccgtatatgtacctgcggatgact

SEQ ID NO: 2403 - DNA, 87 bp, Artificial Sequence
  oligonucleotide
aggttattggcccggtggttgacgtcgtcttcggcggcgccggggtcggcaagacggtgcaagctatctatgtgccggccgacgacc

SEQ ID NO: 2404 - DNA, 87 bp, Artificial Sequence
  oligonucleotide
aggttctcggtcccgtgattgacgtggtgttcggcggcgccggcgtgggcaagacggtgcaggccatctacgtgcccgccgacgacc

SEQ ID NO: 2405 - DNA, 87 bp, Artificial Sequence
  oligonucleotide
gggtcactgggcccgtcgtcgacgtcgtgttcggcggtgccggggtgggcaagacggtgcaagccgtctacgtgcccgccgacgact

SEQ ID NO: 2406 - DNA, 87 bp, Artificial Sequence
  oligonucleotide
aggtaattggccctgtggtcgatgtgttgtttggcggggccggagtgggtaaaactgtgcaggctgtttacgtaccggctgatgact

SEQ ID NO: 2407 - DNA, 87 bp, Artificial Sequence
  oligonucleotide
aggttattggaccagtagtcgatgttattttcggtggtgccggagttggtaaaaccgttcaggccgtttacgatccagccgatgact

SEQ ID NO: 2408 - DNA, 87 bp, Artificial Sequence
  oligonucleotide
aagtgattggcccggtagttgatgtcatatttggtggtgctggtgttggtaaaacggtgcaagcgatctatgtgccagctgatgact

SEQ ID NO: 2409 - DNA, 68 bp, Artificial Sequence
  oligonucleotide
aagaacatgatcaccggtacctcccaggctgactgcgccgtccgagacatgcgacagaccgttgccgt

SEQ ID NO: 2410 - DNA, 68 bp, Artificial Sequence
  oligonucleotide
aagaatatgatcacaggtacttctcaggctgactgtgctgtgcgtgatatgagacaaacagttgcggt

SEQ ID NO: 2411 - DNA, 68 bp, Artificial Sequence
  oligonucleotide
aaaaacatgattacagggacatctcaggctgactgtgctgttcgtgatatgagacagacagttgctgt

SEQ ID NO: 2412 - DNA, 68 bp, Artificial Sequence
  oligonucleotide
aagaacatgatcaccggcgctgcccagatggacggtgctattagagaaggaggcaaaactgttggagc

SEQ ID NO: 2413 - DNA, 68 bp, Artificial Sequence
  oligonucleotide
aaaaacatgatcaccggcgccgcccagatggacggtgctattagagaaggaggcaaaactgttggagc

SEQ ID NO: 2414 - DNA, 68 bp, Artificial Sequence
  oligonucleotide
aagaacatgatcaccggtgccgcccagatggacggcgccatccgtgagggtggtcgtaccgtgggcgc

SEQ ID NO: 2415 - DNA, 68 bp, Artificial Sequence
  oligonucleotide
aaaaatatgattacaggagcagcacaaatggatggtgctataagagaaggaggaaaaactataggagc

SEQ ID NO: 2416 - DNA, 68 bp, Artificial Sequence
  oligonucleotide
aagaatatgattactggagccgcacaaatggatggtgctattagagaaggaggtcgtactataggagc

SEQ ID NO: 2417 - DNA, 68 bp, Artificial Sequence
  oligonucleotide
aaaaatatgattactggagctgcgcaaatggatggtgccttaagggaaggaggtagaacagttggagc

SEQ ID NO: 2418 - DNA, 55 bp, Artificial Sequence
  oligonucleotide
ggctccttcaagtacgcgtgggtgctcgtgacttcataaagaacatgatcacggg

SEQ ID NO: 2419 - DNA, 55 bp, Artificial Sequence
  oligonucleotide
ggttctttcaaatacgcttgggtcttagagatttcatcaagaatatgatcactgg

SEQ ID NO: 2420 - DNA, 55 bp, Artificial Sequence
  oligonucleotide
tcttctttcaagtacgcttgggttctcgagacttcatcaagaacatgatcaccgg

SEQ ID NO: 2421 - DNA, 55 bp, Artificial Sequence
  oligonucleotide
ggatcattcaaatatgcttgggtcttagagatttcattaagaacatgattactgg

SEQ ID NO: 2422 - DNA, 55 bp, Artificial Sequence
  oligonucleotide
ggctccttcaagtacgcgtgggtcctcgcgacttcatcaagaacatgatcacggg

SEQ ID NO: 2423 - DNA, 55 bp, Artificial Sequence
  oligonucleotide
aaatccttcaaatatgcgtgggtcctcgtgacttcatcaagaacatgatcactgg

SEQ ID NO: 2424 - DNA, 55 bp, Artificial Sequence
  oligonucleotide
ggctccttcaagtatgcctgggtcttagagactttatcaaaaacatgattacagg

SEQ ID NO: 2425 - DNA, 55 bp, Artificial Sequence
  oligonucleotide
gcgtccttcaagtacgcgtgggtgctcgcgacttcatcaagaacatgatcaccgg

SEQ ID NO: 2426 - DNA, 55 bp, Artificial Sequence
  oligonucleotide
ggctcatttaaatatgcttgggtattcgtgatttcattaagaatatgatcacagg

SEQ ID NO: 2427 - DNA, 55 bp, Artificial Sequence
  oligonucleotide
ggtagtttcaaatatgcatgggttttaaacattttattaaaaatatgattactgg

SEQ ID NO: 2428 - DNA, 55 bp, Artificial Sequence
  oligonucleotide
ggaagttttaagtacgcatgggtgttaaggatttcattaaaaatatgattaccgg

SEQ ID NO: 2429 - DNA, 55 bp, Artificial Sequence
  oligonucleotide
ggttccttcaagtacgcctgggttttcgtgatttcatcaagaacatgattaccgg

SEQ ID NO: 2430 - DNA, 55 bp, Artificial Sequence
  oligonucleotide
tcttctttcaagtacgcgtgggtcttcgcgacttcatcaagaacatgatcacggg

SEQ ID NO: 2431 - DNA, 55 bp, Artificial Sequence
  oligonucleotide
ggttctttcaagtacgcttgggttctcgagatttcatcaagaacatgatcaccgg

SEQ ID NO: 2432 - DNA, 55 bp, Artificial Sequence
  oligonucleotide
gtgtacaagattggcggtattggtacgatatgagacagactgtcgctgtcggtat

SEQ ID NO: 2433 - DNA, 55 bp, Artificial Sequence
  oligonucleotide
gtttacaagatcggtggtattggtacgatatgagacaaaccgttgctgttggtgt

SEQ ID NO: 2434 - DNA, 55 bp, Artificial Sequence
  oligonucleotide
gtctacaagatcggtggtatcggcacgacatgcgacagaccgttgccgttggtgt

SEQ ID NO: 2435 - DNA, 55 bp, Artificial Sequence
  oligonucleotide
gtttacaagatttcaggtattggaacgatatgaaacaaaccgttgctgttggagt

SEQ ID NO: 2436 - DNA, 26 bp, Artificial Sequence
  oligonucleotide
gtctacaagatctcgggcgtcgggac

SEQ ID NO: 2437 - DNA, 55 bp, Artificial Sequence
  oligonucleotide
gtgtacaaaatctctggtattggcacgacatgagacaaaccgtcgctgtcggtgt

SEQ ID NO: 2438 - DNA, 55 bp, Artificial Sequence
  oligonucleotide
gtctacaaaattggtggtattggtacgatatgagacagacagttgcggtgggtgt

SEQ ID NO: 2439 - DNA, 55 bp, Artificial Sequence
  oligonucleotide
gtgtacaagatcggcggtatcggcacgacatgcgcagaacggtcgccgtcggcat

SEQ ID NO: 2440 - DNA, 55 bp, Artificial Sequence
  oligonucleotide
gtttacaaaattggaggtattggaacgatatgagacaaacagttgctgttggcgt

SEQ ID NO: 2441 - DNA, 55 bp, Artificial Sequence
  oligonucleotide
gtatacaaaattggtggtattggtacgatatgagacaaacaattgctgtcggtat

SEQ ID NO: 2442 - DNA, 55 bp, Artificial Sequence
  oligonucleotide
gtatacaaaatcggtggtattggtacgatatgagacaaaccattgctgtcggtat

SEQ ID NO: 2443 - DNA, 55 bp, Artificial Sequence
  oligonucleotide
gtttacaagatcggtggtattggtacgacatgcgtcaaaccgtcgctgtcggtgt

SEQ ID NO: 2444 - DNA, 55 bp, Artificial Sequence
  oligonucleotide
gtgtacaagatcggcggtatcggcacgacatgcgccagacggtcgccgtcggcat

SEQ ID NO: 2445 - DNA, 55 bp, Artificial Sequence
  oligonucleotide
gtctacaagatcggtggtatcggcacgacatgcgacagaccgttgctgtcggtgt

SEQ ID NO: 2446 - DNA, 56 bp, Artificial Sequence
  oligonucleotide
cctccgcgcgatgttgataaacctttcttgtgacaacgtaggtctgttgcttcgtg

SEQ ID NO: 2447 - DNA, 56 bp, Artificial Sequence
  oligonucleotide
ccagaacgcgacactgaaaaaccattcatgtgacaacattggtgcccttcttcgcg

SEQ ID NO: 2448 - DNA, 70 bp, Artificial Sequence
  oligonucleotide
ggtactgttcgtgtcaacgacgaaatcgaaatcgttggtatcaaagaagaaactcaaaaagcagttgtta

SEQ ID NO: 2449 - DNA, 70 bp, Artificial Sequence
  oligonucleotide
ggtactgttcgtgtcaacgacgaaatcgaaatcgttggtatcaaagaagaaactaaaaaagctgttgtta

SEQ ID NO: 2450 - DNA, 106 bp, Artificial Sequence
  oligonucleotide
ttgattgtttataaagatggcgataagtctcaaaaaatcgtgtaaagaaactttgggtcgtgtgtttaatgttcccttcttgccccttacctaaaaggtggtaaag

SEQ ID NO: 2451 - DNA, 106 bp, Artificial Sequence
  oligonucleotide
cttgtcgtctacaaaaatgacgaaagaaaaacaaaaatcgtctaaagaaactttgggacgtgtcttcaacgtttccttcttgccccttaccttaaaggtggtaaag

SEQ ID NO: 2452 - DNA, 106 bp, Artificial Sequence
  oligonucleotide
ttgattgtttataaagatagtgataaaaagcaaaaaatcgtctaaagaaactttgggacgcgtctttaatgtacccttcttgccccttaccttaaaggtggtaaag

SEQ ID NO: 2453 - DNA, 106 bp, Artificial Sequence
  oligonucleotide
cttgtagtctataaaaatgatgagaaaaaatcaaaaatcgtcaaaggaaactctaggccgggtgttcaatgtttcctgctagcaccttatctgaaaggtgggaaag

SEQ ID NO: 2454 - DNA, 106 bp, Artificial Sequence
  oligonucleotide
ttggtcgtttataaagatggcgacaagtctcaaagaattgttaaaagaaacactaggtcgtgtctttaatgttcccttcttgccccttatcttaaaggtggtaaag

SEQ ID NO: 2455 - DNA, 106 bp, Artificial Sequence
  oligonucleotide
tacgatgctcttgaggtgcaaaatggtaatgagcgtctggtgtaaagcgactctgggccgtatcatgaacgtaccctgatgtgtccgttcgctaagggcggtaaag

SEQ ID NO: 2456 - DNA, 90 bp, Artificial Sequence
  oligonucleotide
cattaagaaaattggctacaaccccgacacagcaacatgctggagccaagtgctaacataaggatggcaatgccagtggaaccacgctgc

SEQ ID NO: 2457 - DNA, 90 bp, Artificial Sequence
  oligonucleotide
catcaagaaggtcggtttcaaccccaagaccgtaacatgattgagcccaccaccaacacaaggctggtgtcgtcaagggtaagactcttt

SEQ ID NO: 2458 - DNA, 62 bp, Artificial Sequence
  oligonucleotide
actggccgtgtagaacgcggacaagttaaagcatcttccagaaggcgtagaaatggttatgc

SEQ ID NO: 2459 - DNA, 26 bp, Artificial Sequence
  oligonucleotide
gttgaaatgttccgtaagcttcttga

SEQ ID NO: 2460 - DNA, 45 bp, Artificial Sequence
  oligonucleotide
agtcggtgacgaagttgaaatcatcggtcttcaagaagagagaaa

SEQ ID NO: 2461 - DNA, 52 bp, Artificial Sequence
  oligonucleotide
cactccacacagcaaattcaaagctgttcttctctaactaccgtcctcagtt

SEQ ID NO: 2462 - DNA, 26 bp, Artificial Sequence
  oligonucleotide
atcatcggtcttcaagaagagagaaa

SEQ ID NO: 2463 - DNA, 56 bp, Artificial Sequence
  oligonucleotide
tggaactgatggaagctgttgatacttgggaacgaaatcaaacgtggtatggttct

SEQ ID NO: 2464 - DNA, 56 bp, Artificial Sequence
  oligonucleotide
tcgaacttatggatgcggttgatgagtactgaagaaatccaacgtggtcaagtact

SEQ ID NO: 2465 - DNA, 78 bp, Artificial Sequence
  oligonucleotide
gtagaacgcggacaagttaaagtcggtgacgaagttgaaatcatcggtcttcaacattggtgcccttcttcgcggtgt

SEQ ID NO: 2466 - DNA, 78 bp, Artificial Sequence
  oligonucleotide
atcgaaactggtgttatccatgtaggtgatgaaatcgaaatcctcggtttgggtcgtaggtctgttgcttcgtggtgt

SEQ ID NO: 2467 - DNA, 58 bp, Artificial Sequence
  oligonucleotide
gttacaggtgttgaaatgttccgtaagctcagttctacttccgtacaactgacgtaac

SEQ ID NO: 2468 - DNA, 58 bp, Artificial Sequence
  oligonucleotide
gttactggtgttgaaatgttccgtaaacacaattctacttccgtacaactgacgtaac

SEQ ID NO: 2469 - DNA, 74 bp, Artificial Sequence
  oligonucleotide
gtgttcggtcagatggatgagccaccaggagtccgtatgcgccgtatgccttccgccgtgggttaccagccaac

SEQ ID NO: 2470 - DNA, 74 bp, Artificial Sequence
  oligonucleotide
gtattcggacagatggacgagccgccgggcacccgtatgcgtcggatgccgtcggccgtgggataccagcccac

SEQ ID NO: 2471 - DNA, 74 bp, Artificial Sequence
  oligonucleotide
gtattcggacaaatgaacgagccgccgggcgcacgtatgcgtcgtatgccttcagcggttggttatcagccgac

SEQ ID NO: 2472 - DNA, 74 bp, Artificial Sequence
  oligonucleotide
gtgtatggccaaatgaacgaacctccaggcaaccgtctgcgccgtatgccttctgcagtgggttaccaaccgac

SEQ ID NO: 2473 - DNA, 74 bp, Artificial Sequence
  oligonucleotide
gtgtacggccagatgaacgagccgccgggcaaccgtctgcgccgtatgccgtcggcagtgggctatcagccgac

SEQ ID NO: 2474 - DNA, 74 bp, Artificial Sequence
  oligonucleotide
gtttatggtcaaatgaacgagccaccaggtaaccgtttacgtcgtatgccatccgcggtaggttaccaaccgac

SEQ ID NO: 2475 - DNA, 74 bp, Artificial Sequence
  oligonucleotide
gtgtttggtcagatgaacgaacccccaggagcacggatgcggcggatgccatcagccgtgggttaccaaccaac

SEQ ID NO: 2476 - DNA, 74 bp, Artificial Sequence
  oligonucleotide
gtgttcggacagatgaacgaacctcctggagcacgtgcttcacgtatgccttctgcggtaggttatcaacctac

SEQ ID NO: 2477 - DNA, 57 bp, Artificial Sequence
  oligonucleotide
ccttgggctaacaacctcacaagaagtatgtgatcctgtcgttcatgagaatgtaaa

SEQ ID NO: 2478 - DNA, 53 bp, Artificial Sequence
  oligonucleotide
gggctaacaacctcacaagaagtatgtgatcctgtcgttcatgagaatgtaaa

SEQ ID NO: 2479 - DNA, 57 bp, Artificial Sequence
  oligonucleotide
tcttggactaacaatctcgcaagaggtatgtgaccctgttactcacgagaatgtgaa

SEQ ID NO: 2480 - DNA, 57 bp, Artificial Sequence; identical to SEQ ID NO: 2479
  oligonucleotide

SEQ ID NO: 2481 - DNA, 57 bp, Artificial Sequence; identical to SEQ ID NO: 2479
  oligonucleotide

SEQ ID NO: 2482 - DNA, 57 bp, Artificial Sequence; identical to SEQ ID NO: 2479
  oligonucleotide

SEQ ID NO: 2483 - DNA, 57 bp, Artificial Sequence; identical to SEQ ID NO: 2479
  oligonucleotide

SEQ ID NO: 2484 - DNA, 57 bp, Artificial Sequence; identical to SEQ ID NO: 2479
  oligonucleotide

SEQ ID NO: 2485 - DNA, 57 bp, Artificial Sequence; identical to SEQ ID NO: 2479
  oligonucleotide

SEQ ID NO: 2486 - DNA, 57 bp, Artificial Sequence; identical to SEQ ID NO: 2479
  oligonucleotide

SEQ ID NO: 2487 - DNA, 57 bp, Artificial Sequence; identical to SEQ ID NO: 2479
  oligonucleotide

SEQ ID NO: 2488 - DNA, 57 bp, Artificial Sequence; identical to SEQ ID NO: 2479
  oligonucleotide

SEQ ID NO: 2489 - DNA, 57 bp, Artificial Sequence; identical to SEQ ID NO: 2479
  oligonucleotide

SEQ ID NO: 2490 - DNA, 57 bp, Artificial Sequence; identical to SEQ ID NO: 2479
  oligonucleotide

SEQ ID NO: 2491 - DNA, 57 bp, Artificial Sequence; identical to SEQ ID NO: 2479
  oligonucleotide

SEQ ID NO: 2492 - DNA, 57 bp, Artificial Sequence; identical to SEQ ID NO: 2479
  oligonucleotide

SEQ ID NO: 2493 - DNA, 57 bp, Artificial Sequence; identical to SEQ ID NO: 2479
  oligonucleotide

SEQ ID NO: 2494 - DNA, 57 bp, Artificial Sequence; identical to SEQ ID NO: 2479
  oligonucleotide

SEQ ID NO: 2495 - DNA, 57 bp, Artificial Sequence; identical to SEQ ID NO: 2479
  oligonucleotide

SEQ ID NO: 2496 - DNA, 57 bp, Artificial Sequence; identical to SEQ ID NO: 2479
  oligonucleotide

SEQ ID NO: 2497 - DNA, 57 bp, Artificial Sequence; identical to SEQ ID NO: 2479
  oligonucleotide

SEQ ID NO: 2498 - DNA, 57 bp, Artificial Sequence; identical to SEQ ID NO: 2479
  oligonucleotide

SEQ ID NO: 2499 - DNA, 53 bp, Artificial Sequence
  oligonucleotide
ggactaacaatctcgcaagaggtatgtgaccctgttactcacgagaatgtgaa

SEQ ID NO: 2500 - DNA, 58 bp, Artificial Sequence
  oligonucleotide
tcttggactaacaatcttgccaaaaggtagtgaccctggttactcacgagaatgtgaa

SEQ ID NO: 2501 - DNA, 69 bp, Artificial Sequence
  oligonucleotide
tatggaggggtaacaaatcatgaagggaatcatttagaaaaaaaatggtaactgctcaagaattagact

SEQ ID NO: 2502 - DNA, 69 bp, Artificial Sequence; identical to SEQ ID NO: 2501
  oligonucleotide

SEQ ID NO: 2503 - DNA, 69 bp, Artificial Sequence
  oligonucleotide
tacggaggggtaacaaatcatgaagggaatcatttagaaaaaaaatggtaactgctcaagaattagact

SEQ ID NO: 2504 - DNA, 69 bp, Artificial Sequence; identical to SEQ ID NO: 2503
  oligonucleotide

SEQ ID NO: 2505 - DNA, 69 bp, Artificial Sequence; identical to SEQ ID NO: 2503
  oligonucleotide

SEQ ID NO: 2506 - DNA, 69 bp, Artificial Sequence; identical to SEQ ID NO: 2503
  oligonucleotide

SEQ ID NO: 2507 - DNA, 69 bp, Artificial Sequence; identical to SEQ ID NO: 2503
  oligonucleotide

SEQ ID NO: 2508 - DNA, 69 bp, Artificial Sequence; identical to SEQ ID NO: 2503
  oligonucleotide

SEQ ID NO: 2509 - DNA, 69 bp, Artificial Sequence; identical to SEQ ID NO: 2503
  oligonucleotide

SEQ ID NO: 2510 - DNA, 69 bp, Artificial Sequence; identical to SEQ ID NO: 2503
  oligonucleotide

SEQ ID NO: 2511 - DNA, 69 bp, Artificial Sequence; identical to SEQ ID NO: 2503
  oligonucleotide

SEQ ID NO: 2512 - DNA, 69 bp, Artificial Sequence; identical to SEQ ID NO: 2503
  oligonucleotide

SEQ ID NO: 2513 - DNA, 69 bp, Artificial Sequence; identical to SEQ ID NO: 2503
  oligonucleotide

SEQ ID NO: 2514 - DNA, 69 bp, Artificial Sequence; identical to SEQ ID NO: 2503
  oligonucleotide

SEQ ID NO: 2515 - DNA, 69 bp, Artificial Sequence; identical to SEQ ID NO: 2503
  oligonucleotide

SEQ ID NO: 2516 - DNA, 69 bp, Artificial Sequence; identical to SEQ ID NO: 2503
  oligonucleotide

SEQ ID NO: 2517 - DNA, 69 bp, Artificial Sequence; identical to SEQ ID NO: 2503
  oligonucleotide

SEQ ID NO: 2518 - DNA, 69 bp, Artificial Sequence; identical to SEQ ID NO: 2503
  oligonucleotide

SEQ ID NO: 2519 - DNA, 69 bp, Artificial Sequence; identical to SEQ ID NO: 2503
  oligonucleotide

SEQ ID NO: 2520 - DNA, 69 bp, Artificial Sequence; identical to SEQ ID NO: 2503
  oligonucleotide

SEQ ID NO: 2521 - DNA, 69 bp, Artificial Sequence; identical to SEQ ID NO: 2503
  oligonucleotide

SEQ ID NO: 2522 - DNA, 69 bp, Artificial Sequence; identical to SEQ ID NO: 2503
  oligonucleotide

SEQ ID NO: 2523 - DNA, 69 bp, Artificial Sequence; identical to SEQ ID NO: 2503
  oligonucleotide

SEQ ID NO: 2524 - DNA, 68 bp, Artificial Sequence
  oligonucleotide
tacggaggggtaacaaatcatgaagggaatcatttagaaaaaaaatggtaactgctcaagaattagct

SEQ ID NO: 2525 - DNA, 68 bp, Artificial Sequence; identical to SEQ ID NO: 2524
  oligonucleotide

SEQ ID NO: 2526 - DNA, 98 bp, Artificial Sequence
  oligonucleotide
ttgatgtcagagggatagatccagaggaagggcgtatcgctttgctgatttttcacatgttacctttgttacattgtctggtgacagtagctatacca

SEQ ID NO: 2527 - DNA, 98 bp, Artificial Sequence; identical to SEQ ID NO: 2526
  oligonucleotide

SEQ ID NO: 2528 - DNA, 98 bp, Artificial Sequence; identical to SEQ ID NO: 2526
  oligonucleotide

SEQ ID NO: 2529 - DNA, 95 bp, Artificial Sequence
  oligonucleotide
ttgatgtcagagggatagatccagaggaagggcgtatcgctttgctgatttttcacatgttacctttgttacattgtctagtgacagtagctata

SEQ ID NO: 2530 - DNA, 98 bp, Artificial Sequence; identical to SEQ ID NO: 2526
  oligonucleotide

SEQ ID NO: 2531 - DNA, 98 bp, Artificial Sequence; identical to SEQ ID NO: 2526
  oligonucleotide

SEQ ID NO: 2532 - DNA, 98 bp, Artificial Sequence; identical to SEQ ID NO: 2526
  oligonucleotide

SEQ ID NO: 2533 - DNA, 98 bp, Artificial Sequence; identical to SEQ ID NO: 2526
  oligonucleotide

SEQ ID NO: 2534 - DNA, 98 bp, Artificial Sequence; identical to SEQ ID NO: 2526
  oligonucleotide

SEQ ID NO: 2535 - DNA, 98 bp, Artificial Sequence
  oligonucleotide
tggatatacgagggcttgatgtctatcaggcgcgtaccgtttttcagattttacacatatatcagtggtttccatgacaacggacagcagttatacca

SEQ ID NO: 2536 - DNA, 98 bp, Artificial Sequence; identical to SEQ ID NO: 2535
  oligonucleotide

SEQ ID NO: 2537 - DNA, 98 bp, Artificial Sequence
  oligonucleotide
taggtatacgagggcttgatgtttatcaggagcgtacagattttcagattttgcacatatatcattgatttccatgacaacggacagcagttatacca

SEQ ID NO: 2538 - DNA, 98 bp, Artificial Sequence; identical to SEQ ID NO: 2537
  oligonucleotide

SEQ ID NO: 2539 - DNA, 98 bp, Artificial Sequence; identical to SEQ ID NO: 2537
  oligonucleotide

SEQ ID NO: 2540 - DNA, 98 bp, Artificial Sequence; identical to SEQ ID NO: 2537
  oligonucleotide

SEQ ID NO: 2541 - DNA, 98 bp, Artificial Sequence; identical to SEQ ID NO: 2537
  oligonucleotide

SEQ ID NO: 2542 - DNA, 98 bp, Artificial Sequence; identical to SEQ ID NO: 2537
  oligonucleotide

SEQ ID NO: 2543 - DNA, 98 bp, Artificial Sequence; identical to SEQ ID NO: 2535
  oligonucleotide

SEQ ID NO: 2544 - DNA, 98 bp, Artificial Sequence; identical to SEQ ID NO: 2535
  oligonucleotide

SEQ ID NO: 2545 - DNA, 98 bp, Artificial Sequence; identical to SEQ ID NO: 2535
  oligonucleotide

SEQ ID NO: 2546 - DNA, 98 bp, Artificial Sequence; identical to SEQ ID NO: 2535
  oligonucleotide

SEQ ID NO: 2547 - DNA, 98 bp, Artificial Sequence; identical to SEQ ID NO: 2535
  oligonucleotide

SEQ ID NO: 2548 - DNA, 98 bp, Artificial Sequence; identical to SEQ ID NO: 2535
  oligonucleotide

SEQ ID NO: 2549 - DNA, 98 bp, Artificial Sequence; identical to SEQ ID NO: 2535
  oligonucleotide

SEQ ID NO: 2550 - DNA, 98 bp, Artificial Sequence; identical to SEQ ID NO: 2535
  oligonucleotide

SEQ ID NO: 2551 - DNA, 98 bp, Artificial Sequence
  oligonucleotide
tggatatacgagggcttgatgtctatcaggcgcgtacagattttcagattttgcacatatatcagtggtttccatgacaacggacagcagttatacca

SEQ ID NO: 2552 - DNA, 84 bp, Artificial Sequence
  oligonucleotide
agcgatgttacggtttgttactgtgacacaacactggatgatctcagtgggcgttcttaaaggttgagtagcgtcctgcctgac

SEQ ID NO: 2553 - DNA, 84 bp, Artificial Sequence; identical to SEQ ID NO: 2552
  oligonucleotide

SEQ ID NO: 2554 - DNA, 84 bp, Artificial Sequence; identical to SEQ ID NO: 2552
  oligonucleotide

SEQ ID NO: 2555 - DNA, 84 bp, Artificial Sequence
  oligonucleotide
agcgatgttacggtttgttactgtgacacaacactggatgatctcagtgggcgttcttaaaggttgagtagtgtcctgcctgat

SEQ ID NO: 2556 - DNA, 84 bp, Artificial Sequence; identical to SEQ ID NO: 2555
  oligonucleotide

SEQ ID NO: 2557 - DNA, 84 bp, Artificial Sequence
  oligonucleotide
agcgatgttacggtttgttactgtgacacaacactggatgatctcagtgggcgttcttaaaggttgagtagtgtcctgcctgac

SEQ ID NO: 2558 - DNA, 84 bp, Artificial Sequence; identical to SEQ ID NO: 2557
  oligonucleotide

SEQ ID NO: 2559 - DNA, 84 bp, Artificial Sequence; identical to SEQ ID NO: 2557
  oligonucleotide

SEQ ID NO: 2560 - DNA, 84 bp, Artificial Sequence; identical to SEQ ID NO: 2557
  oligonucleotide

SEQ ID NO: 2561 - DNA, 81 bp, Artificial Sequence
  oligonucleotide
agcagttctgcgttttgtcactgtcacaaggcactgtctgaaactgctcctgtgtagcgaatcagcaatgtgcttccggag

SEQ ID NO: 2562 - DNA, 81 bp, Artificial Sequence; identical to SEQ ID NO: 2561
  oligonucleotide

SEQ ID NO: 2563 - DNA, 81 bp, Artificial Sequence
  oligonucleotide
agcagttctgcgttttgtcactgtcacatggcactgtctgaaactgctcctgtttagagaatcagcaatgtgcttccggag

SEQ ID NO: 2564 - DNA, 81 bp, Artificial Sequence; identical to SEQ ID NO: 2563
  oligonucleotide

SEQ ID NO: 2565 - DNA, 81 bp, Artificial Sequence; identical to SEQ ID NO: 2563
  oligonucleotide

SEQ ID NO: 2566 - DNA, 81 bp, Artificial Sequence; identical to SEQ ID NO: 2563
  oligonucleotide

SEQ ID NO: 2567 - DNA, 81 bp, Artificial Sequence; identical to SEQ ID NO: 2563
  oligonucleotide

SEQ ID NO: 2568 - DNA, 81 bp, Artificial Sequence; identical to SEQ ID NO: 2563
  oligonucleotide

SEQ ID NO: 2569 - DNA, 81 bp, Artificial Sequence; identical to SEQ ID NO: 2563
  oligonucleotide

SEQ ID NO: 2570 - DNA, 81 bp, Artificial Sequence; identical to SEQ ID NO: 2561
  oligonucleotide

SEQ ID NO: 2571 - DNA, 81 bp, Artificial Sequence; identical to SEQ ID NO: 2561
  oligonucleotide

SEQ ID NO: 2572 - DNA, 81 bp, Artificial Sequence; identical to SEQ ID NO: 2561
  oligonucleotide

SEQ ID NO: 2573 - DNA, 81 bp, Artificial Sequence; identical to SEQ ID NO: 2561
  oligonucleotide

SEQ ID NO: 2574 - DNA, 81 bp, Artificial Sequence; identical to SEQ ID NO: 2561
  oligonucleotide

SEQ ID NO: 2575 - DNA, 81 bp, Artificial Sequence; identical to SEQ ID NO: 2561
  oligonucleotide

SEQ ID NO: 2576 - DNA, 81 bp, Artificial Sequence
  oligonucleotide
agcagttctgcgttttgtcactgtcacaaggcactgtctgaaactgctcctgtgtagagaatcagcaatgtgcttccggag

SEQ ID NO: 2577 - DNA, 81 bp, Artificial Sequence; identical to SEQ ID NO: 2576
  oligonucleotide

SEQ ID NO: 2578 - DNA, 81 bp, Artificial Sequence; identical to SEQ ID NO: 2563
  oligonucleotide

SEQ ID NO: 2579 - DNA, 53 bp, Artificial Sequence
  oligonucleotide
gtaaacagtacggaagaactaaacgctgcagagggcttgctcgtgttgatctt

SEQ ID NO: 2580 - DNA, 53 bp, Artificial Sequence
  oligonucleotide
gtaaacggtacggaagaacttaacgctgcagagggcttgcccgtgttgatctt

SEQ ID NO: 2581 - DNA, 53 bp, Artificial Sequence; identical to SEQ ID NO: 2580
  oligonucleotide

SEQ ID NO: 2582 - DNA, 53 bp, Artificial Sequence; identical to SEQ ID NO: 2580
  oligonucleotide

SEQ ID NO: 2583 - DNA, 53 bp, Artificial Sequence; identical to SEQ ID NO: 2580
  oligonucleotide

SEQ ID NO: 2584 - DNA, 53 bp, Artificial Sequence; identical to SEQ ID NO: 2580
  oligonucleotide

SEQ ID NO: 2585 - DNA, 53 bp, Artificial Sequence; identical to SEQ ID NO: 2579
  oligonucleotide

SEQ ID NO: 2586 - DNA, 53 bp, Artificial Sequence; identical to SEQ ID NO: 2580
  oligonucleotide

SEQ ID NO: 2587 - DNA, 53 bp, Artificial Sequence; identical to SEQ ID NO: 2579
  oligonucleotide

SEQ ID NO: 2588 - DNA, 53 bp, Artificial Sequence; identical to SEQ ID NO: 2580
  oligonucleotide

SEQ ID NO: 2589 - DNA, 53 bp, Artificial Sequence; identical to SEQ ID NO: 2579
  oligonucleotide

SEQ ID NO: 2590 - DNA, 53 bp, Artificial Sequence
  oligonucleotide
gtatgcaaggcagaagaactgcaggcagcagaggattggcccgcattgacctg

SEQ ID NO: 2591 - DNA, 53 bp, Artificial Sequence
  oligonucleotide
gtagaacaaaaaagtgatttatataaagcaaaggattagcgagaatcgacttt

SEQ ID NO: 2592 - DNA, 52 bp, Artificial Sequence
  oligonucleotide
ctgcgatagaagcagcaggacaatatacggtatcttccgcatccatcaggaa

SEQ ID NO: 2593 - DNA, 52 bp, Artificial Sequence
  oligonucleotide
ctgcgatagaagcggcaggacaatatacggtatcttccgcatccatcaggaa

SEQ ID NO: 2594 - DNA, 52 bp, Artificial Sequence; identical to SEQ ID NO: 2593
  oligonucleotide

SEQ ID NO: 2595 - DNA, 52 bp, Artificial Sequence; identical to SEQ ID NO: 2593
  oligonucleotide

SEQ ID NO: 2596 - DNA, 52 bp, Artificial Sequence; identical to SEQ ID NO: 2593
  oligonucleotide

SEQ ID NO: 2597 - DNA, 52 bp, Artificial Sequence; identical to SEQ ID NO: 2593
  oligonucleotide

SEQ ID NO: 2598 - DNA, 52 bp, Artificial Sequence; identical to SEQ ID NO: 2592
  oligonucleotide

SEQ ID NO: 2599 - DNA, 52 bp, Artificial Sequence
  oligonucleotide
ctgcgatagaagcggcaggacaatatatggtatcttccgcatccatcaggaa

SEQ ID NO: 2600 - DNA, 52 bp, Artificial Sequence; identical to SEQ ID NO: 2592
  oligonucleotide

SEQ ID NO: 2601 - DNA, 52 bp, Artificial Sequence; identical to SEQ ID NO: 2593
  oligonucleotide

SEQ ID NO: 2602 - DNA, 52 bp, Artificial Sequence; identical to SEQ ID NO: 2592
  oligonucleotide

SEQ ID NO: 2603 - DNA, 52 bp, Artificial Sequence
  oligonucleotide
cagcaatcgaagaagcaagaaaatatacggcttttttaagattcatcaggaa

SEQ ID NO: 2604 - DNA, 52 bp, Artificial Sequence
  oligonucleotide
aagcaatagacgaagcttcaaaatatatggctttttcgactatgaagagaaa

SEQ ID NO: 2605 - DNA, 58 bp, Artificial Sequence
  oligonucleotide
gtagacggctttttcgattttgaagaaaaaaaggtcttgctcgcatcgacttttttgt

SEQ ID NO: 2606 - DNA, 58 bp, Artificial Sequence; identical to SEQ ID NO: 2605
  oligonucleotide

SEQ ID NO: 2607 - DNA, 58 bp, Artificial Sequence; identical to SEQ ID NO: 2605
  oligonucleotide

SEQ ID NO: 2608 - DNA, 82 bp, Artificial Sequence
  oligonucleotide
attgactacccaagcatacactatgctaatgctatttcaagtaatacaaccgatatatgatgacagatatgatgaaaaccgt

SEQ ID NO: 2609 - DNA, 82 bp, Artificial Sequence
  oligonucleotide
atcgactacccaagtattcactactcaaatgccatttcaagtaacacaaccgatatatgatgaccgaaatgatgaaaacagt

SEQ ID NO: 2610 - DNA, 82 bp, Artificial Sequence
  oligonucleotide
atcgactacccaagtattcactactcaaatgccatttcaagtaacacaaccgatatatgatgaccgacatgatgaaaacagt

SEQ ID NO: 2611 - DNA, 82 bp, Artificial Sequence
  oligonucleotide
atcgactacccaagtattcactactcaaatgccatttcaagtaacacaaccgatatatgatgaccgaaatgatgaaaactgt

SEQ ID NO: 2612 - DNA, 82 bp, Artificial Sequence
  oligonucleotide
atcgactacccaagtcttcactactcaaatgccatttcaagtaacacaaccgatatatgatgaccgacatgatgaaaacagt

SEQ ID NO: 2613 - DNA, 82 bp, Artificial Sequence
  oligonucleotide
atcgactatccaagcatgcattatgcaaacgccatttcaagtaatacaacagatatatgatgaccgacatgatgaaaacagt

SEQ ID NO: 2614 - DNA, 82 bp, Artificial Sequence
  oligonucleotide
atcgactatccaagcatgcattatgcaaacgccatttcaagtaatacaacagatacatgatgaccgaaatgatgaaaactgt

SEQ ID NO: 2615 - DNA, 82 bp, Artificial Sequence
  oligonucleotide
atcgactatccaagcatgcattatgcaaacgccatttcaagtaacacaactgatatatgatgactgaaatgatgaaaactgt

SEQ ID NO: 2616 - DNA, 82 bp, Artificial Sequence
  oligonucleotide
atcgactatccaagtatgcattacgcaaacgccatttcaagtaacacaactgatatatgatgaccgaaatgatgaaaactgt

SEQ ID NO: 2617 - DNA, 82 bp, Artificial Sequence
  oligonucleotide
attgattacccaactatggtctatgctaacgctatttcaagtaatacaactgatacatgatgactgaaatgatgaaaacagt

SEQ ID NO: 2618 - DNA, 82 bp, Artificial Sequence
  oligonucleotide
atcgactacccaagtcttcactactcaaatgccatttcaagtaacacaaccgatacatgatgacagaaatgatgaaaacagt

SEQ ID NO: 2619 - DNA, 56 bp, Artificial Sequence
  oligonucleotide
gctggtaaaactggtacgtcaaactataaatacgggttatgtagctccggacgaaa

SEQ ID NO: 2620 - DNA, 56 bp, Artificial Sequence
  oligonucleotide
gctggtaaaacaggaacctctaactataacctctcaatttgtagcacctgatgaac

SEQ ID NO: 2621 - DNA, 56 bp, Artificial Sequence
  oligonucleotide
gctggtaaaacaggaacctctaactataacctctcaatttgtagcacctgacgaac

SEQ ID NO: 2622 - DNA, 56 bp, Artificial Sequence
  oligonucleotide
gcaggtaaaacaggtacttctaactataaacactggttacgtagctccagatgaaa

SEQ ID NO: 2623 - DNA, 56 bp, Artificial Sequence
  oligonucleotide
gcaggtaagacaggtacttctaactataaacactggctacgtagctccagatgaaa

SEQ ID NO: 2624 - DNA, 56 bp, Artificial Sequence
  oligonucleotide
gctggtaaaacaggaacctctaactataaacactggctatgtagctccagatgaaa

SEQ ID NO: 2625 - DNA, 56 bp, Artificial Sequence
  oligonucleotide
gctggtaagacaggtacttctaactacaaacactggctatgtagctccagatgaaa

SEQ ID NO: 2626 - DNA, 56 bp, Artificial Sequence
  oligonucleotide
gcaggtaagacaggtacttctaactataaacactggttacgtagctccagatgaaa

SEQ ID NO: 2627 - DNA, 56 bp, Artificial Sequence; identical to SEQ ID NO: 2623
  oligonucleotide

SEQ ID NO: 2628 - DNA, 40 bp, Artificial Sequence
  oligonucleotide
gcaggtaagacgggtacatctaactacaaacactggctac

SEQ ID NO: 2629 - DNA, 56 bp, Artificial Sequence
  oligonucleotide
gctggtaaaacaggtacctctaactataaacactggttacgtagctccagatgaaa

SEQ ID NO: 2630 - DNA, 52 bp, Artificial Sequence
  oligonucleotide
gtaggctgcgatattcaaagctccgccggaagaactaaacgctgcgatagaa

SEQ ID NO: 2631 - DNA, 52 bp, Artificial Sequence
  oligonucleotide
gtgggctgtgatattcaaagctccgccggaagaacttaacgctgcgatagaa

SEQ ID NO: 2632 - DNA, 52 bp, Artificial Sequence; identical to SEQ ID NO: 2631
  oligonucleotide

SEQ ID NO: 2633 - DNA, 52 bp, Artificial Sequence; identical to SEQ ID NO: 2631
  oligonucleotide

SEQ ID NO: 2634 - DNA, 52 bp, Artificial Sequence; identical to SEQ ID NO: 2631
  oligonucleotide

SEQ ID NO: 2635 - DNA, 52 bp, Artificial Sequence; identical to SEQ ID NO: 2631
  oligonucleotide

SEQ ID NO: 2636 - DNA, 52 bp, Artificial Sequence; identical to SEQ ID NO: 2630
  oligonucleotide

SEQ ID NO: 2637 - DNA, 52 bp, Artificial Sequence
  oligonucleotide
gtgggctgcgatattcaaagctccgccggaagaacttaacgctgcgatagaa

SEQ ID NO: 2638 - DNA, 52 bp, Artificial Sequence; identical to SEQ ID NO: 2630
  oligonucleotide

SEQ ID NO: 2639 - DNA, 52 bp, Artificial Sequence; identical to SEQ ID NO: 2631
  oligonucleotide

SEQ ID NO: 2640 - DNA, 52 bp, Artificial Sequence; identical to SEQ ID NO: 2630
  oligonucleotide

SEQ ID NO: 2641 - DNA, 52 bp, Artificial Sequence
  oligonucleotide
gtgggatgcgatattcaaagctccgtcagaagaactgcaggcagcaatcgaa

SEQ ID NO: 2642 - DNA, 52 bp, Artificial Sequence
  oligonucleotide
gtaggttgtggtatcggagctgcagcaaagtgatttatataaagcaatagac

SEQ ID NO: 2643 - DNA, 57 bp, Artificial Sequence
  oligonucleotide
gaaacgaggatgatttgattgtcggcatccatcaggaaaacgagccggaaaaaggct

SEQ ID NO: 2644 - DNA, 57 bp, Artificial Sequence
  oligonucleotide
ggaacgaggatgatttgattgtcggcatccatcaggaaaacgagccggaaaaaggct

SEQ ID NO: 2645 - DNA, 57 bp, Artificial Sequence; identical to SEQ ID NO: 2644
  oligonucleotide

SEQ ID NO: 2646 - DNA, 57 bp, Artificial Sequence; identical to SEQ ID NO: 2644
  oligonucleotide

SEQ ID NO: 2647 - DNA, 57 bp, Artificial Sequence; identical to SEQ ID NO: 2644
  oligonucleotide

SEQ ID NO: 2648 - DNA, 57 bp, Artificial Sequence; identical to SEQ ID NO: 2644
  oligonucleotide

SEQ ID NO: 2649 - DNA, 57 bp, Artificial Sequence; identical to SEQ ID NO: 2643
  oligonucleotide

SEQ ID NO: 2650 - DNA, 57 bp, Artificial Sequence
  oligonucleotide
ggaacgaggatgatttgattgtcggcatccatcaggaaaacgagccggaaaaaggat

SEQ ID NO: 2651 - DNA, 57 bp, Artificial Sequence; identical to SEQ ID NO: 2643
  oligonucleotide

SEQ ID NO: 2652 - DNA, 57 bp, Artificial Sequence; identical to SEQ ID NO: 2644
  oligonucleotide

SEQ ID NO: 2653 - DNA, 57 bp, Artificial Sequence; identical to SEQ ID NO: 2643
  oligonucleotide

SEQ ID NO: 2654 - DNA, 57 bp, Artificial Sequence
  oligonucleotide
gaaacggaaatgatctcatggctggcattcatcaggaagcacagccggaaaagggat

SEQ ID NO: 2655 - DNA, 42 bp, Artificial Sequence
  oligonucleotide
ggaatgaacaattggtcgttggatatgaagagaaatacaatt

SEQ ID NO: 2656 - DNA, 56 bp, Artificial Sequence
  synthetic oligonucleotide
ccagaacgtgacactgacaaaccattgcttagataacgtaggtgtccttcttcgtg

SEQ ID NO: 2657 - DNA, 56 bp, Artificial Sequence
  synthetic oligonucleotide
ccaactcacgatcttgacaagccattcttgcgatracactggtcttcttctccgcg

SEQ ID NO: 2658 - DNA, 70 bp, Artificial Sequence
  synthetic oligonucleotide
ggtactgttcgtgtcaacgacgaagttgaaatcgttggtattaaagaagatatccaaaaagcagttgtta

SEQ ID NO: 2659 - DNA, 70 bp, Artificial Sequence
  synthetic oligonucleotide
ggtatcgttaaagtcaacgacgaaatcgaaatcgttggtatcaaagaagaaactcaaaaagcagttgtta

SEQ ID NO: 2660 - DNA, 70 bp, Artificial Sequence
  synthetic oligonucleotide
ggtgttgttcgtgtcaatgacgaagttgaaatcgttggtcttaaagaagacatccaaaaagcagttgtta

SEQ ID NO: 2661 - DNA, 62 bp, Artificial Sequence
  synthetic oligonucleotide
acaggccgtgttgaacgtggtcaaatcaaagaacttaccagaaggtacagaaatggttatgc

SEQ ID NO: 2662 - DNA, 62 bp, Artificial Sequence
  synthetic oligonucleotide
actggacgtgttgaacgtggacaagttaaagacacttccagaaggtactgaaatggtaaygc

SEQ ID NO: 2663 - DNA, 26 bp, Artificial Sequence
  synthetic oligonucleotide
gtagaaatgttccgtaaattactaga

SEQ ID NO: 2664 - DNA, 45 bp, Artificial Sequence
  synthetic oligonucleotide
agttggtgacgaagtagaagttatcggtatcgaagaagaaagaaa

SEQ ID NO: 2665 - DNA, 52 bp, Artificial Sequence
  synthetic oligonucleotide
tactccacacactaacttcaaagctgttcttcaacaactaccgcccacaatt

SEQ ID NO: 2666 - DNA, 26 bp, Artificial Sequence
  synthetic oligonucleotide
gttatcggtatcgaagaagaaagaaa

SEQ ID NO: 2667 - DNA, 56 bp, Artificial Sequence
  synthetic oligonucleotide
tggaattgatgaacacagttgatgagtattgatgaaatcgaacgtggacaagttat

SEQ ID NO: 2668 - DNA, 56 bp, Artificial Sequence
  synthetic oligonucleotide
tagaattaatggctgctgttgacgaatactgaaaacatcgaacgtggacaagttct

SEQ ID NO: 2669 - DNA, 78 bp, Artificial Sequence
  synthetic oligonucleotide
gttgagcgtggtaagctcccaatcaacaccccagttgagatcgttggtttgcgccactggtcttcttctccgcggtat

SEQ ID NO: 2670 - DNA, 78 bp, Artificial Sequence
  synthetic oligonucleotide
atcgaccgtggtatcgttaaagtcaacgacgaaatcgaaatcgttggtatcaaacgtaggtgtccttcttcgtggtgt

SEQ ID NO: 2671 - DNA, 58 bp, Artificial Sequence
  synthetic oligonucleotide
gttacaggtgttgaaatgttccgtaaattcaattctatttccgtactactgacgtaac

SEQ ID NO: 2672 - DNA, 58 bp, Artificial Sequence
  synthetic oligonucleotide
gttactggtgttgaaatgttccgtaaacacagttctacttccgtacaactgacgtaac

What is claimed is:

1. A method for testing for the presence of a vancomycin resistance gene in a sample, comprising:

providing said sample;

contacting said sample with an amplification primer pair that hybridizes to and is capable of amplifying sequences from a vanB gene under conditions that enable nucleic acid amplification to generate a vanB amplicon if said sample comprises a pathogen comprising said vanB gene, wherein said amplification primer pair comprises an oligonucleotide consisting of SEQ ID NO: 1096 or the complement thereof, or variants of SEQ ID NO: 1096, wherein said variants optionally have up to three nucleotide changes compared to SEQ ID NO: 1096, wherein said variants are capable of hybridizing to and amplifying nucleic acids from a vanB gene in a nucleic acid amplification assay; and determining whether or not said vanB amplicon is present wherein the presence of a vanB amplicon is indicative of the presence of a vancomycin resistance gene in the sample, thereby testing for the presence of a vancomycin resistance gene in a sample.

2. The method of claim 1, further comprising:

contacting said sample with an amplification primer pair that hybridizes to and is capable of amplifying sequences from a vanA gene under said conditions that enable nucleic acid amplification to generate a vanA amplicon if said sample comprises a pathogen comprising said vanA gene; and determining whether or not said vanA amplicon is present.

3. The method of claim 1, further comprising:

contacting said sample with an amplification primer pair that hybridizes to and is capable of amplifying sequences from a vanC gene under said conditions that enable nucleic acid amplification, to generate a vanC amplicon if said sample comprises a pathogen comprising said vanC gene; and determining whether or not said vanC amplicon is present.

4. The method of claim 2, further comprising:

contacting said sample with an amplification primer pair that hybridizes to and is capable of amplifying sequences from a vanC gene under said conditions that enable nucleic acid amplification, to generate a vanC amplicon if said sample comprises a pathogen comprising said vanC gene; and determining whether or not said vanC amplicon is present.

5. The method of claim 1, wherein said method further comprises contacting said sample with a probe comprising an oligonucleotide that hybridizes to a portion of the vanB amplicon under said conditions that enable nucleic acid amplification.

6. The method of claim 5, wherein said probe comprises a fluorescent moiety.

7. The method of claim 6, wherein said probe is a molecular beacon.

8. The method of claim 1 wherein said method comprises performing a nucleic acid amplification assay selected from the group consisting of:

(a) polymerase chain reaction (PCR), (b) ligase chain reaction, (c) nucleic acid sequence-based amplification, (d) self-sustained sequence replication, (e) strand displacement amplification,
(f) branched DNA signal amplification,
(g) nested PCR, and
(h) multiplex PCR.

9. The method of claim 8, wherein said nucleic acid amplification assay comprises PCR.

10. The method of claim 8, wherein said nucleic acid amplification assay comprises multiplex PCR.

11. A composition for the detection of a vancomycin resistant pathogen in a sample using a nucleic acid amplification assay, comprising:

an amplification primer pair, said amplification primer pair comprising an oligonucleotide consisting of SEQ ID NO: 1096 or the complement thereof, or variants of SEQ ID NO: 1096, wherein said variants optionally have up to three nucleotide changes compared to SEQ ID NO: 1096, wherein said variants are capable of hybridizing to and amplifying nucleic acids from a vanB gene in said nucleic acid amplification assay.

12. The composition of claim 11, wherein said amplification primer pair further comprises an oligonucleotide consisting of SEQ ID NO: 1095 or the complement thereof, or variants of SEQ ID NO: 1095, wherein said variants optionally have up to three nucleotide changes compared to SEQ ID NO: 1095, wherein said variants are capable of hybridizing to and amplifying nucleic acids from a vanB gene in said nucleic acid amplification assay.

13. The composition of claim 12, wherein each oligonucleotide optionally includes a detectable moiety.

14. The composition of claim 11, further comprising a probe comprising an oligonucleotide that hybridizes to a portion of the vanB amplicon.

15. The composition of claim 14, wherein said probe comprises a fluorescent moiety.

16. The composition of claim 15, wherein said probe is a molecular beacon.

17. The composition of claim 11, further comprising dideoxynucleotide triphosphates.

18. The composition of claim 11, further comprising a polymerase.

19. The composition of claim 11, further comprising a buffer.

20. The composition of claim 11, further comprising an internal control nucleic acid.

* * * * *